United States Patent 12,152,077 (IMMUNOTHERAPY TARGETING TUMOR NEOANTIGENIC PEPTIDES) - sequence listing, part 4

SEQ ID NO: 8507 - DNA, 8628 bp, synthetic construct
  misc_feature 1..8628: note = Synthetic polypeptide
  source 1..8628: mol_type = other DNA
ctttcccaccggagtgagccctgagttcagggcctagtgtgatctactcagcactgtatccctggcttctcccacctgcccagtgggctgtacccatcctacctccacctgaaccacctggagccccccagcagtgggagccccctcctcagccagctgggtcagcccagcattttcgatacccagaaaggtcaggggccaggaggagacggtttctacctgcccaccgcgggggctccgggctccctgcactctcacgcgccctcggcccggacccctggcggcggccactcctcgggcgccccggccaaaggctcgtcgtcgcgggacggtccagccaaggagcgggcgggccgcggcggggagccgcctccgcttttcggcaagaaggacccgcgcgcccggggcgaggaggcctcggggccacggggcgtggtggacctgacccaggaggcgcgcgccgagggccgccaggaccgggggcccccgcgcctggctgagcgcctgtcgcccttcctggctgagtccaagaccaagaatgcggcgctgcagccgtcggtactgaccatgtgcaacggcggcgccggggacgtggggctgcccgcgctggtggccgaagcggggcgcgggggtgccaaggaggctgcccggcaggacgagggcgcgcggctgctgcggcgcacggagaccctgctccctgggccgcgcccctgcccctcaccgctgcccccgccgcccgcgccccccaaggggcctcctgcaccccccgcggccacccccgccggcgtctacaccgtcttccgcgagcagggccgtgagcaccgcgtggtggcgcccaccttcgtgccttccgtggaggccttcgacgagcgcccggggcccatccagatcgcatcccaggcgcgcgatgcccgggcccgcgagcgcgaggctggcaggccaggggtcctgcaggcgccccccggctccccgcggcctctggaccggcccgagggcctgcgcgagaagaactcggtcatccgctcgctcaagcggccgccccccgcggatgcccccacggtgcgggccacacgcgcctccccggacccccgcgcctacgtgcctgccaaggagctgctcaagcccgaggcggacccgaggccctgcgagcgtgcgccccgcggcccagccggtcctgcagcccaacaggccgccaagctcttcggcctggagcccgggcgccccccgcccaccggccctgagcataaatggaaacccttcgagctgggcaacttcgccgccacgcagatggccgtgctggccgcgcagcaccaccacagccgcgccgaagaggaggccgccgtggtcgctgcctcctcctccaagaaggcctacctggaccctggggctgtgctgccccgctcggcggccacctgcggccggccggtcgctgacatgcactctgcggcccacgggtctggagaggcctcggccatgcagagccttataaagtacagtggcagctttgcccgggacgccgtggccgtgcgccctggtggctgtggcaagaagagcccctttggaggtttgggcaccatgaaacccgagcctgcgcccacctctgcgggtgcctcccgagcccaggcccgtctcccacactccggaggccctgcagcgggcggcggccggcagctgaagcgggaccccgagaggcccgagagcgccaaagctttcgggcgcgagggctctggtgcccagggtgaggcagaagtgcgacacccgcctgtgggcattgcagtggctgtggcccggcagaaggacagtggcggcagtggccggctggggcctgggctggtagaccaggagcgctctctgtcgctgagtaacgtcaaagggcacggccgagcagatgaggactgtgtggacgaccgggccagacaccgggaggaacggctgctcggggcacggctggaccgggatcaggagaagctgctcagagagagtaaggagctggctgacctggcccgcctgcaccctaccagctgtgctcctaacggcctgaaccccaacctcatggtgacggggggcccggcgctggcgggctcaggtcgctggtctgccgaccccgcagcccatctggccacgcacccctggttgccccgctcgggcaacgcatccatgtggctcgctggacacccctacggcttgggtcccccatctctgcaccagggcatggcccctgcgttcccacctggcctggggggctccctcccgtcagcctaccagtttgtcagggacccccaatcgggccagctggtggtcattcccagtgatcaccttcctcactttgcggagctgatggagcgggccaccgtaccgcccctctggcccgccctgtacccgccgggccgcagccccctgcaccacgcccagcagctgcagctcttctcacagcagcacttcctgcggcagcaggagttcctgtacctgcagcagcaggcggcccaggccttggaactgcagaggagcgcccagctcgtgcaggagcggttgaaggcgcaggagcaccgggcggagatggaagagaaggggagcaagcggggcctggaggctgcgggcaaggctggcctggccaccgccggccccgggctgctgccgcggaagccccctggcctggccgccggccccgcgggcacctacggcaaggccgtgagcccgccaccatcaccccgcgcatcccctgtggctgccctgaaggccaaggtcatccagaagctggaggacgtgtccaagccacccgcctacgcctaccccgccacccccagctcccaccccaccagcccgccgcccgcctccccaccgcccaccccgggtatcacccgcaaggaggaggctcccgagaatgtggtcgagaagaaagacttggagttggagaaggaagcccccagccccttccaggccctgttctcagatatcccgcccaggtacccgttccaagccctgccaccgcactacgggaggccctaccctttcctgctgcagcccacggccgccgccgacgcggacggcttggcccctgatgtgccgctcccggctgatgggcccgagcgcctggcactctcacccgaagacaagcccatccgcttgtccccctccaagatcacagagccgctgcgggagggcccggaggaagaaccgctggctgagcgggaggtgaaggcagaggtggaggacatggacgagggccccacagagctgccgcctctggagtcgccgctgccactgcccgccgcggaagccatggctacccccagccctgcagggggttgtggaggtggcctgttggaggcccaggcgctgagtgccaccgggcagagctgcgcagagccctctgagtgtccagactttgtggaggggcctgaaccacgggtggattccccgggccggacagaaccctgcaccgccgccctggacctgggggtgcagctgacacccgagacactggtggaggccaaggaggagccggtggaggtgcctgtggcggtgcccgtggtggaggcagtgcccgaggaaggcctggcgcaggtggcaccgagcgagtcccagcccaccctagaaatgtcagactgtgacgtgcccgccggggagggacagtgcccgagcctggagccccaagaggccgtgcctgtactcggcagcacctgcttcctggaagaggcaagctctgaccagttcctgcccagtctggaggacccactggctggcatgaacgccctggcggcagctgcggagctgccccaggccaggcctctgccctccccgggtgctgctggagcccaggccttggagaagctggaagcagccgagagccttgtcttggagcagagcttcctgcatggcatcaccctgctaagtgagatcgcagagctggagctggagaggaggagccaagagatgggaggtgcggagcgggccctggtggcgcggccctccctggagagtctgctggcagctggcagccacatgctgagggaggtgctggatgggcccgtggtggacccactcaagaacctgcggctcccgcgggagctgaagcccaacaagaagtacagctggatgcgcaagaaggaggagcggatgtatgccatgaagtcctccctggaggacatggacgccctggagctggacttccggatgcggctggccgaggtgcagcgccagtacaaggagaagcagcgtgagctggtgaagctgcagcgccgccgggactccgaggacaggcgcgaggaaccccatagaagcttggcacgcagaggccctggcaggccgcggaaacggacccacgccccgagcgccctgtcgcccccccgcaagagagggaagagcggccacagtagcggaaagctgagcagcaagtctctgctgacatcagatgattatgagctgggagcagggataagaaagagacacaaggggtctgaggaggaacatgatgccctcatcggaatggggaaagccagggggaggaaccagacttgggatgaacatgaggcctcgtcggacttcatcagtcagctaaagattaagaagaagaagatggccagcgaccaggagcagttggcaagcaagctcgacaaggccctctccctcaccaagcaggacaagttgaagtcgcccttcaagttttcggacagtgctggggggaaatcgaaaactagcgggggctgcggcaggtacttgactccttacgacagcctgctggggaagaacaggaaggcgctggccaagggcctcggcctgtctctgaaatcctccagagaaggtaaacacaaaagggcagccaaaaccaggaagatggaggtggggttcaaggccagaggccagcccaagtcggcccattccccgtttgcctcggaagtgagcagctactcttacaatacggactcagaggaagacgaagaattcctgaaggacgagtggcccgcccaaggcccctccagctccaaactgacgccttccctcctgtgtagcatggtggcaaagaacagcaaggcagctggtggccccaagctgaccaagaggggcctggcggccccccggactctgaaacccaagccggccaccagcaggaagcagccgttttgtctgctgcttcgagaggccgaggcgcgttcctccttcagcgactcttcggaggaatcgtttgaccaagatgagagctcggaggaggaggacgaggaggaggagctcgaggaggaggacgaggccagcggtggtggctacaggctgggtgcccgggagcgggccctgtcaccgggcctggaggagagtgggctgggcctgctggcacgcttcgccgccagcgccctccccagccccacggtgggtccatccctgtctgtggtacagctggaggccaagcagaaggcccggaagaaagaggagcggcagagcctgctgggcacagagttcgagtacaccgactcagagagcgaggtcaaggtgcgcaagcggtcgcctgcggggctgctgcggcccaagaaggggctgggggagccgggaccctccctggccgcacccacgcctggcgcccgcggtcccgaccccagcagcccagacaaggccaagctggcggtggagaaggggcgcaaggcccggaagctgcggggccccaaggagcctggcttcgaggcggggcccgaggccagcgacgacgacctgtggacgcggcgccgcagcgagcgcatcttcctgcacgacgcctcggctgctgcacctgcgcccgtcagcaccgcgcccgccaccaagaccagccgctgcgccaagggcggccccctgagcccgcgcaaggacgccgggcgtgcaaaggacaggaaggaccccaggaagaagaagaaagggaaagaggctgggccaggagctgggctgccgccgccccgagctcctgccttgccctctgaggccagggctcctcacgccagctccctgaccgctgccaaaaggagcaaagccaaggccaaagggaaggaggtgaagaaggagaaccgcggcaaggggggtgccgtgagcaagctgatggagagcatggcagccgaggaggactttgaacccaaccaagactcgagcttctctgaggacgagcacctgccgcgtggcggggctgtggagcggccgctgaccccggcccctcgctcctgcatcatcgacaaggatgagctgaaggacggcctgcgtgtgctcatccccatggatgacaagctgctgtacgccgggcacgtgcagaccgtgcactcgccagacatataccgcgtggtggtggagggtgagcggggcaaccggccccacatctactgtctggagcagttgctgcaggaggcgatcatcgatgtgaggccagcctccactcgcttcttgccacaagggaccaggattgcagcctactggagccagcagtaccgctgtctctacccaggcactgtggtccgagggttactggacctggaggacgatggggacttgatcaccgtggagtttgacgacggagacacgggcaggatccccctctcacatatccgcctcctgccccctgactataagatacagtgtgctgagccgtccccggcccttctggtgccaagtgccaagcgccgcagccggaagaccagcaaagacactggggagggcaaagatggtggcacggctgggtcggaggagccaggagccaaggcccgtgggcgtgggcggaaacccagcgccaaggccaagggtggtagagccgctaccctggaggaggggaacccaacagacgaggtccccagtacccccttagccctggagccgagcagcaccccaggttccaagaagagccccccagagcctgtggacaagcgagccaaggcccccaaggcgcgcccggcaccgccgcagcccagtcccgcaccacccgccttcaccagctgcccagcacccgagccatttgcagagctgccagctcctgccacctccctggccccagcacccctcatcaccatgcctgccacacgccccaagcccaagaaggcgcgggcagccgaggagtcgggtgccaagggccctcggaggccgggggaggaggccgagctgcttgtcaaactggaccacgagggtgtcacgtcacccaaaagcaagaaggctaaagaggccctgctgctccgggaggatccgggggcggggggctggcaggagcccaagagcctcctgagcctgggcagctatccccccgcggccggcagcagcgagcccaaggcaccctggcccaaggccaccgacggggacctcgcccaggagcccgggccggggctcacgttcgaggactctgggaaccccaagagcccagacaaggcccaggctgagcaggacggggccgaagagtccgagagcagcagcagcagcagtagtggcagcagtagcagcagcagcagcagcagcagcagcggctcggagacagaaggggaggaggaaggcgacaagaacggggacgggggctgcggcaccgggggccgtaactgcagcgctgccagctccagggcggcctcaccggcctcctcctcctcctcctcatcctcctcctcctcctcctcctcctcctcatcctcctcttcctcctcctcctcttcctcctcctcctcttcctcttcgtcttcctcctcttcctcctcctcctcttcctcgtcctcatcctcctcctcctcctcctcttcctcctcttcttcctccaccacagacgaggactcttcctgcagctcggacgatgaggcagcccccgcccccacggctggcccttccgcgcaggcggcgctccccaccaaggccaccaagcaggccggcaaggcgcggccctcggcccactccccaggcaagaagacgcccgcgccccagccccaggcgcctcctccgcagcccacacagcctctgcagcccaaggctcaggccggggccaagagccgacccaagaagagagagggcgtccacctccccaccaccaaggagctggccaagcggcagcgcctgccgtccgtggagaaccggcccaagatcgccgccttcctgccagcccggcagctctggaagtggttcggcaagcccacccagcggcgtggcatgaagggcaaggcccgcaagctcttctacaaggccatcgtgcgcggcaaggagatgatccgtatcggggactgtgccgtgttcctctctgccggccgccccaacctgccctacatcggccgcatccagagcatgtgggagtcgtggggcaacaacatggtggtccgcgtcaagtggttctaccaccccgaggagaccagcccgggcaagcagttccaccagggccagcactgggaccagaagtccagccgcagcctcccggcggccctgcgggtctccagccagaggaaggacttcatggagcgcgcgctataccagtcctcgcatgtggacgaaaatgacgtgcagacggtgtcgcacaagtgcctggtggtgggcctggagcagtatgagcagatgctgaagaccaagaagtaccaggacagcgagggcctgtactacctcgcgggcacctacgagcccaccacgggcatgatcttctccacggacggcgtgcccgtgctctgctga

SEQ ID NO: 8508 - DNA, 8628 bp, synthetic construct
  misc_feature 1..8628: note = Synthetic polypeptide
  source 1..8628: mol_type = other DNA
ctttcccaccggagtgagccctgagttcagggcctagtgtgatctactcagcactgtatccctggcttctcccacctgcccagtgggctgtacccatcctacctccacctgaaccacctggagccccccagcagtgggagccccctcctcagccagctgggtcagcccagcattttcgatacccagaaaggtcaggggccaggaggagacggtttctacctgcccaccgcgggggctccgggctccctgcactctcacgcgccctcggcccggacccctggcggcggccactcctcgggcgccccggccaaaggctcgtcgtcgcgggacggtccagccaaggagcgggcgggccgcggcggggagccgcctccgcttttcggcaagaaggacccgcgcgcccggggcgaggaggcctcggggccacggggcgtggtggacctgacccaggaggcgcgcgccgagggccgccaggaccgggggcccccgcgcctggctgagcgcctgtcgcccttcctggctgagtccaagaccaagaatgcggcgctgcagccgtcggtactgaccatgtgcaacggcggcgccggggacgtggggctgcccgcgctggtggccgaagcggggcgcgggggtgccaaggaggctgcccggcaggacgagggcgcgcggctgctgcggcgcacggagaccctgctccctgggccgcgcccctgcccctcaccgctgcccccgccgcccgcgccccccaaggggcctcctgcaccccccgcggccacccccgccggcgtctacaccgtcttccgcgagcagggccgtgagcaccgcgtggtggcgcccaccttcgtgccttccgtggaggccttcgacgagcgcccggggcccatccagatcgcatcccaggcgcgcgatgcccgggcccgcgagcgcgaggctggcaggccaggggtcctgcaggcgccccccggctccccgcggcctctggaccggcccgagggcctgcgcgagaagaactcggtcatccgctcgctcaagcggccgccccccgcggatgcccccacggtgcgggccacacgcgcctccccggacccccgcgcctacgtgcctgccaaggagctgctcaagcccgaggcggacccgaggccctgcgagcgtgcgccccgcggcccagccggtcctgcagcccaacaggccgccaagctcttcggcctggagcccgggcgccccccgcccaccggccctgagcataaatggaaacccttcgagctgggcaacttcgccgccacgcagatggccgtgctggccgcgcagcaccaccacagccgcgccgaagaggaggccgccgtggtcgctgcctcctcctccaagaaggcctacctggaccctggggctgtgctgccccgctcggcggccacctgcggccggccggtcgctgacatgcactctgcggcccacgggtctggagaggcctcggccatgcagagccttataaagtacagtggcagctttgcccgggacgccgtggccgtgcgccctggtggctgtggcaagaagagcccctttggaggtttgggcaccatgaaacccgagcctgcgcccacctctgcgggtgcctcccgagcccaggcccgtctcccacactccggaggccctgcagcgggcggcggccggcagctgaagcgggaccccgagaggcccgagagcgccaaagctttcgggcgcgagggctctggtgcccagggtgaggcagaagtgcgacacccgcctgtgggcattgcagtggctgtggcccggcagaaggacagtggcggcagtggccggctggggcctgggctggtagaccaggagcgctctctgtcgctgagtaacgtcaaagggcacggccgagcagatgaggactgtgtggacgaccgggccagacaccgggaggaacggctgctcggggcacggctggaccgggatcaggagaagctgctcagagagagtaaggagctggctgacctggcccgcctgcaccctaccagctgtgctcctaacggcctgaaccccaacctcatggtgacggggggcccggcgctggcgggctcaggtcgctggtctgccgaccccgcagcccatctggccacgcacccctggttgccccgctcgggcaacgcatccatgtggctcgctggacacccctacggcttgggtcccccatctctgcaccagggcatggcccctgcgttcccacctggcctggggggctccctcccgtcagcctaccagtttgtcagggacccccaatcgggccagctggtggtcattcccagtgatcaccttcctcactttgcggagctgatggagcgggccaccgtaccgcccctctggcccgccctgtacccgccgggccgcagccccctgcaccacgcccagcagctgcagctcttctcacagcagcacttcctgcggcagcaggagttcctgtacctgcagcagcaggcggcccaggccttggaactgcagaggagcgcccagctcgtgcaggagcggttgaaggcgcaggagcaccgggcggagatggaagagaaggggagcaagcggggcctggaggctgcgggcaaggctggcctggccaccgccggccccgggctgctgccgcggaagccccctggcctggccgccggccccgcgggcacctacggcaaggccgtgagcccgccaccatcaccccgcgcatcccctgtggctgccctgaaggccaaggtcatccagaagctggaggacgtgtccaagccacccgcctacgcctaccccgccacccccagctcccaccccaccagcccgccgcccgcctccccaccgcccaccccgggtatcacccgcaaggaggaggctcccgagaatgtggtcgagaagaaagacttggagttggagaaggaagcccccagccccttccaggccctgttctcagatatcccgcccaggtacccgttccaagccctgccaccgcactacgggaggccctaccctttcctgctgcagcccacggccgccgccgacgcggacggcttggcccctgatgtgccgctcccggctgatgggcccgagcgcctggcactctcacccgaagacaagcccatccgcttgtccccctccaagatcacagagccgctgcgggagggcccggaggaagaaccgctggctgagcgggaggtgaaggcagaggtggaggacatggacgagggccccacagagctgccgcctctggagtcgccgctgccactgcccgccgcggaagccatggctacccccagccctgcagggggttgtggaggtggcctgttggaggcccaggcgctgagtgccaccgggcagagctgcgcagagccctctgagtgtccagactttgtggaggggcctgaaccacgggtggattccccgggccggacagaaccctgcaccgccgccctggacctgggggtgcagctgacacccgagacactggtggaggccaaggaggagccggtggaggtgcctgtggcggtgcccgtggtggaggcagtgcccgaggaaggcctggcgcaggtggcaccgagcgagtcccagcccaccctagaaatgtcagactgtgacgtgcccgccggggagggacagtgcccgagcctggagccccaagaggccgtgcctgtactcggcagcacctgcttcctggaagaggcaagctctgaccagttcctgcccagtctggaggacccactggctggcatgaacgccctggcggcagctgcggagctgccccaggccaggcctctgccctccccgggtgctgctggagcccaggccttggagaagctggaagcagccgagagccttgtcttggagcagagcttcctgcatggcatcaccctgctaagtgagatcgcagagctggagctggagaggaggagccaagagatgggaggtgcggagcgggccctggtggcgcggccctccctggagagtctgctggcagctggcagccacatgctgagggaggtgctggatgggcccgtggtggacccactcaagaacctgcggctcccgcgggagctgaagcccaacaagaagtacagctggatgcgcaagaaggaggagcggatgtatgccatgaagtcctccctggaggacatggacgccctggagctggacttccggatgcggctggccgaggtgcagcgccagtacaaggagaagcagcgtgagctggtgaagctgcagcgccgccgggactccgaggacaggcgcgaggaaccccatagaagcttggcacgcagaggccctggcaggccgcggaaacggacccacgccccgagcgccctgtcgcccccccgcaagagagggaagagcggccacagtagcggaaagctgagcagcaagtctctgctgacatcagatgattatgagctgggagcagggataagaaagagacacaaggggtctgaggaggaacatgatgccctcatcggaatggggaaagccagggggaggaaccagacttgggatgaacatgaggcctcgtcggacttcatcagtcagctaaagattaagaagaagaagatggccagcgaccaggagcagttggcaagcaagctcgacaaggccctctccctcaccaagcaggacaagttgaagtcgcccttcaagttttcggacagtgctggggggaaatcgaaaactagcgggggctgcggcaggtacttgactccttacgacagcctgctggggaagaacaggaaggcgctggccaagggcctcggcctgtctctgaaatcctccagagaaggtaaacacaaaagggcagccaaaaccaggaagatggaggtggggttcaaggccagaggccagcccaagtcggcccattccccgtttgcctcggaagtgagcagctactcttacaatacggactcagaggaagacgaagaattcctgaaggacgagtggcccgcccaaggcccctccagctccaaactgacgccttccctcctgtgtagcatggtggcaaagaacagcaaggcagctggtggccccaagctgaccaagaggggcctggcggccccccggactctgaaacccaagccggccaccagcaggaagcagccgttttgtctgctgcttcgagaggccgaggcgcgttcctccttcagcgactcttcggaggaatcgtttgaccaagatgagagctcggaggaggaggacgaggaggaggagctcgaggaggaggacgaggccagcggtggtggctacaggctgggtgcccgggagcgggccctgtcaccgggcctggaggagagtgggctgggcctgctggcacgcttcgccgccagcgccctccccagccccacggtgggtccatccctgtctgtggtacagctggaggccaagcagaaggcccggaagaaagaggagcggcagagcctgctgggcacagagttcgagtacaccgactcagagagcgaggtcaaggtgcgcaagcggtcgcctgcggggctgctgcggcccaagaaggggctgggggagccgggaccctccctggccgcacccacgcctggcgcccgcggtcccgaccccagcagcccagacaaggccaagctggcggtggagaaggggcgcaaggcccggaagctgcggggccccaaggagcctggcttcgaggcggggcccgaggccagcgacgacgacctgtggacgcggcgccgcagcgagcgcatcttcctgcacgacgcctcggctgctgcacctgcgcccgtcagcaccgcgcccgccaccaagaccagccgctgcgccaagggcggccccctgagcccgcgcaaggacgccgggcgtgcaaaggacaggaaggaccccaggaagaagaagaaagggaaagaggctgggccaggagctgggctgccgccgccccgagctcctgccttgccctctgaggccagggctcctcacgccagctccctgaccgctgccaaaaggagcaaagccaaggccaaagggaaggaggtgaagaaggagaaccgcggcaaggggggtgccgtgagcaagctgatggagagcatggcagccgaggaggactttgaacccaaccaagactcgagcttctctgaggacgagcacctgccgcgtggcggggctgtggagcggccgctgaccccggcccctcgctcctgcatcatcgacaaggatgagctgaaggacggcctgcgtgtgctcatccccatggatgacaagctgctgtacgccgggcacgtgcagaccgtgcactcgccagacatataccgcgtggtggtggagggtgagcggggcaaccggccccacatctactgtctggagcagttgctgcaggaggcgatcatcgatgtgaggccagcctccactcgcttcttgccacaagggaccaggattgcagcctactggagccagcagtaccgctgtctctacccaggcactgtggtccgagggttactggacctggaggacgatggggacttgatcaccgtggagtttgacgacggagacacgggcaggatccccctctcacatatccgcctcctgccccctgactataagatacagtgtgctgagccgtccccggcccttctggtgccaagtgccaagcgccgcagccggaagaccagcaaagacactggggagggcaaagatggtggcacggctgggtcggaggagccaggagccaaggcccgtgggcgtgggcggaaacccagcgccaaggccaagggtgacagagccgctaccctggaggaggggaacccaacagacgaggtccccagtacccccttagccctggagccgagcagcaccccaggttccaagaagagccccccagagcctgtggacaagcgagccaaggcccccaaggcgcgcccggcaccgccgcagcccagtcccgcaccacccgccttcaccagctgcccagcacccgagccatttgcagagctgccagctcctgccacctccctggccccagcacccctcatcaccatgcctgccacacgccccaagcccaagaaggcgcgggcagccgaggagtcgggtgccaagggccctcggaggccgggggaggaggccgagctgcttgtcaaactggaccacgagggtgtcacgtcacccaaaagcaagaaggctaaagaggccctgctgctccgggaggatccgggggcggggggctggcaggagcccaagagcctcctgagcctgggcagctatccccccgcggccggcagcagcgagcccaaggcaccctggcccaaggccaccgacggggacctcgcccaggagcccgggccggggctcacgttcgaggactctgggaaccccaagagcccagacaaggcccaggctgagcaggacggggccgaagagtccgagagcagcagcagcagcagtagtggcagcagtagcagcagcagcagcagcagcagcagcggctcggagacagaaggggaggaggaaggcgacaagaacggggacgggggctgcggcaccgggggccgtaactgcagcgctgccagctccagggcggcctcaccggcctcctcctcctcctcctcatcctcctcctcctcctcctcctcctcctcatcctcctcttcctcctcctcctcttcctcctcctcctcttcctcttcgtcttcctcctcttcctcctcctcctcttcctcgtcctcatcctcctcctcctcctcctcttcctcctcttcttcctccaccacagacgaggactcttcctgcagctcggacgatgaggcagcccccgcccccacggctggcccttccgcgcaggcggcgctccccaccaaggccaccaagcaggccggcaaggcgcggccctcggcccactccccaggcaagaagacgcccgcgccccagccccaggcgcctcctccgcagcccacacagcctctgcagcccaaggctcaggccggggccaagagccgacccaagaagagagagggcgtccacctccccaccaccaaggagctggccaagcggcagcgcctgccgtccgtggagaaccggcccaagatcgccgccttcctgccagcccggcagctctggaagtggttcggcaagcccacccagcggcgtggcatgaagggcaaggcccgcaagctcttctacaaggccatcgtgcgcggcaaggagatgatccgtatcggggactgtgccgtgttcctctctgccggccgccccaacctgccctacatcggccgcatccagagcatgtgggagtcgtggggcaacaacatggtggtccgcgtcaagtggttctaccaccccgaggagaccagcccgggcaagcagttccaccagggccagcactgggaccagaagtccagccgcagcctcccggcggccctgcgggtctccagccagaggaaggacttcatggagcgcgcgctataccagtcctcgcatgtggacgaaaatgacgtgcagacggtgtcgcacaagtgcctggtggtgggcctggagcagtatgagcagatgctgaagaccaagaagtaccaggacagcgagggcctgtactacctcgcgggcacctacgagcccaccacgggcatgatcttctccacggacggcgtgcccgtgctctgctga

SEQ ID NO: 8509 - DNA, 240 bp, synthetic construct
  misc_feature 1..240: note = Synthetic polypeptide
  source 1..240: mol_type = other DNA
ctttcccaccggagtgagccctgagttcagggcctagtgtgatctactcagcactgtatccctggcttctcccacctgcccagtgggctgtacccatcctacctccacctgaaccacctggagccccccagcagtgggagccccctcctcagccagctgggtcagcccagcattttcgatacccagaaaggtcaggggccaggaggagacggtttctacctgcccaccgcgggggctccg

SEQ ID NO: 8510 - DNA, 336 bp, synthetic construct
  misc_feature 1..336: note = Synthetic polypeptide
  source 1..336: mol_type = other DNA
ctttcccaccggagtgagccctgagttcagggcctagtgtgatctactcagcactgtatccctggcttctcccacctgcccagtgggctgtacccatcctacctccacctgaaccacctggagccccccagcagtgggagccccctcctcagccagctgggtcagcccagcattttcgatacccagaaaggtcaggggccaggaggaggtaagactggagtccggggttgggggtggcacaggggccttctgagaggcttctggggcctttggcagcatccaggtagcccccagctctgtccaggatgctggctttttttttttttttttttttga

SEQ ID NO: 8511 - DNA, 2433 bp, synthetic construct
  misc_feature 1..2433: note = Synthetic polypeptide
  source 1..2433: mol_type = other DNA
ggcagggtgcggtggctcacacctgtaatcccagcactttgggaggccaaggcgggcggatcacgaggtcaggagatcgagaccatcctggctaacacggtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcagaggaactcaaagtgaaaggtcccaaggactccaaggacagccacacgtctgtcaccatggaagctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggagtctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtaccctggaggtggattccttcggctattttgtcagcaaagccaaaaccagggtgttccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtag

SEQ ID NO: 8512 - DNA, 380 bp, synthetic construct
  misc_feature 1..380: note = Synthetic polypeptide
  source 1..380: mol_type = other DNA
ggcagggtgcggtggctcacacctgtaatcccagcactttgggaggccaaggcgggcggatcacgaggtcaggagatcgagaccatcctggctaacacggtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaa

SEQ ID NO: 8513 - DNA, 257 bp, synthetic construct
  misc_feature 1..257: note = Synthetic polypeptide
  source 1..257: mol_type = other DNA
ggcagggtgcggtggctcacacctgtaatcccagcactttgggaggccaaggcgggcggatcacgaggtcaggagatcgagaccatcctggctaacacggtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagca

SEQ ID NO: 8514 - DNA, 250 bp, synthetic construct
  misc_feature 1..250: note = Synthetic polypeptide
  source 1..250: mol_type = other DNA
ggcagggtgcggtggctcacacctgtaatcccagcactttgggaggccaaggcgggcggatcacgaggtcaggagatcgagaccatcctggctaacacggtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcacca

SEQ ID NO: 8515 - DNA, 1967 bp, synthetic construct; identical to SEQ ID NO: 7428
  misc_feature 1..1967: note = Synthetic polypeptide
  source 1..1967: mol_type = other DNA

SEQ ID NO: 8516 - DNA, 1142 bp, synthetic construct; identical to SEQ ID NO: 7429
  misc_feature 1..1142: note = Synthetic polypeptide
  source 1..1142: mol_type = other DNA

SEQ ID NO: 8517 - DNA, 328 bp, synthetic construct
  misc_feature 1..328: note = Synthetic polypeptide
  source 1..328: mol_type = other DNA
ggccgggcgcggtggctcacgcctgtaatcccagcactttgggaggccaagagatggacagagacgtatgtgcgttggtctcctaagggcacctacctggctacctttcatcaaagaggcattgctctatgggggggagagaaattcaagcaaattcagagattcagccaccaaggggttcagcttattgacttctcaccttgtgaaaggtacctggtgacctttagccccctgatggacacgcaggatgaccctcaggccataatcatctgggacatccttacggggcacaagaagaggggttttcactgtgagagctcagcccatt

SEQ ID NO: 8518 - DNA, 1497 bp, synthetic construct
  misc_feature 1..1497: note = Synthetic polypeptide
  source 1..1497: mol_type = other DNA
ggccgggcgcggtggctcacgcctgtaatcccagcactttgggaggccaagagatggacagagacgtatgtgcgttggtctcctaagggcacctacctggctacctttcatcaaagaggcattgctctatgggggggagagaaattcaagcaaattcagagattcagccaccaaggggttcagcttattgacttctcaccttgtgaaaggtacctggtgacctttagccccctgatggacacgcaggatgaccctcaggccataatcatctgggacatccttacggggcacaagaagaggggttttcactgtgagagctcagcccattggcctatttttaagtggagccatgatggcaaattctttgccagaatgaccctggatacgcttagcatctatgaaactccttctatgggtcttttggacaagaagagtttgaagatctctgggataaaagacttttcttggtctcctggtggtaacataatcgccttctgggtgcctgaagacaaagatattccagccagggtaaccctgatgcagctccctaccaggcaagagatccgagtgaggaacctgttcaatgtggtggactgcaagctccattggcagaagaacggagactacttgtgtgtgaaagtagataggactccgaaaggcacccagggtgttgtcacaaattttgaaattttccgaatgagggagaaacaggtacctgtggatgtggtcgagatgaaagaaaccatcatagcctttgcctgggaaccaaatggaagtaagtttgctgtgctgcacggagaggctccgcggatatctgtgtctttctaccacgtcaaaaacaacgggaagattgaactcatcaagatgttcgacaagcagcaggcgaacaccatcttctggagcccccaaggacagttcgtggtgttggcgggcctgaggagtatgaacggtgccttagcgtttgtggacacttcggactgcacggtcatgaacatcgcagagcactacatggcttccgacgtcgaatgggatcctactgggcgctacgtcgtcacctctgtgtcctggtggagccataaggtggacaacgcgtactggctgtggactttccagggacgcctcctgcagaagaacaacaaggaccgcttctgccagctgctgtggcggccccggcctcccacactcctgagccaggaacagatcaagcaaattaaaaaggatctgaagaaatactctaagatctttgaacagaaggatcgtttgagtcagtccaaagcctcaaaggaattggtggagagaaggcgcaccatgatggaagatttccggaagtaccggaaaatggcccaggagctctatatggagcagaaaaacgagcgcctggagttgcgaggaggggtggacactgacgagctggacagcaacgtggacgactgggaagaggagaccattgagttcttcgtcactgaagaaatcattcccctcgggaatcaggagtga

SEQ ID NO: 8519 - DNA, 76 bp, synthetic construct
  misc_feature 1..76: note = Synthetic polypeptide
  source 1..76: mol_type = other DNA
ggccgggcgcggtggctcacgcctgtaatcccagcactttgggaggccaagagatggacagagacgtatgtgcgtt

SEQ ID NO: 8520 - DNA, 1477 bp, synthetic construct; identical to SEQ ID NO: 509
  misc_feature 1..1477: note = Synthetic polypeptide
  source 1..1477: mol_type = other DNA

SEQ ID NO: 8521 - DNA, 1369 bp, synthetic construct; identical to SEQ ID NO: 510
  misc_feature 1..1369: note = Synthetic polypeptide
  source 1..1369: mol_type = other DNA

SEQ ID NO: 8522 - DNA, 709 bp, synthetic construct; identical to SEQ ID NO: 511
  misc_feature 1..709: note = Synthetic polypeptide
  source 1..709: mol_type = other DNA

SEQ ID NO: 8523 - DNA, 1681 bp, synthetic construct
  misc_feature 1..1681: note = Synthetic polypeptide
  source 1..1681: mol_type = other DNA
gaaagagcactggacttggagtctaaacacaggacaagggcacacaactggttccgttaagcccctctcttgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaagtacgaactgttcaagagctccccacactccctgttcccagaaaaaatggtctccagctgtctcgatgcacacactggtatatcccatgaagacctcatccagaacttcctgaatgctggcagctttcctgagatccagggctttctgcagctgcggggttcaggacggaagctttggaaacgctttttctgcttcttgcgccgatctggcctctattactccaccaagggcacctctaaggatccgaggcacctgcagtacgtggcagatgtgaacgagtccaacgtgtacgtggtgacgcagggccgcaagctctacgggatgcccactgacttcggtttctgtgtcaagcccaacaagcttcgaaatggccacaaggggcttcggatcttctgcagtgaagatgagcagagccgcacctgctggctggctgccttccgcctcttcaagtacggggtgcagctgtacaagaattaccagcaggcacagtctcgccatctgcatccatcttgtttgggctccccacccttgagaagtgcctcagataataccctggtggccatggacttctctggccatgctgggcgtgtcattgagaacccccgggaggctctgagtgtggccctggaggaggcccaggcctggaggaagaagacaaaccaccgcctcagcctgcccatgccagcctccggcacgagcctcagtgcagccatccaccgcacccaactctggttccacgggcgcatttcccgtgaggagagccagcggcttattggacagcagggcttggtagacggcctgttcctggtccgggagagtcagcggaacccccagggctttgtcctctctttgtgccacctgcagaaagtgaagcattatctcatcctgccgagcgaggaggagggccgcctgtacttcagcatggatgatggccagacccgcttcactgacctgctgcagctcgtggagttccaccagctgaaccgcggcatcctgccgtgcttgctgcgccattgctgcacgcgggtggccctctga

SEQ ID NO: 8524 - DNA, 3744 bp, synthetic construct
  misc_feature 1..3744: note = Synthetic polypeptide
  source 1..3744: mol_type = other DNA
agaaggacctccagccttttaccggggagactatgcactggggaagaggctgtaatcagagcctttggggacaactggacctggctctgagctgtcattgatcccaggagacccacgccactgcaggcctcctgtcagagtcagagtcaggccaggtcgagtcaggactgcccacagatcctgccctccacgcagatctacgtgccagtgggagtggtaaaacccatcaccctggccgcacggaacctgccacagccacagtcaggccagcgtggatatgagtgcctcttccacatcccgggcagcccggcccgtgtcaccgccctgcgcttcaacagctccagcctgcagtgccagaattcctcgtactcctacgaggggaacgatgtcagcgacctgccagtgaacctgtcagtcgtgtggaacggcaactttgtcattgacaacccacagaacatccaggcgcacctctacaagtgcccggccctgcgcgagagctgcggcctctgcctcaaggccgacccgcgcttcgagtgcggatggtgcgtggccgagcgccgctgctccctgcgacaccactgcgctgccgacacacctgcatcgtggatgcacgcgcgtcacggcagcagtcgctgcaccgaccccaagatcctcaagctgtcccccgagacgggcccgaggcagggcggcacgcggctcactatcacaggcgagaacctgggcctgcgattcgaagacgtgcgtctgggcgtgcgcgtgggcaaggtgctgtgcagccctgtggagagcgagtacatcagtgcggagcagatcgtctgtgagatcggggacgccagctccgtgcgtgcccatgacgccctggtggaggtgtgtgtgcgggactgctcaccacactaccgcgccctgtcacccaagcgcttcaccttcgtgacaccaaccttctaccgtgtgagcccctcccgtgggcctctgtcagggggcacctggattggcatcgagggaagccacctgaacgcaggcagtgatgtggctgtgtcggtcggtggccggccctgctccttctcctggaggaactcccgtgagatccggtgcctgacaccccccgggcagagccctggcagcgctcccatcatcatcaacatcaaccgcgcccagctcaccaaccctgaggtgaagtacaactacaccgaggaccccaccatcctgaggatcgaccccgagtggagcatcaacagcggtgggaccctcctgacggtcacaggcaccaacctggccactgtccgtgaaccccgaatccgggccaagtatggaggcattgagagggagaacggctgcctggtgtacaatgacaccaccatggtatgccgcgccccgtctgtggccaaccctgtgcgcagcccaccagagctgggggagcggccggatgagctgggcttcgtcatggacaacgtgcgctccctgcttgtgctcaactccacctccttcctctactaccctgaccccgtactggagccactcagccccactggcctgctggagctgaagcccagctccccactcatcctcaagggccggaacctcttgccacctgcacccggcaactcccgactcaactacacggtgctcatcggctccacaccctgtaccctcaccgtgtcggagacgcaactgctgtgcgaggcgcccaacctcactgggcagcacaaggtcacggtgcgggcaggtggcttcgagttctcgccagggacactgcaggtgtactcggacagcctgctgacgctgcctgccattgtgggcattggcggaggcgggggtctcctgctgctggtcatcgtggctgtgctcatcgcctacaagcgcaagtcacgagatgctgaccgcacactcaagcggctgcagctccagatggacaacctggagtcccgcgtggccctcgaatgcaaggaagcctttgcagagctgcagacagacatccacgagctgaccaatgacctggacggtgccggcatccccttccttgactaccggacatatgccatgcgggtgctctttcctgggatcgaggaccaccctgtgctcaaggagatggaggtgcaggccaatgtggagaagtcgctgacactgttcgggcagctgctgaccaagaagcacttcctgctgaccttcatccgcacgctggaggcacagcgcagcttctccatgcgcgaccgcgggaatgtggcctcgctcatcatgacggccctgcagggcgagatggaatacgccacaggcgtgctcaagcagctgctttccgacctcatcgagaagaacctggagagcaagaaccaccccaagctgctactgcgccggactgagtcggtggcagagaagatgctaactaactggttcaccttcctcttgtataagttcctcaaggagtgcgctggggagccgctgttcatgctgtactgcgccatcaagcagcagatggagaagggccccattgacgccatcacgggtgaggcacgctactccctgagtgaggacaagctcatccggcagcagattgactacaagacactgaccctgaactgtgtgaaccctgagaatgagaatgcacctgaggtgccggtgaaggggctggactgtgacacggtcacccaggccaaggagaagctgctggacgctgcctacaagggcgtgccctactcccagcggcccaaggccgcggacatggacctggagtggcgccagggccgcatggcgcgcatcatcctgcaggacgaggacgtcaccaccaagattgacaacgattggaagaggctgaacacactggctcactaccaggtgacagacgggtcctcggtggcactggtgcccaagcagacgtccgcctacaacatctccaactcctccaccttcaccaagtccctcagcagatacgagagcatgctgcgcacggccagcagccccgacagcctgcgctcgcgcacgcccatgatcacgcccgacctggagagcggcaccaagctgtggcacctggtgaagaaccacgaccacctggaccagcgtgagggtgaccgcggcagcaagatggtctcggagatctacttgacacggctactggccaccaagggcacactgcagaagtttgtggacgacctgtttgagaccatcttcagcacggcacaccggggctcagccctgccgctggccatcaagtacatgttcgacttcctggatgagcaggccgacaagcaccagatccacgatgctgacgtgcgccacacctggaagagcaactgcctgcccctgcgcttctgggtgaacgtgatcaagaacccacagtttgtgttcgacattcacaagaacagcatcacggacgcctgcttgtcggtggtggcccagaccttcatggactcctgctccacctctgagcacaagctgggcaaggactcaccctccaacaagctgctctacgccaaggacatccccaactacaagagctgggtggagaggtactatgcagacatcgccaagatgccagccatcagcgaccaggacatgagtgcgtatctggctgagcagtcccgcctgcacctgagccagttcaacagcatgagcgccttgcacgagatctactcctacatcaccaagtacaaggatgagatcctggcagccctggagaaggatgagcaggcgcggcggcagcggctgcggagcaagctggagcaggtggtggacacgatggccctgagcagctga

SEQ ID NO: 8525 - DNA, 795 bp, synthetic construct
  misc_feature 1..795: note = Synthetic polypeptide
  source 1..795: mol_type = other DNA
cggggcggggattggaatacttttctgctacggttcaatgatttggacttgtgtgtatcagagaatgaaaccctcaagcatctcacaaacgacaccacaactccggaaagtacaatgaccagcgggcaggcccgagcttccacccagtccccccaggccctggaggactcgggcccggtgaatatctcagtctcaatcaccctaaccctggacccactgaaacccttcggagggtattcccgcaacgtcacccatctgtactcaaccatcttagggcatcagattggactttcaggcagggaagcccacgaggagataaacatcaccttcaccctgcctacagcgtggagctcagatgactgcgccctccacggtcactgtgagcaggtggtattcacagcctgcatgaccctcacggccagccctggggtgttccccgtcactgtacagccaccgcactgtgttcctgacacgtacagcaacgccacgctctggtacaagatcttcacaactgccagagatgccaacacaaaatacgcccaagattacaatcctttctggtgttataagggggccattggaaaagtctatcatgctttaaatcccaagcttacagtgattgttccagatgatgaccgttcattaataaatttgcatctcatgcacaccagttacttcctctttgtgatggtgataacaatgttttgctatgctgttatcaagggcagacctagcaaattgcgtcagagcaatcctgaattttgtcccgagaaggtggctttggctgaagcctaa

SEQ ID NO: 8526 - DNA, 194 bp, synthetic construct
  misc_feature 1..194: note = Synthetic polypeptide
  source 1..194: mol_type = other DNA
cggggcggggattggaatacttttctgctacggttcaatgatttggacttgtgtgtatcagagaatgaaaccctcaagcatctcacaaacgacaccacaactccggaaagtacaatgaccagcgggcaggcccgagcttccacccagtccccccaggccctggaggactcgggcccggtgaatatctcagtctc

SEQ ID NO: 8527 - DNA, 462 bp, synthetic construct
  misc_feature 1..462: note = Synthetic polypeptide
  source 1..462: mol_type = other DNA
cggggcggggattggaatacttttctgctacggttcaatgatttggacttgtgtgtatcagagaatgaaaccctcaagcatctcacaaacgacaccacaactccggaaagtacaatgaccagcgggcaggcccgagcttccacccagtccccccaggccctggaggactcgggcccggtgaatatctcagtctcaatcaccctaaccctggacccactgaaacccttcggagggtattcccgcaacgtcacccatctgtactcaaccatcttagggcatcagattggactttcaggcagggaagcccacgaggagataaacatcaccttcaccctgcctacagcgtggagctcagatgactgcgccctccacggtcactgtgagcaggtggtattcacagcctgcatgaccctcacggccagccctggggtgttccccgtcactgtgatgaccgttcattaa

SEQ ID NO: 8528 - DNA, 66 bp, synthetic construct
  misc_feature 1..66: note = Synthetic polypeptide
  source 1..66: mol_type = other DNA
cggggcggggattggaatacttttctgctacggttcaatgatttggacttgtgtgtatcagagaat

SEQ ID NO: 8529 - DNA, 268 bp, synthetic construct
  misc_feature 1..268: note = Synthetic polypeptide
  source 1..268: mol_type = other DNA
cggggcggggattggaatacttttctgctacggttcaatgatttggacttgtgtgtatcagagaatgaaaccctcaagcatctcacaaacgacaccacaactccggaaagtacaatgaccagcgggcaggcccgagcttccacccagtccccccaggccctggaggactcgggcccggtgaatatctcagtctcaatcaccctaaccctggacccactgaaacccttcggagggtattcccgcaacgtcacccatctgtactcaacca

SEQ ID NO: 8530 - DNA, 132 bp, synthetic construct
  misc_feature 1..132: note = Synthetic polypeptide
  source 1..132: mol_type = other DNA
cggggcggggattggaatacttttctgctacggttcaatgatttggacttgtgtgtatcagagaatgaaaccctcaagcatctcacaaacgacaccacaactccggaaagtacaatgaccagcgggcaggcc

SEQ ID NO: 8531 - DNA, 939 bp, synthetic construct
  misc_feature 1..939: note = Synthetic polypeptide
  source 1..939: mol_type = other DNA
cattggcatttttcttgtttctcaaatgttccaggcattttctgctgcttagggcattttgttcttgatgtttgctttctctggaatgctatttcaccagtttataggcaagcaataaacagcaagatgtttgaggtggatatgaaaattgctgcaatgcatgtaaaaagaaagcaactccatcaactactacctaatcatgtgcttcagaaaaagaaaaagcattcaacagaaggtgtcaaattgacagctctcaatgacagcagcctcgacttgtctatggacagtgataacagcatgtctgtgccttcacctactagtgctacgaagaccagtccattgaacagttctggcagctctcagggcagaaacagtcctgctccagctgtaacagcagcatctgtgaccaacatacaggctactgaagtttctgtgccacaagtaaattccagtgaaagctcagggggtacatcgagtgaaagcattcctcaaactgccacacaaccagccatttctccaccaccaaagcctacggtctccagagttgtttcttcaacacgtctggtaaacccaccacctagatcttcaggaaatgcagcaacttcaggaaatgcagcaacaaaaatacctactcctatagtaggagtcaagaggacatcctcacctcataaagaagagagtcccaagaaaaccaaaacagaagaggatgaaacaagtgaagatgctaactgtcttgctttgagtggacatgataaaacagaagcaaaggaacaacttgatacagagacaagtacaactcaatcagaaactattcagacagcggcttctctgttggcctctcagaaaacatccagtacagacctttctgatatccctgctctccctgcaaatcctattcctgttatcaagaattcaataaaactgagattgaatcggtaa

SEQ ID NO: 8532 - DNA, 876 bp, synthetic construct
  misc_feature 1..876: note = Synthetic polypeptide
  source 1..876: mol_type = other DNA
cattggcatttttcttgtttctcaaatgttccaggcattttctgctgcttagggcattttgttcttgatgtttgctttctctggaatgctatttcaccagtttataggcaagcaataaacagcaagatgtttgaggtggatatgaaaattgctgcaatgcatgtaaaaagaaagcaactccatcaactactacctaatcatgtgcttcagaaaaagaaaaagcattcaacagaaggtgtcaaattgacagctctcaatgacagcagcctcgacttgtctatggacagtgataacagcatgtctgtgccttcacctactagtgctacgaagaccagtccattgaacagttctggcagctctcagggcagaaacagtcctgctccagctgtaacagcagcatctgtgaccaacatacaggctactgaagtttctgtgccacaagtaaattccagtgaaagctcagggggtacatcgagtgaaagcattcctcaaactgccacacaaccagccatttctccaccaccaaagcctacggtctccagagttgtttcttcaacacgtctggtaaacccaccacctagatcttcaggaaatgcagcaacttcaggaaatgcagcaacaaaaatacctactcctatagtaggagtcaagaggacatcctcacctcataaagaagagagtcccaagaaaaccaaaacagaagaggaacaacttgatacagagacaagtacaactcaatcagaaactattcagacagcggcttctctgttggcctctcagaaaacatccagtacagacctttctgatatccctgctctccctgcaaatcctattcctgttatcaagaattcaataaaactgagattgaatcggtaa

SEQ ID NO: 8533 - DNA, 877 bp, synthetic construct
  misc_feature 1..877: note = Synthetic polypeptide
  source 1..877: mol_type = other DNA
cattggcatttttcttgtttctcaaatgttccaggcattttctgctgcttagggcattttgttcttgatgtttgctttctctggaatgctatttcaccagtttataggcaagcaataaacagcaagatgtttgaggtggatatgaaaattgctgcaatgcatgtaaaaagaaagcaactccatcaactactacctaatcatgtgcttcagaaaaagaaaaagcattcaacagaaggtgtcaaattgacagctctcaatgacagcagcctcgacttgtctatggacagtgataacagcatgtctgtgccttcacctactagtgctacgaagaccagtccattgaacagttctggcagctctcagggcagaaacagtcctgctccagctgtaacagcagcatctgtgaccaacatacaggctactgaagtttctgtgccacaagtaaattccagtgaaagctcagggggtacatcgagtgaaagcattcctcaaactgccacacaaccagccatttctccaccaccaaagcctacggtctccagagttgtttcttcaacacgtctggtaaacccaccacctagatcttcaggaaatgcagcaacttcaggaaatgcagcaacaaaaatacctactcctatagtaggagtcaagaggacatcctcacctcataaagaagagagtcccaagaaaaccaaaacagaagaggatgaaacaagtgaagatgctaactgtcttgctttgagtggacatgataaaacagaagcaaaggaacaacttgatacagagacaagtacaactcaatcagaaactattcagacagcggcttctctgttggcctctcagaaaacatccagtacagacctttctgatatccctg

SEQ ID NO: 8534 - DNA, 137 bp, synthetic construct
  misc_feature 1..137: note = Synthetic polypeptide
  source 1..137: mol_type = other DNA
ggccgggcgcggggctcaggcctgtcatcccagcactttaggtggctaaggctggactgggatcagatgggaagcggaagctcatcatgaccagaaactgtttccctacagagagcacttggagatggcaaagctga

SEQ ID NO: 8535 - DNA, 1443 bp, synthetic construct; identical to SEQ ID NO: 6760
  misc_feature 1..1443: note = Synthetic polypeptide
  source 1..1443: mol_type = other DNA

SEQ ID NO: 8536 - DNA, 984 bp, synthetic construct; identical to SEQ ID NO: 6761
  misc_feature 1..984: note = Synthetic polypeptide
  source 1..984: mol_type = other DNA

SEQ ID NO: 8537 - DNA, 1032 bp, synthetic construct; identical to SEQ ID NO: 6762
  misc_feature 1..1032: note = Synthetic polypeptide
  source 1..1032: mol_type = other DNA

SEQ ID NO: 8538 - DNA, 477 bp, synthetic construct
  misc_feature 1..477: note = Synthetic polypeptide
  source 1..477: mol_type = other DNA
ggccgggcgcggtggctcacgcctgtaatcctagcactctgggaggccgaggcgggcggatcacgaggtgaccaaagccacgtaatgtccgtagttcgctcatccgtccatgccagatggattgtggggaaggtgattgggacaaaaatgcaaaagactgctaaagtgagagtgaccaggcttgttctggatccctatttattaaagtattttaataagcggaaaacctactttgctcacgatgcccttcagcagtgcacagttggggatattgtgcttctcagagctttacctgttccacgagcaaagcatgtgaaacatgaactggctgagatcgttttcaaagttggaaaagtcatagatccagtgacaggaaagccctgtgctggaactacctacctggagagtccgttgagttcggaaaccacccagctaagcaaaaatctggaagaactcaatatctcttcagcacagtga

SEQ ID NO: 8539 - DNA, 730 bp, synthetic construct
  misc_feature 1..730: note = Synthetic polypeptide
  source 1..730: mol_type = other DNA
agaggagagcatgtactgggggagagcctgctggattggcacgagacaacttgggcgtgagctccagctccaccactaactagagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccgtatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaagacatgaagacatcttatccatcctcactgctgtcaacgatgatgtgagtcgaagagtggacaaacagggaacaaagaaacagatgccccagcctgctttcacactaaggaaaaaactagtattccctgtgcccctggatgcactttcattatag

SEQ ID NO: 8540 - DNA, 727 bp, synthetic construct
  misc_feature 1..727: note = Synthetic polypeptide
  source 1..727: mol_type = other DNA
agaggagagcatgtactgggggagagcctgctggattggcacgagacaacttgggcgtgagctccagctccaccactaactagagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccgtatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaaggatgctgaaatttctggaaaagacaatggaaatcaggggcaggaagagaacagtgtggggtgctaaacagatctcagcaacctccctgcccacggccatctctgcgcagacacctcgaccccccatgcgcaggtggagcagcgtttcctag

SEQ ID NO: 8541 - DNA, 424 bp, synthetic construct
  misc_feature 1..424: note = Synthetic polypeptide
  source 1..424: mol_type = other DNA
ctgggcactcctccctctcctctgcaggctctgttttttcttggttgtggtgctcctgcaggtttgctgctgggccctttcctcttttcagtctgtgtattctcccaggtgctctcagccacgcccctgacttcagttactgcccaggggtagctgatacccaacactcgcacctgcctgccagaccagcatggccagtgaccttccaacagctccgcatggatgcccatagtcctcccgagagctggatgacagcagcagtgagtccagtgacctccagctggaaggccccagcaccctcagggtcctggacgagaaccttgctgacccccaagcagaagacagacctctggttttctttgacctcaagattgacaatgaaagtgggttctcctggggctacccccacccctttctaatttag

SEQ ID NO: 8542 - DNA, 1171 bp, synthetic construct
  misc_feature 1..1171: note = Synthetic polypeptide
  source 1..1171: mol_type = other DNA
ctgggcactcctccctctcctctgcaggctctgttttttcttggttgtggtgctcctgcaggtttgctgctgggccctttcctcttttcagtctgtgtattctcccaggtgctctcagccacgcccctgacttcagttactgcccaggggtagctgatacccaacactcgcacctgcctgccagaccagcatggccagtgaccttccaacagctccgcatggatgcccatagtcctcccgagagctggatgacagcagcagtgagtccagtgacctccagctggaaggccccagcaccctcagggtcctggacgagaaccttgctgacccccaagcagaagacagacctctggttttctttgacctcaagattgacaatgaaacccagaagattagccagctggctgcggtgaaccgggaaagcaagttccgcgtggtcatccagcctgaagccttcttcagcatctactccaaggccgtgtccctggaggtggggctgcagcacttcctcagctttctgagctccatgcgccgccctatcttggcctgctacaagctgtgggggcctggcctcccaaacttcttccgggccctggaggacattaacaggctgtgggaattccaggaggccatctcgggcttcctggctgccctgcctctcatccgggagcgtgtgcccggggccagcagcttcaaactcaagaacctggcccagacctacctggcgagaaacatgagcgagcgcagcgccatggctgccgtgctggccatgcgtgacctgtgccgcctcctcgaggtctccccgggcccccagctggcccagcatgtctaccccttcagtagcctgcagtgctttgcctccctgcagcccctggtgcaggcagctgtgctgccccgggctgaggcccgcctcctggccctacacaacgtgagcttcatggagctgctgagtgcacaccgccgtgaccggcaggggggcctgaagaagtacagccgctatctaagcctgcagaccaccacgttgccccctgcccagcctgctttcaacctgcaggctctgggcacctactttgaaggcctgttggagggtccggcgctggcacgggcagaaggagtctccaccccacttgctggccgtggcttggcagagagggcctcccagcagagctga

SEQ ID NO: 8543 - DNA, 1533 bp, synthetic construct
  misc_feature 1..1533: note = Synthetic polypeptide
  source 1..1533: mol_type = other DNA
ggcatcagatgttcaaagcgagggaagagagtgaggtgaagctatgacagagactccactttcaatgtgtttgtgggaaaaggacagctgatcacagggatggaccaggctcttgttgggatgtgcgtaaacgagagacgtttcgtgaagattcccccaaagcttgcctacggaaatgaaggagtttctggtgtgatcccccccaattcagtgcttcattttgatgtacttctgatggatatttggaattctgaagaccaggttcagattcacacctatttcaagcccccgagttgccctcggaccatccaggtgtctgattttgtgaggtaccactacaacgggacgttcctggacggaactctgtttgattcgagtcacaatcgcatgaaaacatatgacacgtatgtgggaattggctggctgattcctggaatggataaagggctgctggggatgtgtgtgggtgagaagcgcatcatcaccattcctccttttctggcctatggagaggatggagatgggaaagacattcccggtcaggcatctctggtgtttgatgttgcattattggacctccataaccccaaggacagcatttccattgagaacaaggtagtacctgaaaactgtgagcggataagtcaaagtggggactttctcaggtatcattacaatggcacgcttctggatggcaccctctttgattccagctactctcggaaccgcacgtttgacacgtacattgggcagggctacgtgattcctgggatggatgaaggtctacttggtgtttgcattggagaaaagcgaaggattgtggtcccgcctcacctggggtatggagaggaaggaagagggaatatccccggctcggctgtgctggtgtttgacatccatgtgatcgacttccacaacccttcggactccatcagcatcacctcccactacaaaccccctgactgctcagtgctgagtaagaagggagattacctcaaatatcactacaatgcctcacttctggatgggaccctgctggactccacgtggaatttaggcaaaacttacaatattgttctgggatctgggcaagttgtgttggggatggacatgggtctcagagagatgtgcgttggcgagaaacggacagtgatcattccgcctcacctgggctatggggaagctggcgtggatggagaagtgcccggcagtgccgtattagtgtttgacattgagctgctggagctggtggctggccttcctgaggggtacatgttcatatggaatggtgaggtgtcacccaacctctttgaagaaattgacaaggatggcaacggagaagtcctcctggaagagttctcagagtacattcacgcccaggtggcatctggcaaagggaaactcgctcctggctttgatgctgagctgattgtgaagaatatgttcaccaaccaggaccggaatggagatgggaaggtcacagccgaggaatttaaactcaaagaccaggaagccaaacacgatgaactctaa

SEQ ID NO: 8544 - DNA, 561 bp, synthetic construct; identical to SEQ ID NO: 6592
  misc_feature 1..561: note = Synthetic polypeptide
  source 1..561: mol_type = other DNA

SEQ ID NO: 8545 - DNA, 196 bp, synthetic construct; identical to SEQ ID NO: 6593
  misc_feature 1..196: note = Synthetic polypeptide
  source 1..196: mol_type = other DNA

SEQ ID NO: 8546 - DNA, 423 bp, synthetic construct; identical to SEQ ID NO: 6594
  misc_feature 1..423: note = Synthetic polypeptide
  source 1..423: mol_type = other DNA

SEQ ID NO: 8547 - DNA, 352 bp, synthetic construct
  misc_feature 1..352: note = Synthetic polypeptide
  source 1..352: mol_type = other DNA
gggcatggtggctcatgcctgtaatcccagcactttggtaggctgaggtatctgcgggatggtggccatctcctggtacgccttcaacatcacccgggacttcttcgaccccttgtaccccggaaccaagtacgagctgggccccgccctctacctggggtggagcgcctcactgatctccatcctgggtggcctctgcctctgctccgcctgctgctgcggctctgacgaggacccagccgccagcgcccggcggccctaccaggctccagtgtccgtgatgcccgtcgccacctcggaccaagaaggcgacagcagctttggcaaatacggcagaaacgcctacgtgtag

SEQ ID NO: 8548 - DNA, 274 bp, synthetic construct
  misc_feature 1..274: note = Synthetic polypeptide
  source 1..274: mol_type = other DNA
gggcatggtggctcatgcctgtaatcccagcactttggtaggctgaggtatctgcgggatggtggccatctcctggtacgccttcaacatcacccgggacttcttcgaccccttgtaccccggaaccaagtacgagctgggccccgccctctacctggggtggagcgcctcactgatctccatcctgggtggcctctgcctctgctccgcctgctgctgcggctctgacgaggacccagccgccagcgcccggcggccctaccaggctccagtg

SEQ ID NO: 8549 - DNA, 246 bp, synthetic construct
  misc_feature 1..246: note = Synthetic polypeptide
  source 1..246: mol_type = other DNA
gggcatggtggctcatgcctgtaatcccagcactttggtaggctgaggtatctgcgggatggtggccatctcctggtacgccttcaacatcacccgggacttcttcgaccccttgtaccccggaaccaagtacgagctgggccccgccctctacctggggtggagcgcctcactgatctccatcctgggtggcctctgcctctgctccgcctgctgctgcggctctgacgaggacccagccgccag

SEQ ID NO: 8550 - DNA, 340 bp, synthetic construct
  misc_feature 1..340: note = Synthetic polypeptide
  source 1..340: mol_type = other DNA
tcagcatcacctgggagctgggtagaaagaaatgcagattctcagtccccttccgagtcatgaggggaatctttgctgatgaactccaggtggcttctggcacagcagcttaattgaccggaacctcattgattattttgttcccttcctccccctggaatacaaacacctaaaaatgtgtatccgagtggaaatgcagtcccgaggctatgaaattgatgaagacattgtaagcagagtggctgaggagatgacatttttccccaaagaggagagagttttctcagataaaggctgcaaaacggtgttcaccaagttagattattactacgatgattga

SEQ ID NO: 8551 - DNA, 7988 bp, synthetic construct
  misc_feature 1..7988: note = Synthetic polypeptide
  source 1..7988: mol_type = other DNA
gagggaggagccaagatggccgaataggaacagctccggtctacagctcccagcgtgagcgacgaagaagacgggtgatttctgcatttccatctgaggtagaagtgctgtctgtggtcgctcagcagatcctcagcatccaacaagccatcattcggaagctaaagacattcatctttgaagggactgagctctctctgaacccaacctgcgctgtgttcatcaccatgaaccccgggtatgctggcagggctgaactgcccgacaatctcaaggccttgttccggacagtggccatgatggtcccagattacgccctcattggagaaatctccctctactccatggggtttctggactccagaagtctcgcccagaagatcgttgcgacctaccgcctgtgctcggaacaactgtcctctcagcatcactatgactacggtatgcgcgctgtcaagtctgtgcttactgccgcaggaaacctgaagctcaagtatccagaggagaatgaaagtgtcctgctgctccgggcattgcttgatgtcaatctggccaagttcttagcgcaagatgtccctctgtttcagggaattatatctgatttatttcctggagttgttcttccaaagccagactatgaagtttttctgaaagtgctgaatgataacatcaaaaagatgaaactccagccagtaccttggtttatagggaaaattatccagatctacgaaatgatgctggtgagacatggctatatgattgtaggagaccccatgggcggcaagacctctgcttataaagtgttggctgcagctctcggcgatttacacgcagccaatcagatggaggagtttgctgtggagtacaagatcatcaaccccaaggctatcacgatggggcagctgtatgggtgctttgaccaagtgagccacgagtggatggatggtgtccttgccaatgctttccgggagcaagcgtcttcactctctgatgatcgcaagtggattatatttgatgggccagtggatgctatttggattgaaaatatgaacactgttctggatgacaataaaaagctgtgtctcatgagtggggaaattatccagatgaactccaagatgagcctgatcttcgagcccgccgacctcgagcaagcctctccagccactgtgagcaggtgtgggatgatctacatggagccccatcaactaggctggaagcccctgaaggattcctacatggacaccctgccctccagtctcaccaaggagcacaaagaattggtcaatgacatgttcatgtggcttgtccagccctgcctggaatttggtcgccttcattgtaaatttgttgtccagacatctcccatccaccttgccttctcaatgatgagactgtactcttctctgcttgatgaaatcagggcagtagaagaggaggaaatggaattaggtgaaggcctgtcaagtcaacagatctttctctggctccaaggactgtttctcttttccttggtgtggaccgtggctggcaccatcaacgcagacagcagaaagaaatttgatgtgtttttccgcaacctgatcatgggcatggatgataaccacccaaggcccaaaagcgtcaaactcaccaaaaacaacatctttccagaaagaggaagcatctatgatttttattttatcaaacaagctagtggacattgggaaacgtggacacagtatatcaccaaagaggaggaaaaagttccagctggtgcaaaggtctcagaactcatcatccccacaatggagacagcccggcagtccttcttcttgaaaacctacttagaccatgagattccaatgctgttcgtgggtcccacaggcactggcaaatcagccatcaccaacaacttccttctccaccttcccaaaaatacgtacctacccaactgcatcaatttctctgccagaacctcagccaatcagacccaggatatcatcatgtccaagctggatcgacgacggaagggccttttcgggcctcccatagggaagaaagcagtggtgtttgtggatgacctcaacatgccagccaaagaggtgtatggggcccagccacccatcgagctcctgaggcagtggattgaccatggttactggtttgacaaaaaagacacaaccaggctggacatcgtggacatgctgctcgtgacagccatggggccccccgggggaggaaggaatgacattactggacgattcactcgccatctgaatatcatttccatcaatgcctttgaggatgacattttaaccaagattttcagttcgattgttgactggcacttcgggaaagggtttgatgtgatgtttttaaggtacggaaagatgctggtccaagctactaagacaatttatagagatgcagtggagaacttcttgccaactccctcgaagtcacattacgtctttaacctgcgggacttctcacgagtgattcaaggggtcctgctgtgccctcacacacacctgcaggatgtagaaaaatgtatccggctttggatccatgaggtttatcgggtcttctatgatcgtctgattgacaaggaggacagacaggtctttttcaacatggtgaaggaaaccacctccaattgcttcaagcagaccatagagaaggtgcttatccacttgtcacccactggaaagatagtcgatgataacattcgaagcctcttctttggagattatttcaagccagaaagtgaccaaaaaatctacgatgagatcactgacctgaaacagctgactgtggtcatggagcactatctggaagaattcaacaacatcagcaaggcccccatgtccctggtcatgttcaggtttgccattgagcacatctctaggatctgccgtgtcctgaagcaggacaaaggccacctgctcctggtgggcatagggggcagcgggcggcaaagtgccgccaaactgtccacattcatgaacgcatacgagctataccagattgagatcaccaagaactacgcaggcaatgactggcgagaagatcttaagaagatcatactgcaggtcggtgtggccaccaagagcaccgtgttcctcttcgccgacaaccagatcaaggatgaatcattcgtggaggacatcaacatgcttctgaacacaggtgacgtgcctaacatcttccctgctgacgagaaggctgacatcgtggagaagatgcagactgcagccaggacccaaggagagaaggttgaagtcactcctctttctatgtataacttctttattgagagggtaattaacaaaatctccttttcattagccatgagtccaataggggatgccttcaggaaccgcctgcggatgttcccttcgctgatcaattgctgtacgattgattggttccagtcctggcccacagatgccctagagttggtggctaacaaatttctagaggatgtggagcttgatgacaacattcgggtagaggtcgtgtccatgtgcaaatatttccaagagagcgtcaagaagctgtcactcgattattacaacaaacttcgaagacacaactatgttacccccacctcctaccttgaattgattctaaccttcaagacgctcctgaatagcaagaggcaagaggtggctatgatgaggaaccgctacctgacaggcttgcagaaactcgactttgcagcttctcaggtagcggttatgcaaagagaactgacagctcttcaacctcaactcatcctcacctccgaggaaactgccaagatgatggtgaaaattgaagcggagacgagagaagctgatggaaagaaacttctggtgcaggcagatgaaaaagaagccaatgttgctgctgccattgcccaaggaatcaagaacgaatgtgagggggacctagctgaggcaatgcctgcactcgaggctgcactagctgctctggacaccctgaacccggccgacatctcgctggtgaagtcgatgcagaacccaccaggccctgtcaaactggtcatggagagcatctgcatcatgaaagggatgaagccagagaggaagccagaccccagtggctccggtaagatgatagaagattactggggggtatccaaaaagattcttggggatctgaaattcttggagagtcttaagacatatgacaaagacaacatccccccactgaccatgaagcggatccgggaaaggtttatcaatcacccggaattccagccagctgtcattaaaaatgtatcgtcggcctgcgagggtctgtgcaagtgggtgagggccatggaggtgtacgatcgcgtggccaaggtggtggctcccaaacgggagcgactgagggaggcagaggggaagctggctgcacagatgcagaagctgaaccagaaaagagcagagctgaagctggtggtagatcggctccaggccctgaatgacgactttgaagagatgaacaccaagaaaaaggacttggaggaaaacattgaaatctgctcccaaaagctggtcagggcagagaaactgatcagtggtcttgggggagagaaggacagatggaccgaagctgcccgacagctggggatccgctatactaatctgactggtgacgtgttgctgtcctcaggaactgtggcttacctgggcgcttttacagtggattatcgggtccagtgccaaaatcagtggttggctgaatgtaaggacaaggtcatccctggcttcagtgacttcagtctcagccacacgttaggggatcccataaaaatccgtgcctggcagattgctgggcttcccgttgactccttctccatcgacaatggcatcattgtatccaattccagacgctgggccttaatgattgaccctcacgggcaggccaataaatggattaagaacatggagaaggcgaataaactggctgtcatcaagttctctgatagcaactacatgaggatgctggaaaacgcgctgcagttaggcacccctgtcttgattgaaaacattggagaagagctggatgcttctatcgaacctatcttgctcaaggcaacattcaaacagcaaggagttgagtacatgaggctgggtgaaaacatcattgaatattccagggattttaagttatacatcacaacccgtttgaggaatccacattacctcccagaagttgccgtgaaggtctgtctcctcaacttcatgatcacccccttgggtctccaagatcaactccttggcatcgtggctgcgaaggagaagccagagctggaagagaaaaagaaccagttgattgtggaaagtgccaagaacaagaagcatctcaaggaaattgaagataagatcttggaggttctctccatgtccaagggtaacatcctggaggatgaaaccgccatcaaagttctgtcctcctccaaagtgctatctgaagagatctcagagaaacagaaagttgcttccatgacagaaacgcagattgacgagactcggatgggctacaagccagtggctgtgcattctgccaccatcttcttttgtatctcggacctggccaacatcgagccgatgtaccagtactccctgacttggttcataaatctctacatgcattccttgacccacagcacgaagagcgaggaactgaatctgcgcatcaagtacatcattgaccatttcaccctgagcatctacaacaacgtgtgccgttctctgtttgagaaggacaagctactcttctctctcctcctgaccatcggcatcatgaaacagaagaaggaaattacggaggaggtgtggtacttccttctcactggaggcatcgcactggataacccctaccccaatccagctccccaatggctgtctgagaaggcatgggcagagattgtccgtgcatctgccttacccaaactgcatggcctgatggagcatttggaacagaacctgggtgaatggaagctgatctatgactcggcctggccccatgaggagcaactccctgggtcttggaagttctctcaaggattggagaagatggtgatccttcgatgtttgcggcctgacaaaatggtgccagcggtccgggagttcattgctgaacatatgggaaagctgtatatcgaagcccctacgttcgatctccagggatcctacaatgattccagctgctgtgcgcctttgatttttgtgttgtctccaagtgcagacccaatggcaggcctgctgaagtttgctgatgatcttggtatgggaggtaccagaacacagaccatctcccttggccaaggccaaggccctattgctgccaaaatgatcaacaatgccatcaaagacgggacctgggtggtcttacagaactgccacctggccgcaagctggatgcctaccctggagaagatttgtgaggaggtgattgttcctgagagcaccaatgccagattcagactctggctaaccagctatccatcagagaagtttccagtcagcattctccagaatggaatcaaaatgaccaatgagccccccaaagggctccgggccaacctgttgcgctcctacctcaatgaccccatctcagatcctgtgttcttccaaagctgtgcaaaggcggtgatgtggcaaaagatgttatttggcctttgtttcttccacgccgttgttcaagagagaagaaacttcggccccctagggtggaatattccctatgaattcaacgaatctgacctgaggattagtatgtggcagatccagatgtttctcaatgactacaaggaggtgccctttgatgctctgacctacctgacaggggaatgtaattacggaggcagagtgactgatgacaaagaccggcgtctcctgctgtcacttctgtccatgttctactgtaaggaaattgaggaggactattactccctcgctcctggagacacttactacatccctcctcatggctcctaccagtcctatatcgactatctcaggaatctccccatcacagcccacccagaagtgttcggcctccatgagaacgcagacatcaccaaagacaaccaggaaaccaaccagctgtttgagggggtcctgctgaccctccctagacagtcaggaggaagtggcaagtcccctcaggaagtggttgaggagttggcacaagacattctctccaagcttcccagagactttgacctggaagaggtcatgaagttgtaccccgtggtctatgaagaatccatgaataccgtcctaaggcaggagctcatcagattcaacaggctgaccaaagtggttcggaggagcctcatcaatcttggccgagccatcaaaggacaggtcctgatgtcctcggagctagaggaagtctttaacagcatgcttgtgggtaaagtgccagccatgtgggcagccaagtcttacccatcactgaagcctctggggggctacgtggctgacctgctggcccgcctgaccttcttccaggaatggattgacaaggggccccctgtggtattttggatctctggattctacttcacacagtcttttttgactggcgtctctcaaaattatgcccggaaatataccatccccattgaccacattggatttgagtttgaggtaaccccacaagaaacagtgatggagaataaccccgaagatggggcctacatcaaagggctcttcttagaaggtgcccgttgggacaggaaaacgatgcagattggggaatctctccccaaaatcctctatgacccactgcccatcatttggctgaaacctggggagagcgcaatgtttctgcatcaggacatctatgtgtgtccagtctacaaaacaagtgcccgcagaggaaccctctccaccacaggccactctaccaactatgtcctctccattgagcttccaacagacatgccccagaagcactggataaaccgaggggtggcctcactgtgccagctggataactga

SEQ ID NO: 8552 - DNA, 1301 bp, synthetic construct
  misc_feature 1..1301: note = Synthetic polypeptide
  source 1..1301: mol_type = other DNA
gagggaggagccaagatggccgaataggaacagctccggtctacagctcccagcgtgagcgacgaagaagacgggtgatttctgcatttccatctgaggtagaagtgctgtctgtggtcgctcagcagatcctcagcatccaacaagccatcattcggaagctaaagacattcatctttgaagggactgagctctctctgaacccaacctgcgctgtgttcatcaccatgaaccccgggtatgctggcagggctgaactgcccgacaatctcaaggccttgttccggacagtggccatgatggtcccagattacgccctcattggagaaatctccctctactccatggggtttctggactccagaagtctcgcccagaagatcgttgcgacctaccgcctgtgctcggaacaactgtcctctcagcatcactatgactacggtatgcgcgctgtcaagtctgtgcttactgccgcaggaaacctgaagctcaagtatccagaggagaatgaaagtgtcctgctgctccgggcattgcttgatgtcaatctggccaagttcttagcgcaagatgtccctctgtttcagggaattatatctgatttatttcctggagttgttcttccaaagccagactatgaagtttttctgaaagtgctgaatgataacatcaaaaagatgaaactccagccagtaccttggtttatagggaaaattatccagatctacgaaatgatgctggtgagacatggctatatgattgtaggagaccccatgggcggcaagacctctgcttataaagtgttggctgcagctctcggcgatttacacgcagccaatcagatggaggagtttgctgtggagtacaagatcatcaaccccaaggctatcacgatggggcagctgtatgggtgctttgaccaagtgagccacgagtggatggatggtgtccttgccaatgctttccgggagcaagcgtcttcactctctgatgatcgcaagtggattatatttgatgggccagtggatgctatttggattgaaaatatgaacactgttctggatgacaataaaaagctgtgtctcatgagtggggaaattatccagatgaactccaagatgagcctgatcttcgagcccgccgacctcgagcaagcctctccagccactgtgagcaggtgtgggatgatctacatggagccccatcaactaggctggaagcccctgaaggattcctacatggacaccctgccctccagtctcaccaaggagcacaaagaattgatgaaatcagggcagtag

SEQ ID NO: 8553 - DNA, 586 bp, synthetic construct; identical to SEQ ID NO: 6809
  misc_feature 1..586: note = Synthetic polypeptide
  source 1..586: mol_type = other DNA

SEQ ID NO: 8554 - DNA, 1067 bp, synthetic construct
  misc_feature 1..1067: note = Synthetic polypeptide
  source 1..1067: mol_type = other DNA
ccagagtccaactgcttgggttaatccccattctgctcttacctgtggtgggcctcagggaggaggtacaggagaactgtgtgcggtggcgaaagaggttcaccttcgtgtgtaagatgagtgctaacccggccaccggcctgctggacccctgtgtcttccgtgtgtctgtgcgcaaggagctgaaaggcgggaaggcttattccaagctgggcttcgctgacttgaacctggccgagtttgcgggctcgggctccacggtgcgctgctgcctgctcgagggatatgacacgaagaacactcgccaggacaactccatccttaaggtcaccattggtatgttcctgctctctggagatccctgcttcaagacgccaccatcgactgccaagtccatctccatcccaggccaggattcctccctgcagctgacgtgtaagggtggtgggaccagcagtgggggcagcagcaccaactccctgactgggtcccggccccccaaggctcggcccactattctcagctcagggctgccagaggaacccgaccagaacctgtccagccctgaggaggtgttccactctggccactcccgcaactccagctatgccagccagcagtccaagatctccggctacagcacagagcactcgcgctcctccagcctctcagacctgacgcaccgccgcaacacgtccaccagcagcagcgcctctgggggccttggcatgaccgtggagggccctgagggcagtgagcgggagcaccggcccccggagaagccgccgcggccaccccggcccctgcatctgtccgatcgctctttcaggcggaagaaggactcggtggagagccacccgacctgggtggacgacacgcggatcgatgcggatgccatcgtggagaagatcgtgcagagccaggatttcacagatggcagcaacaccgaggacagcaacctccggctgttcgtgagccgcgatggctctgccacgctgagcggcatccagcttgccaccagggtctcttctggggtctacgagccagttgtgattgaaagccattga

SEQ ID NO: 8555 - DNA, 459 bp, synthetic construct
  misc_feature 1..459: note = Synthetic polypeptide
  source 1..459: mol_type = other DNA
tgacctttgaccaataaggatttgaattgcgcgggtccacttatatgcggattttttttcaaccaaacgcgaccagtatttacgggatgtgccgccccgcgtataaggagggcaggctcttcctataagcggattctgcaaggctgactgcgggacgttcctggtagagttacacagttgtgccgccagtatagcgacatgcctcctttgacgttagagggcatccaggaccgtgttctttacgtattgaaactctatgacaagattgacccagagaagctttcagtaaattctcattttatgaaagacctgggcttagacagtttggaccaagtggagattatcatggccatggaagacgaatttgggtttgaaattcctgatatagatgctgaaaagttaatgtgtccacaagaaattgtagattacattgcagataagaaggatgtatatgaataa

SEQ ID NO: 8556 - DNA, 1731 bp, synthetic construct; identical to SEQ ID NO: 6691
  misc_feature 1..1731: note = Synthetic polypeptide
  source 1..1731: mol_type = other DNA

SEQ ID NO: 8557 - DNA, 2019 bp, synthetic construct; identical to SEQ ID NO: 6692
  misc_feature 1..2019: note = Synthetic polypeptide
  source 1..2019: mol_type = other DNA

SEQ ID NO: 8558 - DNA, 2043 bp, synthetic construct; identical to SEQ ID NO: 6693
  misc_feature 1..2043: note = Synthetic polypeptide
  source 1..2043: mol_type = other DNA

SEQ ID NO: 8559 - DNA, 554 bp, synthetic construct; identical to SEQ ID NO: 6694
  misc_feature 1..554: note = Synthetic polypeptide
  source 1..554: mol_type = other DNA

SEQ ID NO: 8560 - DNA, 571 bp, synthetic construct
  misc_feature 1..571: note = Synthetic polypeptide
  source 1..571: mol_type = other DNA
gaaggaggagccaagatggccgaataggaacagctctggtctacagctcccagcgtgagcgacgcagaagatgggtgatttctgcatttccatctgagacacaggtgtgtttgcagtggtgaacagccattccttgtccttgctggggaagctgaccatcagtgctgcctttaacattgtttatatctacacctctgagctttaccctacagtcatcaggaatgttgggcttggaacttgttccatgttctcccgagttggtgggattattgctcccttcatcccctcactgaaatatgtgcaatggtctttaccattcattgtcttcggagccacgggtctgacctccggcctcctgagtttgttattgccggagacccttaacagtccgctgctagaaacattctccgaccttcaggtgtattcgtatcgcaggctgggagaagaagcattatctttacaggctttggacccccaacagtgtgtggacaaggagagctctttagggagtgagagtgaggaagaggaagaattttatgatgcagatgaagagactcagatgatcaagtga

SEQ ID NO: 8561 - DNA, 1456 bp, synthetic construct
  misc_feature 1..1456: note = Synthetic polypeptide
  source 1..1456: mol_type = other DNA
gtgggaccttgggcaagtcagttttaagtgtgaccttggagatacctcatcatatcacacaaaggtttccaccgtgcacattatgaagaaaagaaatggaggtgggagtttaaataactattcctcctccattccaccgactcccagcaccagccaggaggaccctcagttcagtgttcctcccactgccaacacacccacccccgtttgcaagcggtccatgcgctggtccaacctgtttacatctgagaaagggagtgacccagacaaagagaggaaagccccggagaatcatgctgacaccatcgggagcggcagagccatccccattaaacagggcatgctcttaaagcgaagtggaaaatggctgaagacatggaaaaagaaatacgtcaccctgtgttccaatggcgtgctcacctattattcaagcttaggtgattatatgaagaatattcataaaaaagagattgaccttcggacatctaccatcaaagtcccaggaaagtggccatccctagccacatcagcctgtgcacccatctccagctctaaaagcaatggcctatccaaggacatggacaccgggctgggtgactccatatgcttcagccccggtatctccagcaccaccagccccaagctcaacccgcccccctctcctcatgccaataaaaagaaacacctaaagaagaaaagcaccaacaactttatgattgtgtctgccactggccaaacgtggcactttgaagccacgacgtatgaggagcgggatgcctgggtccaagccatccagagccagatcctggccagcctgcagtcatgcaagagcagtaaaagcaagtcccagctgaccagccagagtgaggccatggccctgcagtcgatccaaaacatgcgtgggaacgcccactgtgtggactgtgagacccagaatcctaagtgggccagtttgaacttgggagtcctcatgtgtattgaatgctcaggtatccaccgcagttttggcacccgcctttcccgtgtgcgatctctggagctggatgactggccagttgagctcaggaaggttatgtcatctattggcaatgagctagccaacagcatctgggaagggagcagccaggggcagacaaaaccctcaataaagtccacgagggaagagaaggaatggtggatccgttccaaatatgaggagaagctctttctggccccactaccctgcactgagctgtccctgggccagcagctgctgcgggccaccactgatgaggacctgcagacagccatcctgctgctggcacatggctcccgtgaggaggtgaacgagacctgtggggagggagacggctgcacggcactccatctggcctgccgcaaggggaatgtggtcctggagcagctcctgacggggtggacgtcatggcccgagatgcccacgggaacacagcgctga

SEQ ID NO: 8562 - DNA, 1508 bp, synthetic construct
  misc_feature 1..1508: note = Synthetic polypeptide
  source 1..1508: mol_type = other DNA
gtgggaccttgggcaagtcagttttaagtgtgaccttggagatacctcatcatatcacacaaagagatgcagatagatctttgagcatacctgatgaacagttacactcatttgcggtttccaccgtgcacattatgaagaaaagaaatggaggtgggagtttaaataactattcctcctccattccaccgactcccagcaccagccaggaggaccctcagttcagtgttcctcccactgccaacacacccacccccgtttgcaagcggtccatgcgctggtccaacctgtttacatctgagaaagggagtgacccagacaaagagaggaaagccccggagaatcatgctgacaccatcgggagcggcagagccatccccattaaacagggcatgctcttaaagcgaagtggaaaatggctgaagacatggaaaaagaaatacgtcaccctgtgttccaatggcgtgctcacctattattcaagcttaggtgattatatgaagaatattcataaaaaagagattgaccttcggacatctaccatcaaagtcccaggaaagtggccatccctagccacatcagcctgtgcacccatctccagctctaaaagcaatggcctatccaaggacatggacaccgggctgggtgactccatatgcttcagccccggtatctccagcaccaccagccccaagctcaacccgcccccctctcctcatgccaataaaaagaaacacctaaagaagaaaagcaccaacaactttatgattgtgtctgccactggccaaacgtggcactttgaagccacgacgtatgaggagcgggatgcctgggtccaagccatccagagccagatcctggccagcctgcagtcatgcaagagcagtaaaagcaagtcccagctgaccagccagagtgaggccatggccctgcagtcgatccaaaacatgcgtgggaacgcccactgtgtggactgtgagacccagaatcctaagtgggccagtttgaacttgggagtcctcatgtgtattgaatgctcaggtatccaccgcagttttggcacccgcctttcccgtgtgcgatctctggagctggatgactggccagttgagctcaggaaggttatgtcatctattggcaatgagctagccaacagcatctgggaagggagcagccaggggcagacaaaaccctcaataaagtccacgagggaagagaaggaatggtggatccgttccaaatatgaggagaagctctttctggccccactaccctgcactgagctgtccctgggccagcagctgctgcgggccaccactgatgaggacctgcagacagccatcctgctgctggcacatggctcccgtgaggaggtgaacgagacctgtggggagggagacggctgcacggcactccatctggcctgccgcaaggggaatgtggtcctggagcagctcctgacggggtggacgtcatggcccgagatgcccacgggaacacagcgctga

SEQ ID NO: 8563 - DNA, 4806 bp, synthetic construct
  misc_feature 1..4806: note = Synthetic polypeptide
  source 1..4806: mol_type = other DNA
aaaattaaataaacagagaaggctgatataaaaaatggccaagtgacatgaacattcacttcacttaataacagacaacataaaatggcccttaagtcctctgtaaaaatgtttaatctcattaatgatcaaggaaacacaaattaaaactatactaggatatgaattcttagctgtcaagttggcagcaatcaaaaagctagacaacacactctgaaggttaggcggtggggaagtaggtatacctgtacattgctagtagtaatgcagtgtggtaaaaactgttttgggggaggaatttttcaagatgtgacaaaatttaacacgtatttgcttttttatttagaattctctcttgtcagaatttactctgaagatatccacacagaagcagttcaggctgcactggcaaagcataaagaacagaagatggctttgcccatgccaaccaaaaggcgatccacatttgttcagtctcctgcagatgcctgcacacctcctgacacatcttcggcctctgaggatgagggctctctgagacgccaagctgcgctctctgctgccttgcaacagagcttacagaatgctgagtcctggatcaaccgttcaattcagggatcgtccacttcttcatccgcatcttctacgctgtcccacggagaggtcaaaggaaccagtgggtctctagctgatgtatttgccaatactcgaatagagaatttctctgctcctcctgatgtcactacaactacctcttcctcctcatcatcttcctcaattcgcccagcaaacattgacctgcccccctcggggatagttaaaggcatgcacaaaggatccaacaggtccagccttatggatacagctgatggtgttcctgtcagtagcagagtatctacaaaaatccagcagcttctgaacactctgaaacgacccaaaaggcctcccttaaaggaattttttgtggatgactctgaagaaattgtggaagtacctcagccagaccccaaccagcccaagccggagggacggcagatgacccctgtgaaaggagagcctttaggagtcatctgtaactggcctcctgctcttgaatctgccctgcagcgctggggtaccactcaagcaaaatgctcctgtctgactgcactggacatgacagggaaaccagtttacactcttacatatggaaagttgtggagcagaagtttaaagttggcctacacacttcttaataaactggggaccaaaaatgaacctgtgttaaaacctggagacagggtagccctggtttaccccaacaatgatccagtcatgtttatggtggctttctatggatgcctcctggcagaagtgattccagtgcctatagaggtacctcttaccagaaaggatgctggaggtcagcagattggcttcttgctaggaagctgtggtattgccttagctcttaccagtgaagtttgtctaaaaggactgccaaaaacccagaatggagaaattgtacagtttaaaggttggccccggctcaaatgggttgtaacagattccaagtacctttcaaagccaccgaaagactggcagccacacatctcacctgctgggacagaaccggcatacattgagtataaaacaagcaaagaagggagtgtaatgggagttacagtatcccggcttgcaatgttgtctcactgccaagctctgtcgcaggcctgcaattattctgaaggggaaacaatagtaaatgtcttagactttaagaaggatgctgggctgtggcacggcatgtttgcgaatgtaatgaataagatgcacacaatcagcgtaccctactctgttatgaaaacctgtcctctctcttgggtccaaagagtacatgctcacaaagccaaggtagctttagtaaaatgtcgggacttgcactgggctatgatggcacatcgggaccaaagagacgtgagcttgagttccctccgaatgttaattgtgactgatggagctaacccctggtccgtgtcatcctgtgatgccttcctgagtctgttccaaagtcatggactgaagcctgaggccatctgtccgtgcgccacgtctgctgaagccatgactgtagcaatccgcaggcctggagttccaggagcccctttgccaggaagagccattctctcaatgaatggattgagctatggggtaatacgggtcaatactgaagataaaaattcagcactgacggtccaggatgtagggcatgtaatgcctggtgggatgatgtgcattgtgaaaccagatggacctccccagctctgcaaaacagatgaaattggagaaatctgtgttagctccagaactggaggcatgatgtactttgggcttgctggtgtgacaaaaaatacatttgaggtaattccagtgaattctgcaggctctcctgttggggatgtgccattcatccgatcaggattgctggggtttgtagggccgggtagtttggtgttcgtggttgggaaaatggatggcttactgatggttagtggtcgaagacataatgctgatgacattgttgctactggattggctgtagaatcaataaagactgtttatagaggaagaattgctgtgttttctgtgtctgtattttatgatgagcgcattgtggtggttgcggaacaaagacctgatgcttctgaggaagatagtttccagtggatgagccgcgtgctgcaggcgatcgatagcattcatcaagtgggggtttattgtcttgctctggtgccagccaatacattgccaaaaactccactaggaggaatccatatatctcagacgaaacaactctttctggagggatcactgcatccttgcaacatcctcatgtgcccccatacatgtgtgacaaacttgccaaagccccggcaaaaacaaccaggtgtaggccctgcttccgtgatggttgggaatctggttgctggaaaacgtatagcacaagctgctggaagggatctgggacaaatagaagagaatgatttggtgaggaagcaccagtttctggcagagatcctacagtggcgagcccaggcgactcctgaccatgtactcttcatgctgttaaatgccaagggaaccactgtatgcacagccagctgccttcagcttcataagcgagcagagaggattgcatctgttcttggtgataagggacatctaaatgcaggagataatgtggtgttgctctatccacctggcattgagttaatcgccgccttctatggctgcctgtatgcgggctgtatacctgtgaccgtcagacctccacatgctcagaacctcacggccacgctgcccactgtccgaatgattgttgatgtcagcaaagcagcctgtattctcaccagtcagaccctaatgaggctactgaggtcccgagaggcagcagcagctgtggatgtgaaaacctggccaaccatcattgacacagatgatttacccaggaaaaggttacctcagctgtataaaccgcccactcctgagatgttggcatatcttgattttagtgtctccacaactggcatgcttacaggagtgaagatgtcccactctgcagtgaacgctctgtgtcgagccatcaagctccagtgtgagttgtactcttctcggcagatcgccatctgccttgacccttactgtggacttggcttcgcgctctggtgtctctgcagtgtctattcaggccaccagtctgtcttaattcctcctatggagttagagaacaaccttttcctctggctctccacagtcaaccagtacaaaataagggacactttctgctcctattcagtgatggagctctgcaccaaaggtcttgggaaccaagtggaagtgctaaagaccagagggatcaacctctcctgcgtccggacctgtgtggtggtggcggaggagaggccccgcgttgcactccagcagtccttctctaagctcttcaaagacatcgggctgtccccgcgggctgtcagcaccacttttggatcaagagtcaatgtagcaatatgtttacagggaacctcagggcctgatccgactactgtgtatgtggatctgaaatcactaagacatgacagggttcgtctcgtggaacgtggcgcccctcagagtttgcttctctcagagtctggaaagattttacctggagtgaaagtggttattgttaatcctgagaccaaagggccggttggagactctcaccttggagagatttgggtgaacagtccccatacagccagcggctactacaccatctatgatagcgagactcttcaagctgatcatttcaacactcgcctcagctttggagatgcagctcagacactctgggctcggacaggataccttggttttgtccgccggaccgagctcacagcggccactggagagcgtcatgatgcattgtatgtggtgggagcgctggatgaaacactggagctgagaggattacgataccacccaattgatattgagacctcggtgtcccggatccacagaagcattgctgaatgtgccgtgttcacatggaccaacttgcttgtggtggttgtggaactgtgcggctctgaacaggaagccctagatctggtcccattagtgaccaacgtggtcctggaagagcattacctcatcgttggcgtcgtggttgtggtggacccaggtgtcatcccgatcaactccagaggagagaagcagaggatgcacctccgtgatagcttcctagctgaccagttagaccccatctacgtggcttataacatgtaa

SEQ ID NO: 8564 - DNA, 1093 bp, synthetic construct; identical to SEQ ID NO: 7796
  misc_feature 1..1093: note = Synthetic polypeptide
  source 1..1093: mol_type = other DNA

SEQ ID NO: 8565 - DNA, 2322 bp, synthetic construct; identical to SEQ ID NO: 7493
  misc_feature 1..2322: note = Synthetic polypeptide
  source 1..2322: mol_type = other DNA

SEQ ID NO: 8566 - DNA, 1698 bp, synthetic construct; identical to SEQ ID NO: 7494
  misc_feature 1..1698: note = Synthetic polypeptide
  source 1..1698: mol_type = other DNA

SEQ ID NO: 8567 - DNA, 1490 bp, synthetic construct; identical to SEQ ID NO: 7414
  misc_feature 1..1490: note = Synthetic polypeptide
  source 1..1490: mol_type = other DNA

SEQ ID NO: 8568 - DNA, 1031 bp, synthetic construct; identical to SEQ ID NO: 7415
  misc_feature 1..1031: note = Synthetic polypeptide
  source 1..1031: mol_type = other DNA

SEQ ID NO: 8569 - DNA, 1079 bp, synthetic construct; identical to SEQ ID NO: 7416
  misc_feature 1..1079: note = Synthetic polypeptide
  source 1..1079: mol_type = other DNA

SEQ ID NO: 8570 - DNA, 1775 bp, synthetic construct; identical to SEQ ID NO: 568
  misc_feature 1..1775: note = Synthetic polypeptide
  source 1..1775: mol_type = other DNA

SEQ ID NO: 8571 - DNA, 1418 bp, synthetic construct
  misc_feature 1..1418: note = Synthetic polypeptide
  source 1..1418: mol_type = other DNA
ctccttccacggtctccctctgatgccgagccaaagctggacggtactgctgccatctcggctcactgcaacctccctgcctgattctcctgcctcagcctgccgagggcctgcgattgcaggcgcgcgccaccacgcctgactggttttcgtacttttttggtggagacggggtttcactgtgttggccgggctggtctccagctcctaaccgcgagtgatccgccagccttggcctcccaaggtgccgggattgcagacggagtctggttcactcagtgctcaatggtgcccaggctggagtgcagtggcgtgatctcagctcgctacaacctccatctcccagccgcctgccttggcctcccaaagtgccgagattgcagcctctgcctggccgccaccccgtctgggaagtgaggagcgtctctgcctggccgcccatcgtctgggatacgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctgggccgcaaccctgtctgggaggtgaggagcgtctctgcccggccgccccgtctgagaagtgaggaaaccctctgcctggcaaccgccccgtctgagaagcaaaatgaagctgaatctggtgcagatctttttcatgttgctgatgctgctgctgggcctggggatgggcctggggttgggacttcatatggctacagcagtcttggaggagagtgatcaaccgctcaatgaattttggtccagtgactcacaggacaaagctgaggccactgaggagggagacggcacccaaaccacagaaacgctggtgcttagcaacaaagaagtggtgcaacctggctggccagaagatcccatcctcggtgaagatgaggttgggggtaacaagatgctcagagcctcagctctctttcagagcaacaaagactatcttaggcttgaccagacagatagagaatgcaatgatatgatggcacacaagatgaaggagcccagtcagagttgcatagcccagtatgcattcatccatgaggatctaaacacagtcaaagctgtctgtaacagtcctgtcattgcctgtgagctcaaggggggaaaatgtcacaaaagctcccgaccttttgatttgacattgtgcgagctgtcccaaccagaccaggtcactcctaactgcaattacctaacttctgttataaaaaagcacattattataacctgtaatgacatgaagcgccagttaccaactggacaatga

SEQ ID NO: 8572 - DNA, 1446 bp, synthetic construct
  misc_feature 1..1446: note = Synthetic polypeptide
  source 1..1446: mol_type = other DNA
ggcccggcgcggtggctcacgcctgtaatcccagcactttgggaggctgaggctggtggatcacgagatcaggaaatcgagaccatcctggctaacacgcgtgagtgcatctccatccacgttggccaggctggtgtccagattggcaatgcctgctgggagctctactgcctggaacacggcatccagcccgatggccagatgccaagtgacaagaccattgggggaggagatgattccttcaacaccttcttcagtgaaacgggtgctggcaagcatgtgccccgggcagtgtttgtagacttggaacccacagtcattgatgaagttcgcactggcacttaccgccagctcttccaccctgagcaactcatcacaggcaaggaagatgctgccaataactatgcccgagggcactacaccattggcaaggagatcattgacctcgtgttggaccgaattcgcaagctggctgaccagtgcaccggtcttcagggcttcttggttttccacagctttggtgggggaactggttctgggttcacctcgctgctcatggaacgtctctcagttgattatggcaagaagtccaagctggagttctccatttacccggcgccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctacccccgcatccacttccctctggccacatatgcccctgtcatctctgctgagaaagcctaccacgaacagcttactgtagcagagatcaccaatgcttgctttgagccagccaaccagatggtgaaatgtgaccctcgccatggtaaatacatggcttgctgcctgttataccgtggtgacgtggttcccaaagatgtcaatgctgccattgccaccatcaaaaccaagcgtaccatccagtttgtggattggtgccccactggcttcaaggttggcattaattaccagcctcccactgtggtgcctggcggagacctggccaaggtacagagagctgtgtgcatgctgagcaataccacagctgttgccgaggcctgggctcgcctggaccacaagtttgacctgatgtatgccaagcgtgcctttgttcactggtacgtgggtgaggggatggaggaaggcgagttttcagaggcccgtgaggacatggctgcccttgagaaggattatgaggaggttggagcagatagtgctgacggagaggatgagggtgaagagtattaa

SEQ ID NO: 8573 - DNA, 104 bp, synthetic construct
  misc_feature 1..104: note = Synthetic polypeptide
  source 1..104: mol_type = other DNA
ggcccggcgcggtggctcacgcctgtaatcccagcactttgggaggctgaggctggtggatcacgagatcaggaaatcgagaccatcctggctaacacgcgtga

SEQ ID NO: 8574 - DNA, 489 bp, synthetic construct
  misc_feature 1..489: note = Synthetic polypeptide
  source 1..489: mol_type = other DNA
ggcccggcgcggtggctcacgcctgtaatcccagcactttgggaggctgaggctggtggatcacgagatcaggaaatcgagaccatcctggctaacacgcgtgagtgcatctccatccacgttggccaggctggtgtccagattggcaatgcctgctgggagctctactgcctggaacacggcatccagcccgatggccagatgccaagtgacaagaccattgggggaggagatgattccttcaacaccttcttcagtgaaacgggtgctggcaagcatgtgccccgggcagtgtttgtagacttggaacccacagtcattgatgaagttcgcactggcacttaccgccagctcttccaccctgagcaactcatcacaggcaaggaagatgctgccaataactatgcccgagggcactacaccattggcaaggagatcattgacctcgtgttggaccgaattcgcaagctggtaagtatagtactttaa

SEQ ID NO: 8575 - DNA, 306 bp, synthetic construct
  misc_feature 1..306: note = Synthetic polypeptide
  source 1..306: mol_type = other DNA
gagggagatggggtaggtggagttgagggagatggggtagaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactga

SEQ ID NO: 8576 - DNA, 761 bp, synthetic construct; identical to SEQ ID NO: 7260
  misc_feature 1..761: note = Synthetic polypeptide
  source 1..761: mol_type = other DNA

SEQ ID NO: 8577 - DNA, 675 bp, synthetic construct; identical to SEQ ID NO: 7261
  misc_feature 1..675: note = Synthetic polypeptide
  source 1..675: mol_type = other DNA

SEQ ID NO: 8578 - DNA, 779 bp, synthetic construct
  misc_feature 1..779: note = Synthetic polypeptide
  source 1..779: mol_type = other DNA
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 8579 - DNA, 409 bp, synthetic construct
  misc_feature 1..409: note = Synthetic polypeptide
  source 1..409: mol_type = other DNA
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaa

SEQ ID NO: 8580 - DNA, 6463 bp, synthetic construct
  misc_feature 1..6463: note = Synthetic polypeptide
  source 1..6463: mol_type = other DNA
tctaaaattttaggtaataggaatgtcagagtattaacaattatgagaatcataagaaaacaagacactatcaaacataaggagagatggggggaacagaacttacagaaatttaaaaatcatcaaagtggataacttattcagcaaattagaaataggtggattggaaggtgaatttgaataaatcactcaggatgcgcagagaaaaagagatggaaatatgaaagaggtcaagagacaagaagaataaaatgagaaggtttaacatatgtttgaaaagagttcctgaagaagataaagaaattgaggagggatgacagtcaaagaaagaatggctaaaattttttccagaatggatgaaagacgtaagtcctcagattcagaagcccagtattcctgagcactacaaaataaaaataaaactacatctagacacaatattgtaaagctacagaacattgaaaaacagaatgttaaaagcaacccaaaagaaaagacgtattatttacaaaggaaagactatcagcttttcttgatttctcaacagcagcattggaggccaggaagcattggaataattttttcaaagtgctgaggatataattgacagcctagaattttaaacatagctatactatcaagagtagtatgaaataaagagcttttcaaagagactaagagaatttaccattaacagacccttgctaattgaactgctcaaggatgtacttcaggaagaagaaaattgaacctaagatggaagaaataagatctaagaaggaatggaataataaggatgaacaaccctgccactgttatgatacccccgggtggaaatgtgtcatcttccatgatggcaccaggccccaatccagagctgcagcccaggactcctcgccctgcttctcagtcagatgcaatggatccactcctctctgggctccatatacagcagcaaagtcatccctcaggatctttagctcccccacatcacccaatgcagcctgtctctgtgaacagacaaatgaacccagctaattttccccagctgcagcagcagcagcaacaacaacaacagcagcagcagcagcagcagcagcaacaacagcaacagcagcaacaacagttgcaggcaagacccccacagcaacatcagcagcaacagccacagggaattcgaccccagtttactgccccaactcaggtgcctgttcctccaggctggaaccagctgccttctggagcccttcaacctcctccagcccagggttctctgggcacaatgactgcaaaccaagggtggaagaaggctcccttgcccggcccaatgcaacagcaactccaggcaagaccatccttagccacggtacagacgccttcccaccctccccctccatatccctttggcagccagcaagcctcacaagcccacacaaactttcctcagatgagcaacccaggccagttcacagctcctcagatgaagagtttgcagggagggccctctagggtcccaactcccttgcagcagccccacctcaccaacaagtctcctgcctcctcaccctcctccttccagcagggatcccctgcatcctccccaacggttaaccaaactcagcagcagatgggaccaaggccacctcaaaataacccacttccccagggatttcagcagcctgtcagctctccgggtcggaatcctatggttcaacagggaaatgtgccacctaacttcatggtgatgcagcagcaaccaccaaaccaggggccacagagtttacatccaggcctaggaggaatgcctaaacgcctcccacctggcttctcagcaggacaggccaatccgaactttatgcaaggtcaggtgccttcgaccacagcaaccacccctgggaattcaggagcccctcagctgcaagcaaatcaaaatgtccagcatgcaggtggtcaaggagctggtcctcctcaaaaccagatgcaggtgtcccacgggccgccaaatatgatgcagcccagcctcatgggaattcatggcaacatgaacaatcagcaggctggtacttctggggttcctcaagtgaacctcagcaacatgcaaggccagccccagcagggcccaccatctcagctgatgggcatgcaccagcaaatcgtgccctcccagggccagatggtccagcaacaaggaaccttgaaccctcagaaccctatgatcctttcaagggcccagcttatgccacagggccagatgatggtgaaccccccgagccaaaatcttgggccctcgccccaaaggatgaccccacccaagcagatgctttcccagcagggcccacaaatgatggcgccacataaccagatgatggggcctcaggggcaggttttgctccaacagaacccaatgatagagcagattatgaccaatcaaatgcaggggaataagcagcagtttaacactcagaaccagtccaatgtcatgccgggaccagcccagataatgaggggaccaactccaaacatgcaaggaaatatggtgcagtttacgggacagatgtcaggacagatgctgccccagcaagggcctgtgaacaacagtccatctcaggttatgggcattcagggacaggtcctgcggccaccagggcccagcccacacatggcccagcagcatggtgatcctgctactacagcaaataacgatgtcagtttatctcagatgatgcctgatgttagcattcaacaaaccaacatggtcccccctcatgtgcaggccatgcagggaaacagtgcctcgggaaaccacttctcaggccatgggatgtctttcaatgcacctttcagtggagctcccaatggaaatcagatgtcctgtggtcaaaatccaggcttcccagtcaataaggatgtcacgctaacgagcccattgttggtcaacttattgcagagtgacatatctgcaggccattttggggtaaacaataagcaaaataataccaacgcaaataaaccgaagaagaagaaaccccctcggaagaagaaaaatagtcagcaagatctaaacaccccagatactcgcccagctggtctggaagaggctgatcagccaccgttgcctggagaacaaggaattaacttggataactcaggccctaaactgccagaattttcaaaccggccaccaggttatccttctcaaccagttgaacagaggccacttcagcagatgcctcctcaactcatgcagcatgtggcacccccaccacagccaccacagcagcagccacagccacaactgcctcagcagcagcagccaccacctcccagtcagccacagtctcagcagcagcagcagcagcagcaacaaatgatgatgatgctcatgatgcagcaggatcccaaatcagttaggcttccagtctctcaaaatgtccatcctccaaggggccccctgaaccccgactcccagagaatgcccatgcaacagagtggcagtgtgcctgtcatggtcagtctgcaaggacctgcctccgtgccaccatcacctgataaacaaagaatgccaatgcctgtgaatactcccttgggaagcaattcaaggaaaatggtctatcaggagagcccgcagaatccttccagctcgccactggcggagatggcctcactccctgaagcaagtggcagtgaagcaccatctgtcccaggaggcccaaacaacatgccttcacatgtagtacttccccagaatcagttaatgatgacagggccaaaacctggaccatcgcccctttcagcaactcaaggtgcaactccccagcaaccccctgtaaattccctgcccagctctcacggccaccacttcccaaatgtggctgcgccaacccagacatctaggcccaaaacaccaaacagagccagccccagaccctattatcctcagacacccaacaaccgccctcccagcacagaaccttcagaaatcagtctgtcaccagaaagactcaatgcctccatagcaggactcttccctccacagattaatattcctttacctcctaggccaaatttaaacaggggctttgatcaacaaggcctaaatccaacaactttgaaggccatcgggcaagcaccttcaaatcttaccatgaatccttccaattttgctaccccacaaactcacaaattagattctgtggtagtgaattctggaaagcagtctaattctggagcaacaaaacgggcaagtccaagcaacagtcgcaggtctagtcctgggtccagtaggaaaaccactccaagccctgggaggcaaaattcaaaagcccctaaacttactctggcctctcagacaaatgcagccctattgcagaatgtggagttgccgagaaatgtattggtcagtcccactcctctggccaatccccctgtacctgggagctttcctaacaacagtgggctgaatcctcagaattctactgtgtctgtggctgcagttgggggtgttgttgaggataacaaggagagcttgaatgtgcctcaggacagtgattgccagaattcccagagtaggaaggaacaggtaaacattgaactaaaagcagtccctgcccaagaagttaaaatggttgtccctgaagatcagtccaaaaaggatgggcagccttcggatcctaacaaacttcccagtgtcgaagagaacaaaaatttggtgtctcctgctatgagggaagcaccaacatcgttaagtcaacttcttgacaactctggagctcccaatgtgacaattaaaccccctgggcttacagatctggaagtaacacctccagtagtttctggggaggacctcaaaaaagcatctgtcattcccacactgcaggatctgtcttcttctaaagaaccttctaattccctaaacttacctcacagtaatgagctgtgttcatcccttgtgcatcccgaattgagtgaggtcagttctaacgttgcaccaagcatccctccagtaatgtcaagacctgttagctcttcctccatttccactcccttgcccccaaatcaaataactgtatttgtcacttccaatcccatcacaacttcagctaacacatcagcagctttgccaactcacttgcagtctgcattgatgtcaacagttgtcacaatgcccaatgcgggtagcaaggttatggtttctgagggacagtcagctgctcagtctaatgcccggcctcagttcattacacctgtctttatcaattcatcctcaataattcaggttatgaaaggatcacagccaagcacaattcctgcagccccactgacaaccaactctggcctgatgcctccctctgttgcagttgttggccctttacacatacctcagaacataaaattttcttctgctcctgtaccgcctaatgccctctccagtagtcctgctccaaacatccagacaggtcgacctttggtccttagctcacgagccacccctgttcagcttccttcccctccttgtacgtcttctccagttgtcccttctcatccccctgtgcagcaagtgaaagaattgaatccagatgaggctagccctcaggtgaacacctcagcagatcagaacactcttccctcttcacagtcaaccacaatggtttctccccttttgaccaatagtccagggtcctctggcaaccggcgaagcccagtctcgtctagtaagggcaaaggaaaagtggacaaaattggccaaattttgttgaccaaggcatgtaagaaagttacaggctctcttgagaaaggggaagaacaatatggtgcagatggagagactgaaggccaagggctagacaccacagctccggggctcatgggaacagagcagttatccacagagctggacagtaaaaccccaacgcccccagcacccactctgctaaaaatgacctctagccctgtgggcccgggcactgcctcagcaggacccagcttacctggcggtgctctccccaccagtgtacgctcgatagtaaccactctggtaccctccgagctcatctccgccgtaccgaccacaaaaagcaatcatggtggcatagcatctgagtcacttgcgggtggcctagtggaggagaaggtgggatcccatccagaacttctacccagcatagccccgtcgcagaatttagtctcaaaggaaacttcaaccacagcactgcaggcctctgttgccagaccagagctggaggtaaatgctgccatagtctctggacaaagcagtgagcccaaagagatagttgaaaagtccaaaatcccaggccgaagaaactcccgaactgaagagccaactgtggcctctgaaagtgtggaaaatggacatcgtaaacgatcttctcgacctgcttcagcctccagctctactaaagacataaccagtgcggtgcaatccaagcgaagaaaatccaagtaa

SEQ ID NO: 8581 - DNA, 12665 bp, synthetic construct
  misc_feature 1..12665: note = Synthetic polypeptide
  source 1..12665: mol_type = other DNA
gaagagccaagaaaatattgaaaatgtaatgaagtacttattagagctggggtggaaaggagaatggctttggacttgcagaatgttgcagagacttgcatatgatgaaatatccacccagtgcaactacactacactttgaattctatgcagatcctggggccgaggtcaaaattgagaaaaggacaactagtaacacactacattatattcacatagagcaacttgacaagatttcagaaagcccttctgaaatcatggaatctcttaccaaaatgtacagcattcctaaggataagcagatgctgttatttacacacatacgactggcccatggcttttctaatcacaggaagcgattgcaggcagttcaggccagactgcatgcaatatctatattagtgtattccaatgccttgcaggaatcagcaaacagtatcttgtataatggcttgatagaggagttggtagatgtccttcagataacggataagcagcttatggagattaaagcagcttctttacgaacattaacatcaattgtccacttggagagaactcccaaactcagcagtattattgactgtactggaactgcctcctaccatggatttttgccagtgcttgtaaggaactgtatccaggccatgattgatccttccatggatccataccctcaccagtttgccactgctctcttctcttttttataccatctggccagctacgatgctggtggtgaagccttggtctcctgtggaatgatggaagccttattgaaggtcataaagtttcttggcgatgaacaggaccagataacatttgtcaccagagccgtcagagtggttgaccttatcaccaacctggatatggcagcttttcaatcccatagtggactttctatcttcatttatagacttgagcatgaagtagatttgtgccgaaaagaatgtccgtttgtgatcaagccaaagatccagagacccaatactacacaagaaggagaggaaatggaaactgatatggatggagtccagtgtattccacaacgagcagcacttctgaaatccatgttgaatttcctcaagaaggccatccaagaccctgctttctcagatggcatacgacatgtgatggatggttctctgcctacctccctgaaacacatcatcagcaatgcagaatactatggcccatcactcttcctcctagctactgaagtggtgactgtgtttgtatttcaagaaccatcactgctctcctcactccaggacaatggattgacagatgtcatgctgcatgcactgcttatcaaagatgttcctgctacccgtgaagtccttggctccctcccaaatgtattcagtgcactctgtttgaatgcccgaggtcttcagtcttttgttcagtgtcagccttttgaacgcctcttcaaagttcttctgtctccagattacctcccagccatgcggaggaggagaagttctgatccccttggggatactgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggaaccctgtccagcatccccacagccctgacccgctggacagaagaatgcaaagttctcgatgctgagagcatgcatgactgtgtttcagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacagtgtactgcatctaagtcaaatgactccactgaacagaatctctcagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataacctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacagctccccacctgcatcctctgagagctcttccaccagagattctgccgtggccatttctggagcagattcccgaggaatcctagaagagccgttgccttcaacaagcagtgaagaagaagatccccttgcgggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaatttctcccactactaagggcagcaaatctccagcgaaggtgagtgatgggggcagcagcagtacagactttaagatggtgtcctctggcctcactgaaaaccagctacagctctctgtagaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggttcctccggtttaggctcagctagcagcatccaggcagctgttcggcagctggaggctgaggctgatgccattatacaaatggtacgtgagggtcaaagggcgcggagacagcaacaagcagcaacgtcggagtctagccagtcagaggcgtctgtccggagggaggaatcacccatggatgtggaccagccatctcccagtgctcaagatactcaatccattgcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctagtgctacagcctgctgtcgaggccttctttctggtccatgccacagagcgggagagcaagcctcctgtccgagacacccgtgagagccagctggcacacatcaaggacgagcctcctccactctcccctgcccccttaaccccagccacgccttcctcccttgacccattcttctcccgggagccctcatctatgcacatctcctcaagcctgccccctgacacacagaagttccttcgctttgcagagactcaccgcactgtgttaaaccagatcctacggcagtccacgacccaccttgctgatgggccttttgctgtcctggtagactacattcgtgtcctcgactttgatgtcaagcgcaaatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtatatagtatttgaaggagaagaagggcaggatgctggtgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctggtttatctgctggaaaatgatgtctccacactaggctatgacctcaccttcagcactgaggtccaagagtttggagtttgtgaagttcgtgacctcaaacccaatggggccaacatcttggtaacagaggagaataagaaggagtatgtacacctggtatgccagatgagaatgacaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcagatccagtggttctggagagcattgcgttctttcgatcaagctgaccgtgccaagttcctccagtttgtcacgggtacttccaaggtacccctgcaaggctttgctgccctcgaaggcatgaatggcattcagaagtttcagatccatcgagatgacaggtccacagatcgcctgccttcagctcacacatgttttaatcagctggatctgcctgcctatgagagctttgagaagctccgccacatgctactgttggctatccaggagtgctctgaaggctttgggctggcctaa

SEQ ID NO: 8582 - DNA, 4559 bp, synthetic construct
  misc_feature 1..4559: note = Synthetic polypeptide
  source 1..4559: mol_type = other DNA
gaagagccaagaaaatattgaaaatgtaatgaagtacttattagagctggggtggaaaggagaatggctttggacttgcagaatgttgcagagacttgcatatgatgaaatatccacccagtgcaactacactacactttgaattctatgcagatcctggggccgaggtcaaaattgagaaaaggacaactagtaacacactacattatattcacatagagcaacttgacaagatttcagaaagcccttctgaaatcatggaatctcttaccaaaatgtacagcattcctaaggataagcagatgctgttatttacacacatacgactggcccatggcttttctaatcacaggaagcgattgcaggcagttcaggccagactgcatgcaatatctatattagtgtattccaatgccttgcaggaatcagcaaacagtatcttgtataatggcttgatagaggagttggtagatgtccttcagataacggataagcagcttatggagattaaagcagcttctttacgaacattaacatcaattgtccacttggagagaactcccaaactcagcagtattattgactgtactggaactgcctcctaccatggatttttgccagtgcttgtaaggaactgtatccaggccatgattgatccttccatggatccataccctcaccagtttgccactgctctcttctcttttttataccatctggccagctacgatgctggtggtgaagccttggtctcctgtggaatgatggaagccttattgaaggtcataaagtttcttggcgatgaacaggaccagataacatttgtcaccagagccgtcagagtggttgaccttatcaccaacctggatatggcagcttttcaatcccatagtggactttctatcttcatttatagacttgagcatgaagtagatttgtgccgaaaagaatgtccgtttgtgatcaagccaaagatccagagacccaatactacacaagaaggagaggaaatggaaactgatatggatggagtccagtgtattccacaacgagcagcacttctgaaatccatgttgaatttcctcaagaaggccatccaagaccctgctttctcagatggcatacgacatgtgatggatggttctctgcctacctccctgaaacacatcatcagcaatgcagaatactatggcccatcactcttcctcctagctactgaagtggtgactgtgtttgtatttcaagaaccatcactgctctcctcactccaggacaatggattgacagatgtcatgctgcatgcactgcttatcaaagatgttcctgctacccgtgaagtccttggctccctcccaaatgtattcagtgcactctgtttgaatgcccgaggtcttcagtcttttgttcagtgtcagccttttgaacgcctcttcaaagttcttctgtctccagattacctcccagccatgcggaggaggagaagttctgatccccttggggatactgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcagggtacctcggctgaataa

SEQ ID NO: 8583 - DNA, 952 bp, synthetic construct
  misc_feature 1..952: note = Synthetic polypeptide
  source 1..952: mol_type = other DNA
ttttacttaaaattttctttgttgttttttctcctacccattagaatgtaagttccataaagtccggttctccaccgagggacatgaggctgctttcactatccgcataagacacccgcccaaccctcggctgtacccacctgggtctctaccccagggagcccagtacaacatcagcgctctagtcacgattgccaccaagaccttcctccgttatgatcggctacgggctctcatcaccagtatccgccgcttctacccaacggttaccgtggtcatcgctgacgacagcgacaagccagagcgcgttagtggcccctacgtggaacactatctcatgcccttcggcaagggctggttcgcaggccggaacctggccgtgtctcaagtaaccaccaagtacgtgctgtgggtggacgacgacttcgtcttcacggcgcggacgcggctggagaggcttgtggacgtgctggagcggacgccgctggacctggtggggggcgcggtgcgcgagatctccggctttgccaccacttatcggcagctgctgagcgtggagcccggcgccccaggcctcgggaactgcctccggcaaaggcgcggcttccaccacgagctcgtcggcttcccaggctgcgtggtcaccgacggcgtggttaacttcttcctggcgcggactgacaaggtgcgcgaggtcggtttcgacccccgcctcagccgcgtggctcatctggaattcttcttggatgggcttggttcccttcgggttggctcctgctccgacgtcgtggtggatcatgcatccaaactgaagctgccttggacatcaagggatgccggagcagagacttacgcccggtaccgttacccaggatcactggacgagagccagatggccaaacaccggctgctcttcttcaaacaccggctgcagtgcatgacctcccagtga

SEQ ID NO: 8584 - DNA, 87 bp, synthetic construct
  misc_feature 1..87: note = Synthetic polypeptide
  source 1..87: mol_type = other DNA
ttttacttaaaattttctttgttgttttttctcctacccattagaatgtaagttccataaagtccggttctccaccgagggacatga

SEQ ID NO: 8585 - DNA, 3220 bp, synthetic construct
  misc_feature 1..3220: note = Synthetic polypeptide
  source 1..3220: mol_type = other DNA
cactcccagttttgaaagttctattatgagtaaaatgctatcagacagcatcgcatgctacagagaaatctttgtgaaaggaagagtcaatggatgtggcaaacttcattgttgtcttagtttaagaaattgccatagccatcacaaccttcagtagccacttctctcatcagtcagcagccgtcatcgaggcaagactctccaccagcacaaagattacaactcaactgaaggctcagatgattattagcattttatagcaatgatgtattttaaaattaaggtagactggcgtcgttccttcatcaccactgatgttaatccttactatgattcatttgtcagatggcaatttttaacattaagagaaagaaacaaaattaaatttgggaagcggtatacaatttactctccgaaagatggacagccttgcatggatcatgatagacaaactggagagggtgttggacctcaggaatatactttactcaaattgaaggtgcttgagccatacccatctaaattaagtggcctgaaaggtaaaaatattttcttggtggctgctactctcagacctgagaccatgtttgggcagacaaattgttgggttcgtcctgatatgaagtacattggatttgagacggtgaatggtgatatattcatctgtacccaaaaagcagccaggaatatgtcataccagggctttaccaaagacaatggcgtggtgcctgttgttaaggaattaatgggggaggaaattcttggtgcatcactttctgcacctttaacatcatacaaggtgatctatgttctcccaatgctaactattaaggaggataaaggcactggtgtggttacaagtgttccttccgactcccctgatgatattgctgccctcagagacttgaagaaaaagcaagccttacgagcaaaatatggaattagagatgacatggtcttgccatttgagccggtgccagtcattgaaatcccaggttttggaaatctttctgctgtaaccatttgtgatgagttgaaaattcagagccagaatgaccgggaaaaacttgcagaagcaaaggagaagatatatctaaaaggattttatgagggtatcatgttggtggatggatttaaaggacagaaggttcaagatgtaaagaagactattcagaaaaagatgattgacgctggagatgcacttatttacatggaaccagagaaacaagtgatgtccaggtcgtcagatgaatgtgttgtggctctgtgtgaccagtggtacttggattatggagaagagaattggaagaaacagacatctcagtgcttgaagaacctggaaacattctgtgaggagaccaggaggaattttgaagccaccttaggttggctacaagaacatgcttgctcaagaacttatggtctaggcactcacctgccttgggatgagcagtggctgattgaatcactttctgactccactatttacatggcattttacacagttgcacacctattgcaggggggtaacttgcatggacaggcagagtctccgctgggcattagaccgcaacagatgaccaaggaagtttgggattatgttttcttcaaggaggctccatttcctaagactcagattgcaaaggaaaaattagatcagttaaagcaggagtttgaattctggtatcctgttgatcttcgcgtctctggcaaggatcttgttccaaatcatctttcatattacctttataatcatgtggctatgtggccggaacaaagtgacaaatggcctacagctgtgagagcaaatggacatctcctcctgaactctgagaagatgtcaaaatccacaggcaacttcctcactttgacccaagctattgacaaattttcagcagatggaatgcgtttggctctggctgatgctggtgacactgtagaagatgccaactttgtggaagccatggcagatgcaggtattctccgtctgtacacctgggtagagtgggtgaaagaaatggttgccaactgggacagcctaagaagtggtcctgccagcactttcaatgatagagtttttgccagtgaattgaatgcaggaattataaaaacagatcaaaactatgaaaagatgatgtttaaagaagctttgaaaacagggttttttgagtttcaggccgcaaaagataagtaccgtgaattggctgtggaagggatgcacagagaacttgtgttccggtttattgaagttcagacacttctcctcgctccattctgtccacatttgtgtgagcacatctggacactcctgggaaagcctgactcaattatgaatgcttcatggcctgtggcaggtcctgttaatgaagttttaatacactcctcacagtatcttatggaagtaacacatgaccttagactacgactcaagaactatatgatgccagctaaagggaagaagactgacaaacaacccctgcagaagccctcacattgcaccatctatgtggcaaagaactatccaccttggcaacataccaccctgtctgttctacgtaaacactttgaggccaataacggaaaactgcctgacaacaaagtcattgctagtgaactaggcagtatgccagaactgaagaaatacatgaagaaagtcatgccatttgttgccatgattaaggaaaatctggagaagatggggcctcgtattctggatttgcaattagaatttgatgaaaaggctgtgcttatggagaatatagtctatctgactaattcgcttgagctagaacacatagaagtcaagtttgcctccgaagcagaagataaaatcagggaagactgctgtcctgggaaaccacttaatgtttttagaatagaacctggtgtgtccgtttctctggtgaatccccagccatccaatggccacttctcaaccaaaattgaaatcaggcaaggagataactgtgattccataatcaggcgtttaatgaaaatgaatcgaggaattaaagacctttccaaagtgaaactgatgagatttgatgatccactgttggggcctcgacgagttcctgtcctgggaaaggagtacaccgagaagacccccatttctgagcatgctgttttcaatgtggacctcatgagcaagaaaattcatctgactgagaatgggataagggtggatattggcgatacaataatctatctggttcattaa

SEQ ID NO: 8586 - DNA, 809 bp, synthetic construct
  misc_feature 1..809: note = Synthetic polypeptide
  source 1..809: mol_type = other DNA
cctggttctctggggcacgaggcttctcctcagcactctggcgcccccaacaggttcccagtgttcggctgggacaggcacgctgtggctggctacttcccttccttccatcccccttgggccaaacaggatcggtgcttctggtgagacgtctccccatgcacatcactcccagatgccctagggggcacatttcccacaactcccagagggcaggtttctagaaagtgccaccagtggggaggcgccacaacttcactgccattttgtgaggtgccgccgtctctcctccagcaagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 8587 - DNA, 809 bp, synthetic construct
  misc_feature 1..809: note = Synthetic polypeptide
  source 1..809: mol_type = other DNA
cctggttctctggggcacgaggcttctcctcagcactctggcgcccccaacaggttcccagtgttcggctgggacaggcacgctgtggctggctacttcccttccttccatcccccttgggccaaacaggatcggtgcttctggtgagacgtctccccatgcacatcactcccagatgccctagggggcacatttcccacaactcccagagggcaggtttctagaaagtgccaccagtggggaggcgccacaacttcactgccattttgtgaggtgccgccgtctctcctccagcaagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagatgggatgatgcagaaacctggtagcaatgcacctgtgggaggaaatgttaccagcaatttctctggagatgacctagaatgcagaggaatagcctcctctcccaaaagccaacaagaaattaatgctgatataaaatgtcaagtagtgaaggaaatccgatgccttggacgaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 8588 - DNA, 2208 bp, synthetic construct
  misc_feature 1..2208: note = Synthetic polypeptide
  source 1..2208: mol_type = other DNA
tctccctctccctctcccgtctccccacggtctccctctccctctgtttccacggtctccctctcatgccgagccgaagctggactgtactgctgccatctcggctcactgcaacctccctgcctgattctcctgcctcagcctgccgagtgcctgcgattgcaggcacccgctgccacgcctgactggttttcgtattttttttggtggagacggggtttcgctgtgttggcctggccggtctccagctcctaaccgcgagcgatccgccagcctcggcctcccgaggtgccgggattgcagacggagtctcgttcactcagtgctcagtggtgccccggctggagtgcagtggcatgatctcggctcgctacaacctccaactcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctgggaagtgaggagcgtctccgtccggccgccatcccacctaggaagtgaggagcgcctcttcccggccgccatcccatctaggaagtgaagagcgtctctgcccggccgcccatcgtctgagatgtggggagcgcctctgccccgccgccccgtctgggatgtgaggagcgcctctgccaggccgtgaccccgtctgggaggtgaggagtgtctctgcccggccaccccgtctgagaagtgaggagaccctctgcctggcaaccgccccgtctgagaagtgaggagcccctctgcccagcagccgccccgtctgagaagtgaggagcctctccgcccggcagccaccccgtctgggaaaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagcatgggctgatgcctttcgaagcagtcctgatctcaccggcgttgtgcacatatatgaggagctgaagaggaaaggggttgaatttcccatggcagacttggacgctctgtctcccatacacacaccacagcggagtgtccctgaagtggatccagctgcgaccatgcccaggtcccaatcacagcagaggacaagtgctggttcctattcctcgccgcctcctgctccctactccgcaccgcaggccccagctctgagtgtgactggccccatcacagccaattcagaacagattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggatccccgttgcgcagccatctgtcatggacgacattgaggtgtggctcaggaccgacctgaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtga

SEQ ID NO: 8589 - DNA, 2358 bp, synthetic construct
  misc_feature 1..2358: note = Synthetic polypeptide
  source 1..2358: mol_type = other DNA
tctccctctccctctcccgtctccccacggtctccctctccctctgtttccacggtctccctctcatgccgagccgaagctggactgtactgctgccatctcggctcactgcaacctccctgcctgattctcctgcctcagcctgccgagtgcctgcgattgcaggcacccgctgccacgcctgactggttttcgtattttttttggtggagacggggtttcgctgtgttggcctggccggtctccagctcctaaccgcgagcgatccgccagcctcggcctcccgaggtgccgggattgcagacggagtctcgttcactcagtgctcagtggtgccccggctggagtgcagtggcatgatctcggctcgctacaacctccaactcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctgggaagtgaggagcgtctccgtccggccgccatcccacctaggaagtgaggagcgcctcttcccggccgccatcccatctaggaagtgaagagcgtctctgcccggccgcccatcgtctgagatgtggggagcgcctctgccccgccgccccgtctgggatgtgaggagcgcctctgccaggccgtgaccccgtctgggaggtgaggagtgtctctgcccggccaccccgtctgagaagtgaggagaccctctgcctggcaaccgccccgtctgagaagtgaggagcccctctgcccagcagccgccccgtctgagaagtgaggagcctctccgcccggcagccaccccgtctgggaaaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagtgctggagacatgtgtgaagaactgtggccaccgcttccacatccttgtggccaaccgagatttcatcgacagtgttctggtcaaaattatatctcccaagaacaaccctcccaccattgtacaggacaaagtgcttgctctgatccaggcatgggctgatgcctttcgaagcagtcctgatctcaccggcgttgtgcacatatatgaggagctgaagaggaaaggggttgaatttcccatggcagacttggacgctctgtctcccatacacacaccacagcggagtgtccctgaagtggatccagctgcgaccatgcccaggtcccaatcacagcagaggacaagtgctggttcctattcctcgccgcctcctgctccctactccgcaccgcaggccccagctctgagtgtgactggccccatcacagccaattcagaacagattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggatccccgttgcgcagccatctgtcatggacgacattgaggtgtggctcaggaccgacctgaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtga

SEQ ID NO: 8590 - DNA, 2223 bp, synthetic construct
  misc_feature 1..2223: note = Synthetic polypeptide
  source 1..2223: mol_type = other DNA
tctccctctccctctcccgtctccccacggtctccctctccctctgtttccacggtctccctctcatgccgagccgaagctggactgtactgctgccatctcggctcactgcaacctccctgcctgattctcctgcctcagcctgccgagtgcctgcgattgcaggcacccgctgccacgcctgactggttttcgtattttttttggtggagacggggtttcgctgtgttggcctggccggtctccagctcctaaccgcgagcgatccgccagcctcggcctcccgaggtgccgggattgcagacggagtctcgttcactcagtgctcagtggtgccccggctggagtgcagtggcatgatctcggctcgctacaacctccaactcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctgggaagtgaggagcgtctccgtccggccgccatcccacctaggaagtgaggagcgcctcttcccggccgccatcccatctaggaagtgaagagcgtctctgcccggccgcccatcgtctgagatgtggggagcgcctctgccccgccgccccgtctgggatgtgaggagcgcctctgccaggccgtgaccccgtctgggaggtgaggagtgtctctgcccggccaccccgtctgagaagtgaggagaccctctgcctggcaaccgccccgtctgagaagtgaggagcccctctgcccagcagccgccccgtctgagaagtgaggagcctctccgcccggcagccaccccgtctgggaaaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagtgctggagacatgtgtgaagaactgtggccaccgcttccacatccttgtggccaaccgagatttcatcgacagtgttctggtcaaaattatatctcccaagaacaaccctcccaccattgtacaggacaaagtgcttgctctgatccagagtgtccctgaagtggatccagctgcgaccatgcccaggtcccaatcacagcagaggacaagtgctggttcctattcctcgccgcctcctgctccctactccgcaccgcaggccccagctctgagtgtgactggccccatcacagccaattcagaacagattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggatccccgttgcgcagccatctgtcatggacgacattgaggtgtggctcaggaccgacctgaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtga

SEQ ID NO: 8591 - DNA, 2286 bp, synthetic construct
  misc_feature 1..2286: note = Synthetic polypeptide
  source 1..2286: mol_type = other DNA
tctccctctccctctcccgtctccccacggtctccctctccctctgtttccacggtctccctctcatgccgagccgaagctggactgtactgctgccatctcggctcactgcaacctccctgcctgattctcctgcctcagcctgccgagtgcctgcgattgcaggcacccgctgccacgcctgactggttttcgtattttttttggtggagacggggtttcgctgtgttggcctggccggtctccagctcctaaccgcgagcgatccgccagcctcggcctcccgaggtgccgggattgcagacggagtctcgttcactcagtgctcagtggtgccccggctggagtgcagtggcatgatctcggctcgctacaacctccaactcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctgggaagtgaggagcgtctccgtccggccgccatcccacctaggaagtgaggagcgcctcttcccggccgccatcccatctaggaagtgaagagcgtctctgcccggccgcccatcgtctgagatgtggggagcgcctctgccccgccgccccgtctgggatgtgaggagcgcctctgccaggccgtgaccccgtctgggaggtgaggagtgtctctgcccggccaccccgtctgagaagtgaggagaccctctgcctggcaaccgccccgtctgagaagtgaggagcccctctgcccagcagccgccccgtctgagaagtgaggagcctctccgcccggcagccaccccgtctgggaaaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagtgctggagacatgtgtgaagaactgtggccaccgcttccacatccttgtggccaaccgagatttcatcgacagtgttctggtcaaaattatatctcccaagaacaaccctcccaccattgtacaggacaaagtgcttgctctgatccaggcatgggctgatgcctttcgaagcagtcctgatctcaccggcgttgtgcacatatatgaggagctgaagaggaaaggggttgaatttcccatggcagacttggacgctctgtctcccatacacacaccacagcggattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggacttttctgtcctcggcccagaagagaggtagaggtggggagtctgacctggagcccatagacagctggcttataacccaaggaatgatccccgttgcgcagccatctgtcatggacgacattgaggtgtggctcaggaccgacctgaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtga

SEQ ID NO: 8592 - DNA, 2004 bp, synthetic construct
  misc_feature 1..2004: note = Synthetic polypeptide
  source 1..2004: mol_type = other DNA
tctccctctccctctcccgtctccccacggtctccctctccctctgtttccacggtctccctctcatgccgagccgaagctggactgtactgctgccatctcggctcactgcaacctccctgcctgattctcctgcctcagcctgccgagtgcctgcgattgcaggcacccgctgccacgcctgactggttttcgtattttttttggtggagacggggtttcgctgtgttggcctggccggtctccagctcctaaccgcgagcgatccgccagcctcggcctcccgaggtgccgggattgcagacggagtctcgttcactcagtgctcagtggtgccccggctggagtgcagtggcatgatctcggctcgctacaacctccaactcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctgggaagtgaggagcgtctccgtccggccgccatcccacctaggaagtgaggagcgcctcttcccggccgccatcccatctaggaagtgaagagcgtctctgcccggccgcccatcgtctgagatgtggggagcgcctctgccccgccgccccgtctgggatgtgaggagcgcctctgccaggccgtgaccccgtctgggaggtgaggagtgtctctgcccggccaccccgtctgagaagtgaggagaccctctgcctggcaaccgccccgtctgagaagtgaggagcccctctgcccagcagccgccccgtctgagaagtgaggagcctctccgcccggcagccaccccgtctgggaaaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagtgctggagacatgtgtgaagaactgtggccaccgcttccacatccttgtggccaaccgagatttcatcgacagtgttctggtcaaaattatatctcccaagaacaaccctcccaccattgtacaggacaaagtgcttgctctgatccagattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtga

SEQ ID NO: 8593 - DNA, 2001 bp, synthetic construct
  misc_feature 1..2001: note = Synthetic polypeptide
  source 1..2001: mol_type = other DNA
tctccctctccctctcccgtctccccacggtctccctctccctctgtttccacggtctccctctcatgccgagccgaagctggactgtactgctgccatctcggctcactgcaacctccctgcctgattctcctgcctcagcctgccgagtgcctgcgattgcaggcacccgctgccacgcctgactggttttcgtattttttttggtggagacggggtttcgctgtgttggcctggccggtctccagctcctaaccgcgagcgatccgccagcctcggcctcccgaggtgccgggattgcagacggagtctcgttcactcagtgctcagtggtgccccggctggagtgcagtggcatgatctcggctcgctacaacctccaactcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctgggaagtgaggagcgtctccgtccggccgccatcccacctaggaagtgaggagcgcctcttcccggccgccatcccatctaggaagtgaagagcgtctctgcccggccgcccatcgtctgagatgtggggagcgcctctgccccgccgccccgtctgggatgtgaggagcgcctctgccaggccgtgaccccgtctgggaggtgaggagtgtctctgcccggccaccccgtctgagaagtgaggagaccctctgcctggcaaccgccccgtctgagaagtgaggagcccctctgcccagcagccgccccgtctgagaagtgaggagcctctccgcccggcagccaccccgtctgggaaaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacaattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggacttttctgtcctcggcccagaagagaggtagaggtggggagtctgacctggagcccatagacagctggcttataacccaaggaatgatccccgttgcgcagccatctgtcatggacgacattgaggtgtggctcaggaccgacctgaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtga

SEQ ID NO: 8594 - DNA, 3545 bp, synthetic construct
  misc_feature 1..3545: note = Synthetic polypeptide
  source 1..3545: mol_type = other DNA
ttcacccggtagtttaatgtggctttgtagaagaatcagtatttccctccttagagtccctctgtgacttactttctaacatagctccactgtatctcacaggaccccggatgccccagcccccatccttcccaaattcatccgcttcttccccttctcttcgggtttactctgctttagccgtgcggatcttctttccattatggaatatgtccggactactcccacccgtcagattttgtacttgtggttcccactagaagcatccagaatgtttttcctctctaccctcccccattctttcattggatgaccttattctcattcttctggtaataatcagggttaacacctctctgaccacctccacttactctgtctcatcaccttgttgatttccttcatagtactcaccactgtttaaaatgatgatttagaaagttctgcgtgtgcaagctcaacaggcattgctgtttgtcctgctcactgctgtctacccagtgcctcagcccagtgctccgcctgtaaagggtaacttcggggaggcagggccagctggcagtccagggccaccaggaccagtggggccagcaggcatcaaaggggcgaagggggagccctgtgagccgtgcccagccctgtccaaccttcaggatggggatgtccgtgtggtggccttgcctggcccatccggagagaagggggaacctgggcctccaggctttggcttgccaggaaaacagggcaaggctggagagcgtggactgaaggggcagaagggtgatgctgggaatcctggagaccctggaacgccgggcaccacagggcggccaggactgtcaggagagcctggagttcagggccccgcggggccaaaaggagaaaagggtgatggctgcactgcctgccccagcctgcaggggacagtgacagacatggcaggacggcctgggcagcccggccccaaaggagagcagggccccgaaggcgtgggccgacctggtaaacccggccaacccggtctaccaggagttcaagggcccccaggactgaagggcgtgcagggagagccagggcctccaggaaggggagtccagggaccccagggggagcctggagccccgggtttgcctggcattcagggacttccgggacctcggggaccacctggccccactggagagaagggtgcccagggatctccaggggtgaaaggagccaccggacctgtgggacctcctggggccagtgtctctgggcctccgggccgtgatgggcagcaaggacagacgggactcagaggaacaccaggtgaaaaaggaccacgaggagagaagggtgagccaggggagtgctcctgcccctctcaaggagacctcatcttctctggcatgccgggtgctccgggactttggatgggcagctcctggcagccgggcccgcagggtccaccaggtattcccggaccaccaggcccccctggagtacctgggctgcagggagtgcctggaaacaacggtttgccaggacagcctgggctcactgcagaactgggagccctggctctgggttctcactggggctccccaagtatctgcggggactgtgtccaggggcagagggcccacccagggtacctcgtggagaagggagagaagggagaccagggcatccctggtgtgccaggcctcgacaactgcgcccagtgctttttgtcactggagcgcccaagagccgaggaggcccggggtgacaacagtgagggagatcctggctgtgttgggagcccaggcctacctggtcctccgggattgccaggccagagaggagaagagggtccgcctggcatgaggggctccccgggtcctccaggccctatcggccccccaggttttcctggtgctgttggctcccccggattgcctggccttcaaggagagcgaggtctcacgggcctgactggagacaagggggagccgggtcctccagggcaaccaggttacccaggtgccacgggccccccaggactgcctggcatcaagggggagcgtggctacaccgggtcagcgggagagaaaggagagccgggccccccaggatctgaaggcctcccaggccccccaggcccagcgggtcccagaggagagcgaggaccccaaggtaactccggtgagaagggcgaccagggatttcaaggccagccaggctttccgggcccaccgggtccccctggattcccaggcaaagttggatcacctggcccacctggccctcaagcagagaagggcagcgaagggattcgaggcccatcaggcctgcctggctcccctgggccaccgggacctcctgggattcagggccccgccggtctggatggtttggatgggaaggacggcaagcctggcttgaggggggaccctggtcctgctggcccccctggactcatgggaccaccgggctttaaggggaaaacaggacatcctggcctcccaggacctaagggtgactgtggcaaaccaggtccccctggcagcactggccggcctggcgcagagggtgaacctggtgccatgggaccccagggaagacccggtcccccgggacacgttgggccaccagggcctccaggccagccaggaccagctgggatctctgcagtgggtctgaaaggagaccgaggagccaccggagaaaggggccttgcaggcctcccaggccagcccggcccccctggacaccctggccccccaggcgaacctggtacggatggtgcagctggcaaagagggaccccctggaaagcagggattctatggacctcctggtcccaagggtgatccaggagctgcaggacagaagggccaggcaggagagaaggggagagccggcatgcctggtggacctggcaagagtggttccatggggcctgttgggccaccgggccctgcaggagagagaggccaccctggagctccggggccttcggggagccctggcttgcctggtgtgcctggctccatgggagacatggtgaattatgatgaaatcaagaggttcatcagacaagagatcattaaaatgtttgatgagagaatggcttactacacctccaggatgcagttccccatggagatggcggcagctccgggacgaccagggcctccagggaaggatggtgctccgggcaggccaggtgctccagggtcacctgggctccctggtcagattggcagagaaggacggcagggcttgccaggagtaagaggattgcctggtaccaaaggtgaaaaaggggacattggtattggcattgcaggagaaaatggtcttcccggccccccaggtcctcaaggtcctccaggctatggcaagatgggtgcaacaggaccaatgggccagcaaggcatccctggcatccctgggcccccgggtcccatgggccagccaggcaaggctggccactgtaatccctctgactgctttggggccatgccgatggagcagcagtacccacccatgaaaaccatgaaggggccttttggctga

SEQ ID NO: 8595 - DNA, 3542 bp, synthetic construct
  misc_feature 1..3542: note = Synthetic polypeptide
  source 1..3542: mol_type = other DNA
ttcacccggtagtttaatgtggctttgtagaagaatcagtatttccctccttagagtccctctgtgacttactttctaacatagctccactgtatctcacaggaccccggatgccccagcccccatccttcccaaattcatccgcttcttccccttctcttcgggtttactctgctttagccgtgcggatcttctttccattatggaatatgtccggactactcccacccgtcagattttgtacttgtggttcccactagaagcatccagaatgtttttcctctctaccctcccccattctttcattggatgaccttattctcattcttctggtaataatcagggttaacacctctctgaccacctccacttactctgtctcatcaccttgttgatttccttcatagtactcaccactgtttaaaatgatgatttagaaagttctgcgtgtgcaagctcaacaggcattgctgtttgtcctgctcactgctgtctacccagtgcctcagcccagtgctccgcctgtaaagggtaacttcggggaggcagggccagctggcagtccagggccaccaggaccagtggggccagcaggcatcaaaggggcgaagggggagccctgtgagccgtgcccagccctgtccaaccttcaggatggggatgtccgtgtggtggccttgcctggcccatccggagagaagggggaacctgggcctccaggctttggcttgccaggaaaacagggcaaggctggagagcgtggactgaaggggcagaagggtgatgctgggaatcctggagaccctggaacgccgggcaccacagggcggccaggactgtcaggagagcctggagttcagggccccgcggggccaaaaggagaaaagggtgatggctgcactgcctgccccagcctgcaggggacagtgacagacatggcaggacggcctgggcagcccggccccaaaggagagcagggccccgaaggcgtgggccgacctggtaaacccggccaacccggtctaccaggagttcaagggcccccaggactgaagggcgtgcagggagagccagggcctccaggaaggggagtccagggaccccagggggagcctggagccccgggtttgcctggcattcagggacttccgggacctcggggaccacctggccccactggagagaagggtgcccagggatctccaggggtgaaaggagccaccggacctgtgggacctcctggggccagtgtctctgggcctccgggccgtgatgggcagcaaggacagacgggactcagaggaacaccaggtgaaaaaggaccacgaggagagaagggtgagccaggggagtgctcctgcccctctcaaggagacctcatcttctctggcatgccgggtgctccgggactttggatgggcagctcctggcagccgggcccgcagggtccaccaggtattcccggaccaccaggcccccctggagtacctgggctgcagggagtgcctggaaacaacggtttgccaggacagcctgggctcactgcagaactgggatccttaccaattgaacagcacctccttaagagtatctgcggggactgtgtccaggggcagagggcccacccagggtacctcgtggagaagggagagaagggagaccagggcatccctggtgtgccaggcctcgacaactgcgcccagtgctttttgtcactggagcgcccaagagccgaggaggcccggggtgacaacagtgagggagatcctggctgtgttgggagcccaggcctacctggtcctccgggattgccaggccagagaggagaagagggtccgcctggcatgaggggctccccgggtcctccaggccctatcggccccccaggttttcctggtgctgttggctcccccggattgcctggccttcaaggagagcgaggtctcacgggcctgactggagacaagggggagccgggtcctccagggcaaccaggttacccaggtgccacgggccccccaggactgcctggcatcaagggggagcgtggctacaccgggtcagcgggagagaaaggagagccgggccccccaggatctgaaggcctcccaggccccccaggcccagcgggtcccagaggagagcgaggaccccaaggtaactccggtgagaagggcgaccagggatttcaaggccagccaggctttccgggcccaccgggtccccctggattcccaggcaaagttggatcacctggcccacctggccctcaagcagagaagggcagcgaagggattcgaggcccatcaggcctgcctggctcccctgggccaccgggacctcctgggattcagggccccgccggtctggatggtttggatgggaaggacggcaagcctggcttgaggggggaccctggtcctgctggcccccctggactcatgggaccaccgggctttaaggggaaaacaggacatcctggcctcccaggacctaagggtgactgtggcaaaccaggtccccctggcagcactggccggcctggcgcagagggtgaacctggtgccatgggaccccagggaagacccggtcccccgggacacgttgggccaccagggcctccaggccagccaggaccagctgggatctctgcagtgggtctgaaaggagaccgaggagccaccggagaaaggggccttgcaggcctcccaggccagcccggcccccctggacaccctggccccccaggcgaacctggtacggatggtgcagctggcaaagagggaccccctggaaagcagggattctatggacctcctggtcccaagggtgatccaggagctgcaggacagaagggccaggcaggagagaaggggagagccggcatgcctggtggacctggcaagagtggttccatggggcctgttgggccaccgggccctgcaggagagagaggccaccctggagctccggggccttcggggagccctggcttgcctggtgtgcctggctccatgggagacatggtgaattatgatgaaatcaagaggttcatcagacaagagatcattaaaatgtttgatgagagaatggcttactacacctccaggatgcagttccccatggagatggcggcagctccgggacgaccagggcctccagggaaggatggtgctccgggcaggccaggtgctccagggtcacctgggctccctggtcagattggcagagaaggacggcagggcttgccaggagtaagaggattgcctggtaccaaaggtgaaaaaggggacattggtattggcattgcaggagaaaatggtcttcccggccccccaggtcctcaaggtcctccaggctatggcaagatgggtgcaacaggaccaatgggccagcaaggcatccctggcatccctgggcccccgggtcccatgggccagccaggcaaggctggccactgtaatccctctgactgctttggggccatgccgatggagcagcagtacccacccatgaaaaccatgaaggggccttttggctga

SEQ ID NO: 8596 - DNA, 1628 bp, synthetic construct
  misc_feature 1..1628: note = Synthetic polypeptide
  source 1..1628: mol_type = other DNA
ttcacccggtagtttaatgtggctttgtagaagaatcagtatttccctccttagagtccctctgtgacttactttctaacatagctccactgtatctcacaggaccccggatgccccagcccccatccttcccaaattcatccgcttcttccccttctcttcgggtttactctgctttagccgtgcggatcttctttccattatggaatatgtccggactactcccacccgtcagattttgtacttgtggttcccactagaagcatccagaatgtttttcctctctaccctcccccattctttcattggatgaccttattctcattcttctggtaataatcagggttaacacctctctgaccacctccacttactctgtctcatcaccttgttgatttccttcatagtactcaccactgtttaaaatgatgatttagaaagttctgcgtgtgcaagctcaacaggcattgctgtttgtcctgctcactgctgtctacccagtgcctcagcccagtgctccgcctgtaaagggtaacttcggggaggcagggccagctggcagtccagggccaccaggaccagtggggccagcaggcatcaaaggggcgaagggggagccctgtgagccgtgcccagccctgtccaaccttcaggatggggatgtccgtgtggtggccttgcctggcccatccggagagaagggggaacctgggcctccaggctttggcttgccaggaaaacagggcaaggctggagagcgtggactgaaggggcagaagggtgatgctgggaatcctggagaccctggaacgccgggcaccacagggcggccaggactgtcaggagagcctggagttcagggccccgcggggccaaaaggagaaaagggtgatggctgcactgcctgccccagcctgcaggggacagtgacagacatggcaggacggcctgggcagcccggccccaaaggagagcagggccccgaaggcgtgggccgacctggtaaacccggccaacccggtctaccaggagttcaagggcccccaggactgaagggcgtgcagggagagccagggcctccaggaaggggagtccagggaccccagggggagcctggagccccgggtttgcctggcattcagggacttccgggacctcggggaccacctggccccactggagagaagggtgcccagggatctccaggggtgaaaggagccaccggacctgtgggacctcctggggccagtgtctctgggcctccgggccgtgatgggcagcaaggacagacgggactcagaggaacaccaggtgaaaaaggaccacgaggagagaagggtgagccaggggagtgctcctgcccctctcaaggagacctcatcttctctggcatgccgggtccaccaggtattcccggaccaccaggcccccctggagtacctgggctgcaggtaaagggggagaagagaatgaggagcttgggtggcagagctcatgggtcaggatggctgctcccggctggaccccaaggatgctgctcccccaccccaaaaacacagacatgccatttctcactcctctgtttacctgcctcccagggtggcaaggagggcccactgagcctctag

SEQ ID NO: 8597 - DNA, 782 bp, synthetic construct
  misc_feature 1..782: note = Synthetic polypeptide
  source 1..782: mol_type = other DNA
gcatgaaaactccctggggtgcttataaaagaataagactcttgggccccacccttggagttttgattcagctatttatagcaggttacctgggtgattctggtccacagccagcctacatgaagaagaaccatgaagaggagatgaaggaatttagcaaccaggtggtcggccaggtcaacgtggagatggatgccaccccaggcattgacctgacccgcgtgctggcagagatgagggagcagtacgaggccatggcagagaggaaccgccgggatgctgaggaatggttccacaccaagagtgcagagctgaacaaggaggtgtctaccaacactgccatgattcagaccagcaagacagagatcacggagctcaggcgcacgctccaaggcctggagattgagctgcagtcccagctgagcatgaaagcggggctggagaacacggtggcagagacggagtgccgctatgccctgcagctgcagcagatccagggactcatcagcagcatcgaggcccagctgagcgagctccgcagtgagatggagtgccagaaccaagagtacaagatgctgctggacatcaagacacgtctggagcaggagatcgccacctaccgcagcctgctcgagggccaggacgccaagatgattggtttcccttcctcagcaggaagcgtcagcccccgtagcacctctgttaccacgacttctagtgcctctgttaccaccacctctaatgcctctggtcgccgcacttctgatgtccgtaggccttaa

SEQ ID NO: 8598 - DNA, 668 bp, synthetic construct
  misc_feature 1..668: note = Synthetic polypeptide
  source 1..668: mol_type = other DNA
gcatgaaaactccctggggtgcttataaaagaataagactcttgggccccacccttggagttttgattcagctatttatagcaggttacctgggtgattctggtccacagccagcctacatgaagaagaaccatgaagaggagatgaaggaatttagcaaccaggtggtcggccaggtcaacgtggagatggatgccaccccaggcattgacctgacccgcgtgctggcagagatgagggagcagtacgaggccatggcagagaggaaccgccgggatgctgaggaatggttccacaccaagagtgcagagctgaacaaggaggtgtctaccaacactgccatgattcagaccagcaagacagagatcacggagctcaggcgcacgctccaaggcctggagattgagctgcagtcccagctgagcatgaaagcggggctggagaacacggtggcagagacggagtgccgctatgccctgcagctgcagcagatccagggactcatcagcagcatcgaggcccagctgagcgagctccgcagtgagatggagtgccagaaccaagagtacaagatgctgctggacatcaagacacgtctggagcaggagatcgccacctaccgcagcctgctcgagggccaggacgccaagaagcgtcagcccccgtag

SEQ ID NO: 8599 - DNA, 653 bp, synthetic construct
  misc_feature 1..653: note = Synthetic polypeptide
  source 1..653: mol_type = other DNA
gcatgaaaactccctggggtgcttataaaagaataagactcttgggccccacccttggagttttgattcagctatttatagcaggttacctgggtgattctggtccacagccagcctacatgaagaagaaccatgaagaggagatgaaggaatttagcaaccaggtggtcggccaggtcaacgtggagatggatgccaccccaggcattgacctgacccgcgtgctggcagagatgagggagcagtacgaggccatggcagagaggaaccgccgggatgctgaggaatggttccacaccaagagtgcagagctgaacaaggaggtgtctaccaacactgccatgattcagaccagcaagacagagatcacggagctcaggcgcacgctccaaggcctggagattgagctgcagtcccagctgagcatgaaagcggggctggagaacacggtggcagagacggagtgccgctatgccctgcagctgcagcagatccagggactcatcagcagcatcgaggcccagctgagcgagctccgcagtgagatggagtgccagaaccaagagtacaagatgctgctggacatcaagacacgtctggagcaggagatcgccacctaccgcagcctgctcgagggccaggacgccaagtag

SEQ ID NO: 8600 - DNA, 221 bp, synthetic construct
  misc_feature 1..221: note = Synthetic polypeptide
  source 1..221: mol_type = other DNA
gcatgaaaactccctggggtgcttataaaagaataagactcttgggccccacccttggagttttgattcagctatttatagcaggttacctgggtgattctggtccacagccagcctacatgaagaagaaccatgaagaggagatgaaggaatttagcaaccaggtggtcggccaggtcaacgtggagatggatgccaccccaggcattgacctgacccgc

SEQ ID NO: 8601 - DNA, 170 bp, synthetic construct
  misc_feature 1..170: note = Synthetic polypeptide
  source 1..170: mol_type = other DNA
gcatgaaaactccctggggtgcttataaaagaataagactcttgggccccacccttggagttttgattcagctatttatagcaggttacctgggtgattctggtccacagccagcctacatgaagaagaaccatgaagaggagatgaaggaatttagcaaccaggtggtc

SEQ ID NO: 8602 - DNA, 1257 bp, synthetic construct
  misc_feature 1..1257: note = Synthetic polypeptide
  source 1..1257: mol_type = other DNA
ccccctcccccctcccccctcccccctctcccctctcccctctcccctctccccggtctccctctgatgccaagccgaagctggactgtactgctgccatctcggctcactgcaacctccctgcctgattctcctgcctaagcctgccgagtgcctgcaattgcaggtgcgcgctgccacgcctgactggttttcgtattttttgggtggagacggggtttcgctgtgttggcagggctggtctccagctcctaaccgcgagtgatccgccagcctcggcctcccgaggtgccgggattgcagacggagtctccttcactcagtgctcaatggtgccgaggctggagtgcagtggcgtgatctcagctcgctacaacatccacctcccagcagcctgccttggcctcctaaagagccgagattgcagcctctgcccggccgccaccccgtctgggaagtgaggagcgtctctgcctggccgcccatcgtctgggatgtgaggagcccctctgcctggctgctcagtctggaaagtgaggagtgtctctgcccagccgccatcccatctaggaagtgaggagcgcctcttcccagccgccatcccatctaggaagtgaggagcgtctctgcccggccgccccgtctgagaagtgaggagaccctctgcctggcaaccgccctgtctgagaagtgaggagcccctccgcccagcagccgccccgtctgagaagtgaggagcctccgcccggcagccaccccgtctgggaagtacccattcctggcccagtgggtaacaagagaatggttcatttttccccggattctcatcaccatgaccattggtttagccctggggctaggacagagcatgaccagcatcagcttctgagagataatcgagctgaaagaggacacaagaaaaattgttctgtgagaacagccagcaggcaaacaagcatgcatttaggatccttatgcacgggagatatcaaacggagaagaaaagctgcacctttgcctggacctactactgcaggatttgtaggtgaaaatgcccagccaatcctagaaaataatattggaaaccgaatgcttcagaatatgggctggacgcctgggtcaggccttggacgagatggcaaggggatctctgagccaattcaagccatgcagaggccaaagggattaggacttggatttcctctaccaaaaagtacttccgcaactactacccccaatgcaggaaaatccgcctaa

SEQ ID NO: 8603 - DNA, 2502 bp, synthetic construct
  misc_feature 1..2502: note = Synthetic polypeptide
  source 1..2502: mol_type = other DNA
ggccgggcgtggtagtttacgcctataatcccagcactttgggaggctgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggccgaggctaccagggggacccgtcgtcggcactgctggagctgctggacccagagcagaatgccaacttcctggaccactacctggacgtgcccgtggacttgtccaaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtga

SEQ ID NO: 8604 - DNA, 441 bp, synthetic construct
  misc_feature 1..441: note = Synthetic polypeptide
  source 1..441: mol_type = other DNA
ggccgggcgtggtagtttacgcctataatcccagcactttgggaggctgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagggaggcctcagccgggtccagctcccagcctcagcggctgattcacacctgccttgctcccgtgtcagagtccatatcagcagacagctggaggtggagcccgaggagccggaggcggagaacaagcacaagccccgcaggaagtcaaagcggggcaagaaggaggcggaggacgagctga

SEQ ID NO: 8605 - DNA, 2454 bp, synthetic construct
  misc_feature 1..2454: note = Synthetic polypeptide
  source 1..2454: mol_type = other DNA
ggccgggcgtggtagtttacgcctataatcccagcactttgggaggctgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggccgaggctaccagggggacccgtcgtcggcactgctggagctgctggacccagagcagaatgccaacttcctggaccactacctggacgtgcccgtggacttgtccaaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtga

SEQ ID NO: 8606 - DNA, 961 bp, synthetic construct; identical to SEQ ID NO: 6722
  misc_feature 1..961: note = Synthetic polypeptide
  source 1..961: mol_type = other DNA

SEQ ID NO: 8607 - DNA, 1508 bp, synthetic construct
  misc_feature 1..1508: note = Synthetic polypeptide
  source 1..1508: mol_type = other DNA
gtgggaccttgggcaagtcagttttaagtgtgaccttggagatacctcatcatatcacacaaagagatgcagatagatctttgagcatacctgatgaacagttacactcatttgcggtttccaccgtgcacattatgaagaaaagaaatggaggtgggagtttaaataactattcctcctccattccaccgactcccagcaccagccaggaggaccctcagttcagtgttcctcccactgccaacacacccacccccgtttgcaagctgtccatgcgctggtccaacctgtttacatctgagaaagggagtgacccagacaaagagaggaaagccccggagaatcatgctgacaccatcgggagcggcagagccatccccattaaacagggcatgctcttaaagcgaagtggaaaatggctgaagacatggaaaaagaaatacgtcaccctgtgttccaatggcgtgctcacctattattcaagcttaggtgattatatgaagaatattcataaaaaagagattgaccttcggacatctaccatcaaagtcccaggaaagtggccatccctagccacatcagcctgtgcacccatctccagctctaaaagcaatggcctatccaaggacatggacaccgggctgggtgactccatatgcttcagccccggtatctccagcaccaccagccccaagctcaacccgcccccctctcctcatgccaataaaaagaaacacctaaagaagaaaagcaccaacaactttatgattgtgtctgccactggccaaacgtggcactttgaagccacgacgtatgaggagcgggatgcctgggtccaagccatccagagccagatcctggccagcctgcagtcatgcaagagcagtaaaagcaagtcccagctgaccagccagagtgaggccatggccctgcagtcgatccaaaacatgcgtgggaacgcccactgtgtggactgtgagacccagaatcctaagtgggccagtttgaacttgggagtcctcatgtgtattgaatgctcaggtatccaccgcagttttggcacccgcctttcccgtgtgcgatctctggagctggatgactggccagttgagctcaggaaggttatgtcatctattggcaatgagctagccaacagcatctgggaagggagcagccaggggcagacaaaaccctcaataaagtccacgagggaagagaaggaatggtggatccgttccaaatatgaggagaagctctttctggccccactaccctgcactgagctgtccctgggccagcagctgctgcgggccaccactgatgaggacctgcagacagccatcctgctgctggcacatggctcccgtgaggaggtgaacgagacctgtggggagggagacggctgcacggcactccatctggcctgccgcaaggggaatgtggtcctggagcagctcctgacggggtggacgtcatggcccgagatgcccacgggaacacagcgctga

SEQ ID NO: 8608 - DNA, 1456 bp, synthetic construct
  misc_feature 1..1456: note = Synthetic polypeptide
  source 1..1456: mol_type = other DNA
gtgggaccttgggcaagtcagttttaagtgtgaccttggagatacctcatcatatcacacaaaggtttccaccgtgcacattatgaagaaaagaaatggaggtgggagtttaaataactattcctcctccattccaccgactcccagcaccagccaggaggaccctcagttcagtgttcctcccactgccaacacacccacccccgtttgcaagctgtccatgcgctggtccaacctgtttacatctgagaaagggagtgacccagacaaagagaggaaagccccggagaatcatgctgacaccatcgggagcggcagagccatccccattaaacagggcatgctcttaaagcgaagtggaaaatggctgaagacatggaaaaagaaatacgtcaccctgtgttccaatggcgtgctcacctattattcaagcttaggtgattatatgaagaatattcataaaaaagagattgaccttcggacatctaccatcaaagtcccaggaaagtggccatccctagccacatcagcctgtgcacccatctccagctctaaaagcaatggcctatccaaggacatggacaccgggctgggtgactccatatgcttcagccccggtatctccagcaccaccagccccaagctcaacccgcccccctctcctcatgccaataaaaagaaacacctaaagaagaaaagcaccaacaactttatgattgtgtctgccactggccaaacgtggcactttgaagccacgacgtatgaggagcgggatgcctgggtccaagccatccagagccagatcctggccagcctgcagtcatgcaagagcagtaaaagcaagtcccagctgaccagccagagtgaggccatggccctgcagtcgatccaaaacatgcgtgggaacgcccactgtgtggactgtgagacccagaatcctaagtgggccagtttgaacttgggagtcctcatgtgtattgaatgctcaggtatccaccgcagttttggcacccgcctttcccgtgtgcgatctctggagctggatgactggccagttgagctcaggaaggttatgtcatctattggcaatgagctagccaacagcatctgggaagggagcagccaggggcagacaaaaccctcaataaagtccacgagggaagagaaggaatggtggatccgttccaaatatgaggagaagctctttctggccccactaccctgcactgagctgtccctgggccagcagctgctgcgggccaccactgatgaggacctgcagacagccatcctgctgctggcacatggctcccgtgaggaggtgaacgagacctgtggggagggagacggctgcacggcactccatctggcctgccgcaaggggaatgtggtcctggagcagctcctgacggggtggacgtcatggcccgagatgcccacgggaacacagcgctga

SEQ ID NO: 8609 - DNA, 1448 bp, synthetic construct
  misc_feature 1..1448: note = Synthetic polypeptide
  source 1..1448: mol_type = other DNA
gtgggaccttgggcaagtcagttttaagtgtgaccttggagatacctcatcatatcacacaaagagatgcagatagatctttgagcatacctgatgaacagttacactcatttgcggtttccaccgtgcacattatgaagaaaagaaatggaggtgggagtttaaataactattcctcctccattccaccgactcccagcaccagccaggaggaccctcagttcagtgttcctcccactgccaacacacccacccccgtttgcaagctgtccatgcgctggtccaacctgtttacatctgagaaagggagtgacccagacaaagagaggaaagccccggagaatcatgctgacaccatcgggagcggcagagccatccccattaaacagggcatgctcttaaagcgaagtggaaaatggctgaagacatggaaaaagaaatacgtcaccctgtgttccaatggcgtgctcacctattattcaagcttaggtgattatatgaagaatattcataaaaaagagattgaccttcggacatctaccatcaaagtcccaggaaagtggccatccctagccacatcagcctgtgcacccatctccagctctaaaagcaatggcctatccaaggacatggacaccgggctgggtgactccatatgcttcagccccggtatctccagcaccaccagccccaagctcaacccgcccccctctcctcatgccaataaaaagaaacacctaaagaagaaaagcaccaacaactttatgattgtgtctgccactggccaaacgtggcactttgaagccacgacgtatgaggagcgggatgcctgggtccaagccatccagagccagagtgaggccatggccctgcagtcgatccaaaacatgcgtgggaacgcccactgtgtggactgtgagacccagaatcctaagtgggccagtttgaacttgggagtcctcatgtgtattgaatgctcaggtatccaccgcagttttggcacccgcctttcccgtgtgcgatctctggagctggatgactggccagttgagctcaggaaggttatgtcatctattggcaatgagctagccaacagcatctgggaagggagcagccaggggcagacaaaaccctcaataaagtccacgagggaagagaaggaatggtggatccgttccaaatatgaggagaagctctttctggccccactaccctgcactgagctgtccctgggccagcagctgctgcgggccaccactgatgaggacctgcagacagccatcctgctgctggcacatggctcccgtgaggaggtgaacgagacctgtggggagggagacggctgcacggcactccatctggcctgccgcaaggggaatgtggtcctggagcagctcctgacggggtggacgtcatggcccgagatgcccacgggaacacagcgctga

SEQ ID NO: 8610 - DNA, 3692 bp, synthetic construct
  misc_feature 1..3692: note = Synthetic polypeptide
  source 1..3692: mol_type = other DNA
gggatgatggagggagctcctgcacggcacagaaggaggagaacatcgagctggcgtttgacgacttggaacccccgacggatgactctgtggctgctgtggaccaggcctcccatcagtccctggtccgctcgctggcccgcacagacgaggcgaggggcctgctctggctattggaagaggaggctctggtgccaggggccagtgaggacaccctcctggagcgccttttctcctattatggcccccaggaaggtgacaaaaaaggccaaagcccccttctgcacagcagcaaaccacaccactttctcctgggccacagccatggcaccaactgggtagagtacaatgtgactggctggctgaactacaccaagcagaacccagccacccagaatgccccccggctcctgcaggactcccagaaaaaaatcatcagcaacctgtttctgggccgcgcaggcagtgccacggtgctctctggctccatcgcgggcctggagggcggctcgcagctggcactgcgccgggccaccagcatgcggaaaacctttaccacaggcatggcggctgtcaaaaagaagtcactgtgcatccagatgaagctacaggtggacgccctcatcgacaccatcaagaagtcaaagctgcattttgtgcactgcttcctgcctgtagctgagggctgggctggggagccccgttccgcctcctcccgccgagtcagcagcagcagtgagctggacctgccctcgggagaccactgcgaggctgggctcctgcagctcgacgtgcccctgctccgcacccagctccgcggctcccgcctgctcgatgccatgcgcatgtaccgccaaggttaccctgaccacatggtgttttccgagttccgccgccgctttgatgtcctggccccgcacctgaccaagaaacacgggcgtaactacatcgtggtggatgaaaggcgggcagtggaggagctgctggagtgcttggatctggagaagagcagctgctgcatgggcctgagccgggtgttcttccgggcgggcaccttggcacggctggaggagcagcgggatgaacaaaccagcaggaacctaaccctgttccaagcagcctgcaggggctacctggcccgccagcacttcaagaagagaaagatccaggacctggccattcgctgtgtacagaagaacatcaagaagaacaaaggggtgaaggactggccctggtggaagctttttaccacagtgaggcccctcatcgaagtacagctgtcagaggagcagatccggaacaaagacgaggagatccagcagctgcggagcaagctcgagaaggcggagaaggagaggaacgagctgcggctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcagatggaggttatggaaatggaggtgatggaggcccgtctcatccgggcagcggagatcaacggggaagtggatgatgatgatgcaggtggcgagtggcggctgaagtatgagcgggctgtgcgggaggtggacttcaccaagaaacggctccagcaggagtttgaggacaagctggaggtggagcagcagaacaagaggcagctggaacggcggctcggggacctgcaggcagatagtgaggagagtcagcgggctctgcagcagctcaagaagaagtgccagcgactgacggctgagctgcaagacaccaagctgcacctggagggccagcaggtccgcaaccacgaactggagaagaagcagaggaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacaggccaagctgcgtctggagatggagatggagcggatgagacagacccattctaaggagatggagagtcgggatgaggaggtggaggaggcccggcagtcgtgtcagaagaagttaaaacagatggaggtgcagctagaggaagagtatgaggacaagcagaaggttctgcgagagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccagctggaggagtcagagttcacctgtgcggcagccgtgaaagcacggaaagcaatggaggtggagatcgaagacctgcacctgcagattgatgacatcgccaaagccaagacagcgctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtttgcaggacatggtgacaaagtatcagaaaagaaagaataaacttgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatag

SEQ ID NO: 8611 - DNA, 3536 bp, synthetic construct
  misc_feature 1..3536: note = Synthetic polypeptide
  source 1..3536: mol_type = other DNA
gggatgatggagggagctcctgcacggcacagaaggaggagaacatcgagctggcgtttgacgacttggaacccccgacggatgactctgtggctgctgtggaccaggcctcccatcagtccctggtccgctcgctggcccgcacagacgaggcgaggggcctgctctggctattggaagaggaggctctggtgccaggggccagtgaggacaccctcctggagcgccttttctcctattatggcccccaggaaggtgacaaaaaaggccaaagcccccttctgcacagcagcaaaccacaccactttctcctgggccacagccatggcaccaactgggtagagtacaatgtgactggctggctgaactacaccaagcagaacccagccacccagaatgccccccggctcctgcaggactcccagaaaaaaatcatcagcaacctgtttctgggccgcgcaggcagtgccacggtgctctctggctccatcgcgggcctggagggcggctcgcagctggcactgcgccgggccaccagcatgcggaaaacctttaccacaggcatggcggctgtcaaaaagaagtcactgtgcatccagatgaagctacaggtggacgccctcatcgacaccatcaagaagtcaaagctgcattttgtgcactgcttcctgcctgtagctgagggctgggctggggagccccgttccgcctcctcccgccgagtcagcagcagcagtgagctggacctgccctcgggagaccactgcgaggctgggctcctgcagctcgacgtgcccctgctccgcacccagctccgcggctcccgcctgctcgatgccatgcgcatgtaccgccaaggttaccctgaccacatggtgttttccgagttccgccgccgctttgatgtcctggccccgcacctgaccaagaaacacgggcgtaactacatcgtggtggatgaaaggcgggcagtggaggagctgctggagtgcttggatctggagaagagcagctgctgcatgggcctgagccgggtgttcttccgggcgggcaccttggcacggctggaggagcagcgggatgaacaaaccagcaggaacctaaccctgttccaagcagcctgcaggggctacctggcccgccagcacttcaagaagagaaagatccaggacctggccattcgctgtgtacagaagaacatcaagaagaacaaaggggtgaaggactggccctggtggaagctttttaccacagtgaggcccctcatcgaagtacagctgtcagaggagcagatccggaacaaagacgaggagatccagcagctgcggagcaagctcgagaaggcggagaaggagaggaacgagctgcggctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcagatggaggttatggaaatggaggtgatggaggcccgtctcatccgggcagcggagatcaacggggaagtggatgatgatgatgcaggtggcgagtggcggctgaagtatgagcgggctgtgcgggaggtggacttcaccaagaaacggctccagcaggagtttgaggacaagctggaggtggagcagcagaacaagaggcagctggaacggcggctcggggacctgcaggcagatagtgaggagagtcagcgggctctgcagcagctcaagaagaagtgccagcgactgacggctgagctgcaagacaccaagctgcacctggagggccagcaggtccgcaaccacgaactggagaagaagcagaggaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacagttaaaacagatggaggtgcagctagaggaagagtatgaggacaagcagaaggttctgcgagagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccagctggaggagtcagagttcacctgtgcggcagccgtgaaagcacggaaagcaatggaggtggagatcgaagacctgcacctgcagattgatgacatcgccaaagccaagacagcgctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatag

SEQ ID NO: 8612 - DNA, 3647 bp, synthetic construct
  misc_feature 1..3647: note = Synthetic polypeptide
  source 1..3647: mol_type = other DNA
gggatgatggagggagctcctgcacggcacagaaggaggagaacatcgagctggcgtttgacgacttggaacccccgacggatgactctgtggctgctgtggaccaggcctcccatcagtccctggtccgctcgctggcccgcacagacgaggcgaggggcctgctctggctattggaagaggaggctctggtgccaggggccagtgaggacaccctcctggagcgccttttctcctattatggcccccaggaaggtgacaaaaaaggccaaagcccccttctgcacagcagcaaaccacaccactttctcctgggccacagccatggcaccaactgggtagagtacaatgtgactggctggctgaactacaccaagcagaacccagccacccagaatgccccccggctcctgcaggactcccagaaaaaaatcatcagcaacctgtttctgggccgcgcaggcagtgccacggtgctctctggctccatcgcgggcctggagggcggctcgcagctggcactgcgccgggccaccagcatgcggaaaacctttaccacaggcatggcggctgtcaaaaagaagtcactgtgcatccagatgaagctacaggtggacgccctcatcgacaccatcaagaagtcaaagctgcattttgtgcactgcttcctgcctgtagctgagggctgggctggggagccccgttccgcctcctcccgccgagtcagcagcagcagtgagctggacctgccctcgggagaccactgcgaggctgggctcctgcagctcgacgtgcccctgctccgcacccagctccgcggctcccgcctgctcgatgccatgcgcatgtaccgccaaggttaccctgaccacatggtgttttccgagttccgccgccgctttgatgtcctggccccgcacctgaccaagaaacacgggcgtaactacatcgtggtggatgaaaggcgggcagtggaggagctgctggagtgcttggatctggagaagagcagctgctgcatgggcctgagccgggtgttcttccgggcgggcaccttggcacggctggaggagcagcgggatgaacaaaccagcaggaacctaaccctgttccaagcagcctgcaggggctacctggcccgccagcacttcaagaagagaaagatccaggacctggccattcgctgtgtacagaagaacatcaagaagaacaaaggggtgaaggactggccctggtggaagctttttaccacagtgaggcccctcatcgaagtacagctgtcagaggagcagatccggaacaaagacgaggagatccagcagctgcggagcaagctcgagaaggcggagaaggagaggaacgagctgcggctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcagatggaggttatggaaatggaggtgatggaggcccgtctcatccgggcagcggagatcaacggggaagtggatgatgatgatgcaggtggcgagtggcggctgaagtatgagcgggctgtgcgggaggtggacttcaccaagaaacggctccagcaggagtttgaggacaagctggaggtggagcagcagaacaagaggcagctggaacggcggctcggggacctgcaggcagatagtgaggagagtcagcgggctctgcagcagctcaagaagaagtgccagcgactgacggctgagctgcaagacaccaagctgcacctggagggccagcaggtccgcaaccacgaactggagaagaagcagaggaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacaggccaagctgcgtctggagatggagatggagcggatgagacagacccattctaaggagatggagagtcgggatgaggaggtggaggaggcccggcagtcgtgtcagaagaagttaaaacagatggaggtgcagctagaggaagagtatgaggacaagcagaaggttctgcgagagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccagctggaggagtcagagttcacctgtgcggcagccgtgaaagcacggaaagcaatggaggtggagatcgaagacctgcacctgcagattgatgacatcgccaaagccaagacagcgctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatag

SEQ ID NO: 8613 - DNA, 809 bp, synthetic construct
  misc_feature 1..809: note = Synthetic polypeptide
  source 1..809: mol_type = other DNA
cctggttctctggggcacgaggcttctcctcagcactctggcgcccccaacaggttcccagtgttcggctgggacaggcacgctgtggctggctacttcccttccttccatcccccttgggccaaacaggatcggtgcttctggtgagacgtctccccatgcacatcactcccagatgccctagggggcacatttcccacaactcccagagggcaggtttctagaaagtgccaccagtggggaggcgccacaacttcactgccattttgtgaggtgccgccgtctctcctccagcaagggaatgtgacagtccttcgtatcagaaaaggcagaggatggccctgttggcaaggaaacaaggagcaggagacagccttattgcaggctctgccatgtccaaagcaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 8614 - DNA, 971 bp, synthetic construct
  misc_feature 1..971: note = Synthetic polypeptide
  source 1..971: mol_type = other DNA
ttgcctgtcagctccaaattcacccttttatcccgctgtgtgagaaggttctgtgttcctctgcctctgcccgctgtgcagttgatagtgaaggccacctgtagagagcaccagagtcagctaaggggagagctgcgcttcctggttctcccgctggcgccagcggtcctgctgagcgcaaaacttctcttccggactctggcgccccacacaggttcccagtgttaggctgggggagggcacgcgaaagcggtcagcttcccttccttccatccgccttgagcctttccggattggtgcttctggtgagacgcctccccatgagcatcactcccaagcacgcgagggggcacgtttcccataactcccaaacggcaagtttctacaaagttacaacagtggggaggcgccacaacttcactgccattttgtgaggtgctgccgcccctcctccggcaagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 8615 - DNA, 971 bp, synthetic construct
  misc_feature 1..971: note = Synthetic polypeptide
  source 1..971: mol_type = other DNA
ttgcctgtcagctccaaattcacccttttatcccgctgtgtgagaaggttctgtgttcctctgcctctgcccgctgtgcagttgatagtgaaggccacctgtagagagcaccagagtcagctaaggggagagctgcgcttcctggttctcccgctggcgccagcggtcctgctgagcgcaaaacttctcttccggactctggcgccccacacaggttcccagtgttaggctgggggagggcacgcgaaagcggtcagcttcccttccttccatccgccttgagcctttccggattggtgcttctggtgagacgcctccccatgagcatcactcccaagcacgcgagggggcacgtttcccataactcccaaacggcaagtttctacaaagttacaacagtggggaggcgccacaacttcactgccattttgtgaggtgctgccgcccctcctccggcaagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagatgggatgatgcagaaacctggtagcaatgcacctgtgggaggaaatgttaccagcaatttctctggagatgacctagaatgcagaggaatagcctcctctcccaaaagccaacaagaaattaatgctgatataaaatgtcaagtagtgaaggaaatccgatgccttggacgaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 8616 - DNA, 628 bp, synthetic construct
  misc_feature 1..628: note = Synthetic polypeptide
  source 1..628: mol_type = other DNA
gggcgcggtgactcatgcctgtaatcccagcactttgggaggccaaggtacttccgaagatcccagtttacagcgatcagtttcggttgcaacgggactgaacatgatgaagaagcagaaagtgaagaccatcttcccgcacactgcgggctccaacaagaccttactcagctttgcacagggagatgtcatcacgctgctcatccccgaggagaaggatggctggctctatggagaacacgacgtgtccaaggcgaggggttggttcccgtcgtcgtacacgaagttgctggaagaaaatgagacagaagcagtgaccgtgcccacgccaagccccacaccagtgagaagcatcagcaccgtgaacttgtctgagaatagcagtgttgtcatccccccacccgactacttggaatgcttgtccatgggggcagctgccgacaggagagcagattcggccaggacgacatccacctttaaggccccagcgtccaagcccgagaccgcggctcctaacgatgccaacgggactgcaaagccgccttttctcagcggagaaaacccctttgccactgtgaaactccgcccgactgtgacgaatgatcgctcggcacccatcattcgatga

SEQ ID NO: 8617 - DNA, 971 bp, synthetic construct
  misc_feature 1..971: note = Synthetic polypeptide
  source 1..971: mol_type = other DNA
ttgcctgtcagctccaaattcacccttttatcccgctgtgtgagaaggttctgtgttcctctgcctctgcccgctgtgcagttgatagtgaaggccacctgtagagagcaccagagtcagctaaggggagagctgcgcttcctggttctcccgctggcgccagcggtcctgctgagcgcaaaacttctcttccggactctggcgccccacacaggttcccagtgttaggctgggggagggcacgcgaaagcggtcagcttcccttccttccatccgccttgagcctttccggattggtgcttctggtgagacgcctccccatgagcatcactcccaagcacgcgagggggcacgtttcccataactcccaaacggcaagtttctacaaagttacaacagtggggaggcgccacaacttcactgccattttgtgaggtgctgccgcccctcctccggcaagggaatgtgacagtccttcgtatcagaaaaggcagaggatggccctgttggcaaggaaacaaggagcaggagacagccttattgcaggctctgccatgtccaaagcaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 8618 - DNA, 1418 bp, synthetic construct
  misc_feature 1..1418: note = Synthetic polypeptide
  source 1..1418: mol_type = other DNA
ggccgggcactgtggctgacgcctgtaatcctagcactttgagaggccgaggcggcggatcacgaggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcatagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctaccctcctgaagtgtccatctccggctatgatgacaactggtacctcggccgtactgatgccaccctgagctgtgacgtccgcagcaacccagagcccacgggctatgactggagcacgacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgagaaacccccagggcctcgccccgagatgtgggcccgctggtgtggggggccgtgggggggacactgctggtgctgctgcttctggctggggggtccttggccttcatcctgctgagggtgaggaggaggaggaagagccctggaggagcaggaggaggagccagtggcgacgggggattctacgatccgaaagctcaggtgttgggaaatggggaccccgtcttctggacaccagtagtccctggtcccatggaaccagatggcaaggatgaggaggaggaggaggaggaagagaaggcagagaaaggcctcatgttgcctccacccccagcactcgaggatgacatggagtcccagctggacggctccctcatctcacggcgggcagtttatgtgtga

SEQ ID NO: 8619 - DNA, 1595 bp, synthetic construct
  misc_feature 1..1595: note = Synthetic polypeptide
  source 1..1595: mol_type = other DNA
ggccgggcactgtggctgacgcctgtaatcctagcactttgagaggccgaggcggcggatcacgaggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcatagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctaccctcctgaagtgtccatctccggctatgatgacaactggtacctcggccgtactgatgccaccctgagctgtgacgtccgcagcaacccagagcccacgggctatgactggagcacgacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgagagacccccaacacagcaggcgcaggggccacaggcggcatcatcgggggcatcatcgccgccatcattgctactgctgtggctgccacgggcatccttatctgccggcagcagcggaaggagcagacgctgcagggggcagaggaggacgaagacctggagggacctccctcctacaagccaccaaccccaaaagcgaagctggaggcacaggagatgccctcccagctcttcactctgggggcctcggagcacagcccactcaagaccccctactttgatgctggcgcctcatgcactgagcaggaaatgcctcgataccatgagctgcccaccttggaagaacggtcaggacccttgcaccctggagccacaagcctggggtcccccatcccggtgcctccagggccacctgctgtggaagacgtttccctggatctagaggatgaggagggggaggaggaggaagagtatctggacaagatcaaccccatctatgatgctctgtcctatagcagcccctctgattcctaccagggcaaaggctttgtcatgtcccgggccatgtatgtgtga

SEQ ID NO: 8620 - DNA, 771 bp, synthetic construct
  misc_feature 1..771: note = Synthetic polypeptide
  source 1..771: mol_type = other DNA
ctagatcctaagctctttgcaggggaatcttcctttgtttggttcgcagataaatcccaagcccgtagaacttcatcttgcacatggaaccagctgtctcctgaagaggaggagaagcgtcgcatccggcgggagaggaacaagctggctgcagccaagtgccggaaccgacgccgggagctgacagagaagctgcaggcgattggtccctggcaggttgctgtccctcacatccctctctttccgtggcaggagacagaggagctggaggaggagaagtcaggcctgcagaaggagattgctgagctgcagaaggagaaggagaagctggagttcatgttggtggctcacggcccagtgtgcaagattagccccgaggagcgccgatcgcccccagcccctgggctgcagcccatgcgcagtgggggtggctcggtgggcgctgtagtggtgaaacaggagcccctggaagaggacagcccctcgtcctcgtcggcggggctggacaaggcccagcgctctgtcatcaagcccatcagcattgctgggggcttctacggtgaggagcccctgcacacccccatcgtggtgacctccacacctgctgtcactccgggcacctcgaacctcgtcttcacctatcctagcgtcctggagcaggagtcacccgcatctccctccgaatcctgctccaaggctcaccgcagaagcagtagcagcggggaccaatcatcagactccttgaactcccccactctgctggctctgtaa

SEQ ID NO: 8621 - DNA, 720 bp, synthetic construct
  misc_feature 1..720: note = Synthetic polypeptide
  source 1..720: mol_type = other DNA
ctagatcctaagctctttgcaggggaatcttcctttgtttggttcgcagataaatcccaagcccgtagaacttcatcttgcacatggaaccagctgtctcctgaagaggaggagaagcgtcgcatccggcgggagaggaacaagctggctgcagccaagtgccggaaccgacgccgggagctgacagagaagctgcaggcggagacagaggagctggaggaggagaagtcaggcctgcagaaggagattgctgagctgcagaaggagaaggagaagctggagttcatgttggtggctcacggcccagtgtgcaagattagccccgaggagcgccgatcgcccccagcccctgggctgcagcccatgcgcagtgggggtggctcggtgggcgctgtagtggtgaaacaggagcccctggaagaggacagcccctcgtcctcgtcggcggggctggacaaggcccagcgctctgtcatcaagcccatcagcattgctgggggcttctacggtgaggagcccctgcacacccccatcgtggtgacctccacacctgctgtcactccgggcacctcgaacctcgtcttcacctatcctagcgtcctggagcaggagtcacccgcatctccctccgaatcctgctccaaggctcaccgcagaagcagtagcagcggggaccaatcatcagactccttgaactcccccactctgctggctctgtaa

SEQ ID NO: 8622 - DNA, 464 bp, synthetic construct
  misc_feature 1..464: note = Synthetic polypeptide
  source 1..464: mol_type = other DNA
ctagatcctaagctctttgcaggggaatcttcctttgtttggttcgcagataaatcccaagcccgtagaacttcatcttgcacatggaaccagctgtctcctgaagaggaggagaagcgtcgcatccggcgggagaggaacaagctggctgcagccaagtgccggaaccgacgccgggagctgacagagaagctgcaggcggagacagaggagctggaggaggagaagtcaggcctgcagaaggagattgctgagctgcagaaggagaaggagaagctggagttcatgttggtggctcacggcccagtgtgcaagattagccccgaggagcgccgatcgcccccagcccctgggctgcagcccatgcgcagtgggggtggctcggtgggcgctgtagtggtgaaacaggagcccctggaagaggacagcccctcgtcctcgtcggcggggctggacaaggccca

SEQ ID NO: 8623 - DNA, 1056 bp, synthetic construct
  misc_feature 1..1056: note = Synthetic polypeptide
  source 1..1056: mol_type = other DNA
ctggagtctcttaaaaagttaaaaatgtaccatatgccattctactcccaaatatttatccaagagaaatgaaaacatatgtctacacaaagatttacactccagtgttcatgagtgctatattcataatggcacaaaaaaaataaaacccagactggaatcaattaaaatacccatcagcagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaaggtgacactcagtccaattaa

SEQ ID NO: 8624 - DNA, 1227 bp, synthetic construct
  misc_feature 1..1227: note = Synthetic polypeptide
  source 1..1227: mol_type = other DNA
ctggagtctcttaaaaagttaaaaatgtaccatatgccattctactcccaaatatttatccaagagaaatgaaaacatatgtctacacaaagatttacactccagtgttcatgagtgctatattcataatggcacaaaaaaaataaaacccagactggaatcaattaaaatacccatcagcagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaagtgcagcgtaagtatgcacagatgaagatggaactaagccgagtaagaagacatacaaaagcctcttctgaaggaaaagacagtgtagtcctgcaaaacattttgaggtacattgttttgtctcagctattttgtagcagactcgtgcccccattagtgtgcctctttggaaattatcgcccacatttgtaa

SEQ ID NO: 8625 - DNA, 1056 bp, synthetic construct
  misc_feature 1..1056: note = Synthetic polypeptide
  source 1..1056: mol_type = other DNA
ctggagtctcttaaaaagttaaaaatgtaccatatgccattctactcccaaatatttatccaagagaaatgaaaacatatgtctacacaaagatttacactccagtgttcatgagtgctatattcataatggcacaaaaaaaataaaacccagactggaatcaattaaaatacccatcagcagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaagggctttttgttactgtttga

SEQ ID NO: 8626 - DNA, 891 bp, synthetic construct
  misc_feature 1..891: note = Synthetic polypeptide
  source 1..891: mol_type = other DNA
ggccagtctcctcttggcaaagtgaaagaagcagtgaaggtggccattgatgcaggatatcggcacattgactgtgcctatgtctatcagaatgaacatgaagtgggggaagccatccaagagaagatccaagagaaggctgtgaagcgggaggacctgttcatcgtcagcaagttgtggcccactttctttgagagaccccttgtgaggaaagcctttgagaagaccctcaaggacctgaagctgagctatctggacgtctatcttattcactggccacagggattcaagtctggggatgaccttttccccaaagatgataaaggtaatgccatcggtggaaaagcaacgttcttggatgcctgggaggccatggaggagctggtggatgaggggctggtgaaagcccttggggtctccaatttcagccacttccagatcgagaagctcttgaacaaacctggactgaaatataaaccagtgactaaccaggttgagtgtcacccatacctcacacaggagaaactgatccagtactgccactccaagggcatcaccgttacggcctacagccccctgggctctccggatagaccttgggccaagccagaagacccttccctgctggaggatcccaagattaaggagattgctgcaaagcacaaaaaaaccgcagcccaggttctgatccgtttccatatccagaggaatgtgattgtcatccccaagtctgtgacaccagcacgcattgttgagaacattcaggtctttgactttaaattgagtgatgaggagatggcaaccatactcagcttcaacagaaactggagggcctgtaacgtgttgcaatcctctcatttggaagactatcccttcaatgcagaatattga

SEQ ID NO: 8627 - DNA, 903 bp, synthetic construct
  misc_feature 1..903: note = Synthetic polypeptide
  source 1..903: mol_type = other DNA
tggctgaggtcacagttgggactgagaggagatttgagctccagacttgattccacctcgtcagacttctatggccttgggctagctccttcgccccatcccaaactgagcctcactttccccatctgcataatggaaatgaggataatgatgattttcagctttcggggtagacaggaagatcacacaggcctggactctgggttctgcaccatctcccgcctgccccgctcggaaaagccgcatgaccgagaccgggatggttccttcccctctgagcccgggcttcgccgctctgactctctcttgtccttccgcctggacctcgaccttgggccctcactcctcagcgagctgctaggggtcatgagcctcccagaagcccctgcagctgagactccagcccccgctgcaaaccccccagcccctactgcaaaccccacgggtcctgctgcaaaccccccagccactactgcaaaccccccagcgcctgctgcaaacccctcagcacctgccgcaacccccacgggtcctgctgcaaatcccccagcccctgccgcaagctccacaccccatggacactgtcccaatggggtaacagctgggttgggcccagtggctgaggtgaagtccagcccagtgggagggggtccccgaggacctgctggccctgccctcggcaggcactggggagcaggctgggatggcggccaccactacccagagatggatgcgcggcaggagcgggtggaggtgctgccccaagcccgggcctcctgggagagcctggacgaagagtggagggcgccccaggcaggcagcaggaccccagtgcccagcacagtgcaagcaaacacctttgaatttgcggatgctgaggaggatgatgaggtcaaggtgtga

SEQ ID NO: 8628 - DNA, 1896 bp, synthetic construct
  misc_feature 1..1896: note = Synthetic polypeptide
  source 1..1896: mol_type = other DNA
ctgggagaaacagcaagcagaagtacccgggcctccaacccaggccagttcgagagcgacagcgatgtgttgtggcagcgggcacaggtgcccgacaccgtcttccaccacggccgcgtgggcatcaacacagaccggccggatgaggcgctggttgtgcacgggaatgtcaaggtcatgggctcgcttatgcacccctccgacctgcgcgccaaggaacacgtgcaggaggtggacaccaccgagcaattgaagaggatctcgcgcatgcggctggtgcactacagatacaagcccgagttcgccgccagcgcgggcatcgaggccaccgcgccagagacaggtgtcatcgctcaggaggtgaaggagatcttgcctgaggctgtgaaagacaccggagacatggtctttgccaatgggaaaaccatagagaacttcctggtggtgaacaaggagcgcatcttcatggagaacgtaggggccgtgaaggagctgtgcaagctgacagacaacctggagacgcgcattgatgagctggagcgctggagccacaagctggccaagctgcggcggctcgacagcctcaagtccaccggcagctcgggcgccttcagccatgcagggagccagttcagtcgggcgggcagcgtcccccacaagaagaggccccccaaggtggccagcaagtcatcgtccgtggttccggaccaggcctgcatcagccagcgcttcctgcagggaaccatcattgccctggtggtggtcatggccttcagcgtggtgtccatgtccacactgtacgtgctgagcctgcgcacagaggaggacctggtagacactgatggctcttttgccgtgtccacttcctgtctcctggccctgctccggccccagccccctggggggagtgaggccttgtgcccatggtccagccagagctttgggaccacgcagctccgacagtcccccttgaccacggggctaccaggcatacagccctctttgctgctggtgaccaccagcctcaccagctcggccccaggttctgctgtccgcaccttggacatgtgttccagccacccctgccctgtcatctgctgttcctcacccactaccaaccctaccactggtcctagtcttggccccagctttaaccctggccatgttctcagcccaagtcccagccccagcaccaaccgctcaggccccagccagatggcccttctgccagtcaccaacatcagagccaagtcctggggtctttcagtcaatggcattggccactccaagcatcacaagagtctggagcctctggccagccctgcagtccccttccctggggggcagggcaaagccaagaacagtcccagccttggtttccatggccgggcccgccgaggggccctccagtccagcgtgggccctgctgagcccacctgggcccagggccagtcagcctctctccttgcagagccagtgccctccctgacctccatccaggtgctggagaattcgatgtccatcacctcccagtactgtgctccaggggatgcctgcaggcctgggaacttcacctaccacatccctgtcagtagtggcaccccactgcacctcagcctgactctgcagatgaactcctcctcccccgtgtctgtggtgctgtgcagcctgaggtcaaaggaggaaccatgtgaggaggggagccttccacagagtctccacacccaccaggacacccagggcacctctcaccggtggccaataaccatcctgtccttccgtgaattcacctaccacttccgggtggcactgctgggtcaggccaactgcagttcagaggctctcgcccagccagccacagactaccacttccacttctaccgcctgtgtgactga

SEQ ID NO: 8629 - DNA, 1803 bp, synthetic construct
  misc_feature 1..1803: note = Synthetic polypeptide
  source 1..1803: mol_type = other DNA
ctgggagaaacagcaagcagaagtacccgggcctccaacccaggccagttcgagagcgacagcgatgtgttgtggcagcgggcacaggtgcccgacaccgtcttccaccacggccgcgtgggcatcaacacagaccggccggatgaggcgctggttgtgcacgggaatgtcaaggtcatgggctcgcttatgcacccctccgacctgcgcgccaaggaacacgtgcaggaggtggacaccaccgagcaattgaagaggatctcgcgcatgcggctggtgcactacagatacaagcccgagttcgccgccagcgcgggcatcgaggccaccgcgccagagacaggtgtcatcgctcaggaggtgaaggagatcttgcctgaggctgtgaaagacaccggagacatggtctttgccaatgggaaaaccatagagaacttcctggtggtgaacaaggagcgcatcttcatggagaacgtaggggccgtgaaggagctgtgcaagctgacagacaacctggagacgcgcattgatgagctggagcgctggagccacaagctggccaagctgcggcggctcgacagcctcaagtccaccggcagctcgggcgccttcagccatgcagggagccagttcagtcgggcgggcagcgtcccccacaagaagaggccccccaaggtggccagcaagtcatcgtccgtggttccggaccaggcctgcatcagccagcgcttcctgcagggaaccatcattgccctggtggtggtcatggccttcagcgtggtgtccatgtccacactgtacgtgctgagcctgcgcacagaggaggacctggtagacactgatggcaggtccagccagagctttgggaccacgcagctccgacagtcccccttgaccacggggctaccaggcatacagccctctttgctgctggtgaccaccagcctcaccagctcggccccaggttctgctgtccgcaccttggacatgtgttccagccacccctgccctgtcatctgctgttcctcacccactaccaaccctaccactggtcctagtcttggccccagctttaaccctggccatgttctcagcccaagtcccagccccagcaccaaccgctcaggccccagccagatggcccttctgccagtcaccaacatcagagccaagtcctggggtctttcagtcaatggcattggccactccaagcatcacaagagtctggagcctctggccagccctgcagtccccttccctggggggcagggcaaagccaagaacagtcccagccttggtttccatggccgggcccgccgaggggccctccagtccagcgtgggccctgctgagcccacctgggcccagggccagtcagagccagtgccctccctgacctccatccaggtgctggagaattcgatgtccatcacctcccagtactgtgctccaggggatgcctgcaggcctgggaacttcacctaccacatccctgtcagtagtggcaccccactgcacctcagcctgactctgcagatgaactcctcctcccccgtgtctgtggtgctgtgcagcctgaggtcaaaggaggaaccatgtgaggaggggagccttccacagagtctccacacccaccaggacacccagggcacctctcaccggtggccaataaccatcctgtccttccgtgaattcacctaccacttccgggtggcactgctgggtcaggccaactgcagttcagaggctctcgcccagccagccacagactaccacttccacttctaccgcctgtgtgactga

SEQ ID NO: 8630 - DNA, 1014 bp, synthetic construct
  misc_feature 1..1014: note = Synthetic polypeptide
  source 1..1014: mol_type = other DNA
ctgggagaaacagcaagcagaagtacccgggcctccaacccaggccagttcgagagcgacagcgatgtgttgtggcagcgggcacaggtgcccgacaccgtcttccaccacggccgcgtgggcatcaacacagaccggccggatgaggcgctggttgtgcacgggaatgtcaaggtcatgggctcgcttatgcacccctccgacctgcgcgccaaggaacacgtgcaggaggtggacaccaccgagcaattgaagaggatctcgcgcatgcggctggtgcactacagatacaagcccgagttcgccgccagcgcgggcatcgaggccaccgcgccagagacaggtgtcatcgctcaggaggtgaaggagatcttgcctgaggctgtgaaagacaccggagacatggtctttgccaatgggaaaaccatagagaacttcctggtggtgaacaaggtctgtgggctgaaatacgtggtttattgtgaggacgacgtttgtcacttacctgtcctgagtctgggcgccaaggaggcatgggccgtgaaggagctgtgcaagctgacagacaacctggagacgcgcattgatgagctggagcgctggagccacaagctggccaagctgcggcggctcgacagcctcaagtccaccggcagctcgggcgccttcagccatgcagggagccagttcagtcgggcgggcagcgtcccccacaagaagaggccccccaaggtggccagcaaggtagggtcatcgtccgtggttccggaccaggcctgcatcagccagcgcttcctgcagggaaccatcattgccctggtggtggtcatggccttcaggcatcacctgggagcccagcctcaggagcaaggaccacagccttgtcctagagagagggcactggatggtggctccagctctaacggtcacccttttctgtggctccagcgtggtgtccatgtccacactgtacgtgctgagcctgcgcacagaggaggacctggtagacactga

SEQ ID NO: 8631 - DNA, 2271 bp, synthetic construct
  misc_feature 1..2271: note = Synthetic polypeptide
  source 1..2271: mol_type = other DNA
caaactcagtatcaccagtaatggaacaaaatgacattgtgtctttgcattgtatcatatcaagaggaggcatgataacattaccaatgtaaatttcttgtcaaatgtttatctagaatctgatcatgatacaacaaagagatccagtgtgggacattctacaaaaagctggtctgatctttaaaaaaggtcaatgccataaaagactataaaaagctggagaatgctggaggagaccttaaggatggccaccaccactatgaaggagctgttgtcattctggatgctggtgctcagtacgggaaagtcatagaccgaagagtgagggaactgttcgtgcagtctgaaattttccccttggaaacaccagcatttgctataaaggaacaaggattccgtgctattatcatctctggaggacctaattctgtgtatgctgaagatgctccctggtttgatccagcaatattcactattggcaagcctgttcttggaatttgctatggtatgcagatgatgaataaggtatttggaggtactgtgcacaaaaaaagtgtcagagaagatggagttttcaacattagtgtggataatacatgttcattattcaggggccttcagaaggaagaagttgttttgcttacacatggagatagtgtagacaaagtagctgatggattcaaggttgtggcacgttctggaaacatagtagcaggcatagcaaatgaatctaaaaagttatatggagcacagttccaccctgaagttggccttacagaaaatggaaaagtaatactgaagaatttcctttatgatatagctggatgcagtggaaccttcaccgtgcagaacagagaacttgagtgtattcgagagatcaaagagagagtaggcacgtcaaaagttttggttttactcagtggtggagtagactcaacagtttgtacagctttgctaaatcgtgctttgaaccaagaacaagtcattgctgtgcacattgataatggctttatgagaaaacgagaaagccagtctgttgaagaggccctcaaaaagcttggaattcaggtcaaagtgataaatgctgctcattctttctacaatggaacaacaaccctaccaatatcagatgaagatagaaccccacggaaaagaattagcaaaacgttaaatatgaccacaagtcctgaagagaaaagaaaaatcattggggatacttttgttaagattgccaatgaagtaattggagaaatgaacttgaaaccagaggaggttttccttgcccaaggtactttacggcctgatctaattgaaagtgcatcccttgttgcaagtggcaaagctgaactcatcaaaacccatcacaatgacacagagctcatcagaaagttgagagaggagggaaaagtaatagaacctctgaaagattttcataaagatgaagtgagaattttgggcagagaacttggacttccagaagagttagtttccaggcatccatttccaggtcctggcctggcaatcagagtaatatgtgctgaagaaccttatatttgtaaggactttcctgaaaccaacaatattttgaaaatagtagctgatttttctgcaagtgttaaaaagccacataccctattacagagagtcaaagcctgcacaacagaagaggatcaggagaagctgatgcaaattaccagtctgcattcactgaatgccttcttgctgccaattaaaactgtaggtgtgcagggtgactgtcgttcctacagttacgtgtgtggaatctccagtaaagatgaacctgactgggaatcacttatttttctggctaggcttatacctcgcatgtgtcacaacgttaacagagttgtttatatatttggcccaccagttaaagaacctcctacagatgttactcccactttcttgacaacaggggtgctcagtactttacgccaagctgattttgaggcccataacattctcagggagtctgggtatgctgggaaaatcagccagatgccggtgattttgacaccattacattttgatcgggacccacttcaaaagcagccttcatgccagagatctgtggttattcgaacctttattactagtgacttcatgactggtatacctgcaacacctggcaatgagatccctgtagaggtggtattaaagatggtcactgagattaagaagattcctggtatttctcgaattatgtatgacttaacatcaaagcccccaggaactactgagtgggagtaa

SEQ ID NO: 8632 - DNA, 3591 bp, synthetic construct
  misc_feature 1..3591: note = Synthetic polypeptide
  source 1..3591: mol_type = other DNA
tccctctccctctccctctccctctccctctccctctccctcacggtctccctctgatgccgagccaaagctggatggtactgctgccatctcggctcactgcaacctccctgcctgattctcctgcctcagcctgccgagtgccgccacgcctgactggttttcgtttttttttggtggagacggggtttcgctgtgttggccgggctggtctccagctcctaaccgcgagtgatccgccagcctcggcctcccgaggtgccgggattgcagacggagtctcattcactcagtgctcaatggtgcccaggctggagtgcagtggcgtgatcttggctcgctacaacctccacctcccagccgcctgccttggcctcccaaagagccgagattgcagcctctgcccggccgccaccccgtctgggaagtgaggagcgtctctgcttggccacccatcgtctgggatatgaggagccccctctgcctggctgcccagtctggaaagtgaggagcgtctctgcccggccgccatcccatctaggaagcgaggagcgcctcttccccgccgccatcacatctaggaagtgaggagcgtctctgcccggccgcccatcgtctgagatgtggggagcacctctgccctgccgccctgtctgggatgtgaggagcgtctctgcccggccgctccgtctgagaagtgaggaaaccctctgcctggcaaccgccccgtctgagaagtgaggagcccctccgtccggcaaccaccccgtctgggaagttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgtctggctctgggagaggagtggacagcagctggttgagatacatccccatctggagacaggactgccactgacagaagatgtgagctgtgtctaa

SEQ ID NO: 8633 - DNA, 3504 bp, synthetic construct
  misc_feature 1..3504: note = Synthetic polypeptide
  source 1..3504: mol_type = other DNA
tccctctccctctccctctccctctccctctccctctccctcacggtctccctctgatgccgagccaaagctggatggtactgctgccatctcggctcactgcaacctccctgcctgattctcctgcctcagcctgccgagtgccgccacgcctgactggttttcgtttttttttggtggagacggggtttcgctgtgttggccgggctggtctccagctcctaaccgcgagtgatccgccagcctcggcctcccgaggtgccgggattgcagacggagtctcattcactcagtgctcaatggtgcccaggctggagtgcagtggcgtgatcttggctcgctacaacctccacctcccagccgcctgccttggcctcccaaagagccgagattgcagcctctgcccggccgccaccccgtctgggaagtgaggagcgtctctgcttggccacccatcgtctgggatatgaggagccccctctgcctggctgcccagtctggaaagtgaggagcgtctctgcccggccgccatcccatctaggaagcgaggagcgcctcttccccgccgccatcacatctaggaagtgaggagcgtctctgcccggccgcccatcgtctgagatgtggggagcacctctgccctgccgccctgtctgggatgtgaggagcgtctctgcccggccgctccgtctgagaagtgaggaaaccctctgcctggcaaccgccccgtctgagaagtgaggagcccctccgtccggcaaccaccccgtctgggaagttgcacgttttcaaaaaatacctaatggtgaaaatgagacaatgattcctgtattgacatcaaaaaaagcaagtgaattaccagtcagtgaagttgcaagcattctccaatttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtctggctctgggagaggagtggacagcagctggttgagatacatccccatctggagacaggactgccactgacagaagatgtgagctgtgtctaa

SEQ ID NO: 8634 - DNA, 3531 bp, synthetic construct
  misc_feature 1..3531: note = Synthetic polypeptide
  source 1..3531: mol_type = other DNA
tccctctccctctccctctccctctccctctccctctccctcacggtctccctctgatgccgagccaaagctggatggtactgctgccatctcggctcactgcaacctccctgcctgattctcctgcctcagcctgccgagtgccgccacgcctgactggttttcgtttttttttggtggagacggggtttcgctgtgttggccgggctggtctccagctcctaaccgcgagtgatccgccagcctcggcctcccgaggtgccgggattgcagacggagtctcattcactcagtgctcaatggtgcccaggctggagtgcagtggcgtgatcttggctcgctacaacctccacctcccagccgcctgccttggcctcccaaagagccgagattgcagcctctgcccggccgccaccccgtctgggaagtgaggagcgtctctgcttggccacccatcgtctgggatatgaggagccccctctgcctggctgcccagtctggaaagtgaggagcgtctctgcccggccgccatcccatctaggaagcgaggagcgcctcttccccgccgccatcacatctaggaagtgaggagcgtctctgcccggccgcccatcgtctgagatgtggggagcacctctgccctgccgccctgtctgggatgtgaggagcgtctctgcccggccgctccgtctgagaagtgaggaaaccctctgcctggcaaccgccccgtctgagaagtgaggagcccctccgtccggcaaccaccccgtctgggaagttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtatga

SEQ ID NO: 8635 - DNA, 1132 bp, synthetic construct
  misc_feature 1..1132: note = Synthetic polypeptide
  source 1..1132: mol_type = other DNA
tccctctccctctccctctccctctccctctccctctccctcacggtctccctctgatgccgagccaaagctggatggtactgctgccatctcggctcactgcaacctccctgcctgattctcctgcctcagcctgccgagtgccgccacgcctgactggttttcgtttttttttggtggagacggggtttcgctgtgttggccgggctggtctccagctcctaaccgcgagtgatccgccagcctcggcctcccgaggtgccgggattgcagacggagtctcattcactcagtgctcaatggtgcccaggctggagtgcagtggcgtgatcttggctcgctacaacctccacctcccagccgcctgccttggcctcccaaagagccgagattgcagcctctgcccggccgccaccccgtctgggaagtgaggagcgtctctgcttggccacccatcgtctgggatatgaggagccccctctgcctggctgcccagtctggaaagtgaggagcgtctctgcccggccgccatcccatctaggaagcgaggagcgcctcttccccgccgccatcacatctaggaagtgaggagcgtctctgcccggccgcccatcgtctgagatgtggggagcacctctgccctgccgccctgtctgggatgtgaggagcgtctctgcccggccgctccgtctgagaagtgaggaaaccctctgcctggcaaccgccccgtctgagaagtgaggagcccctccgtccggcaaccaccccgtctgggaagttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcagg

SEQ ID NO: 8636 - DNA, 1078 bp, synthetic construct
  misc_feature 1..1078: note = Synthetic polypeptide
  source 1..1078: mol_type = other DNA
tccctctccctctccctctccctctccctctccctctccctcacggtctccctctgatgccgagccaaagctggatggtactgctgccatctcggctcactgcaacctccctgcctgattctcctgcctcagcctgccgagtgccgccacgcctgactggttttcgtttttttttggtggagacggggtttcgctgtgttggccgggctggtctccagctcctaaccgcgagtgatccgccagcctcggcctcccgaggtgccgggattgcagacggagtctcattcactcagtgctcaatggtgcccaggctggagtgcagtggcgtgatcttggctcgctacaacctccacctcccagccgcctgccttggcctcccaaagagccgagattgcagcctctgcccggccgccaccccgtctgggaagtgaggagcgtctctgcttggccacccatcgtctgggatatgaggagccccctctgcctggctgcccagtctggaaagtgaggagcgtctctgcccggccgccatcccatctaggaagcgaggagcgcctcttccccgccgccatcacatctaggaagtgaggagcgtctctgcccggccgcccatcgtctgagatgtggggagcacctctgccctgccgccctgtctgggatgtgaggagcgtctctgcccggccgctccgtctgagaagtgaggaaaccctctgcctggcaaccgccccgtctgagaagtgaggagcccctccgtccggcaaccaccccgtctgggaagttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatg

SEQ ID NO: 8637 - DNA, 3438 bp, synthetic construct
  misc_feature 1..3438: note = Synthetic polypeptide
  source 1..3438: mol_type = other DNA
tccctctccctctccctctccctctccctctccctctccctcacggtctccctctgatgccgagccaaagctggatggtactgctgccatctcggctcactgcaacctccctgcctgattctcctgcctcagcctgccgagtgccgccacgcctgactggttttcgtttttttttggtggagacggggtttcgctgtgttggccgggctggtctccagctcctaaccgcgagtgatccgccagcctcggcctcccgaggtgccgggattgcagacggagtctcattcactcagtgctcaatggtgcccaggctggagtgcagtggcgtgatcttggctcgctacaacctccacctcccagccgcctgccttggcctcccaaagagccgagattgcagcctctgcccggccgccaccccgtctgggaagtgaggagcgtctctgcttggccacccatcgtctgggatatgaggagccccctctgcctggctgcccagtctggaaagtgaggagcgtctctgcccggccgccatcccatctaggaagcgaggagcgcctcttccccgccgccatcacatctaggaagtgaggagcgtctctgcccggccgcccatcgtctgagatgtggggagcacctctgccctgccgccctgtctgggatgtgaggagcgtctctgcccggccgctccgtctgagaagtgaggaaaccctctgcctggcaaccgccccgtctgagaagtgaggagcccctccgtccggcaaccaccccgtctgggaagttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactgggtctggctctgggagaggagtggacagcagctggttga

SEQ ID NO: 8638 - DNA, 3621 bp, synthetic construct
  misc_feature 1..3621: note = Synthetic polypeptide
  source 1..3621: mol_type = other DNA
tccctctccctctccctctccctctccctctccctctccctcacggtctccctctgatgccgagccaaagctggatggtactgctgccatctcggctcactgcaacctccctgcctgattctcctgcctcagcctgccgagtgccgccacgcctgactggttttcgtttttttttggtggagacggggtttcgctgtgttggccgggctggtctccagctcctaaccgcgagtgatccgccagcctcggcctcccgaggtgccgggattgcagacggagtctcattcactcagtgctcaatggtgcccaggctggagtgcagtggcgtgatcttggctcgctacaacctccacctcccagccgcctgccttggcctcccaaagagccgagattgcagcctctgcccggccgccaccccgtctgggaagtgaggagcgtctctgcttggccacccatcgtctgggatatgaggagccccctctgcctggctgcccagtctggaaagtgaggagcgtctctgcccggccgccatcccatctaggaagcgaggagcgcctcttccccgccgccatcacatctaggaagtgaggagcgtctctgcccggccgcccatcgtctgagatgtggggagcacctctgccctgccgccctgtctgggatgtgaggagcgtctctgcccggccgctccgtctgagaagtgaggaaaccctctgcctggcaaccgccccgtctgagaagtgaggagcccctccgtccggcaaccaccccgtctgggaagttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtctggctctgggagaggagtggacagcagctggttgagatacatccccatctggagacaggactgccactgacagaagatgtgagctgtgtctaa

SEQ ID NO: 8639 - DNA, 1043 bp, synthetic construct
  misc_feature 1..1043: note = Synthetic polypeptide
  source 1..1043: mol_type = other DNA
tgatatggttcagctgtgtccctgggcaaatatcaacttgaattgtatctcccagaattcgcacatgttgtgggagggaccaaagaggaactggttgaatcatgaggccggtctttcccgtgctattctcatgatagtgaataagtctcacgagatctggtgggttcatcaggggtttccgcttttgcttcctcctcattttctcttgccactgccatgtaagaagtgccttttgcctcctgccatgattcagaggcctctcagctatgtggtactgccctgaagaggaaagtgaggatgactctcatctcgaaggcagggatcctgatatttggcatgttggttttaagatctcatgggacatagagacacctggtttggcgataccccttcaccaaggagactgctatttcatgcttgatgatctcaatgccacccaccaacactgtgttttggccggttcacaacctcggtttagttccacccaccgagtggcagagtgctcaacaggaaccttggattatattttacaacgctgtcagttggctctgcagaatgtctgtgacgatgtggacaatgatgatgtctctttgaaatcctttgagcctgcagttttgaaacaaggagaagaaattcataatgaggtcgagtttgagtggctgaggcagttttggtttcaaggcaatcgatacagaaagtgcactgactggtggtgtcaacccatggctcaactggaagcactgtggaagaagatggagggtgtgacaaatgctgtgcttcatgaagttaaaagagaggggctccccgtggaacaaaggaatgaaatcttgactgccatccttgcctcgctcactgcacgccagaacctgaggagagaatggcatgccaggtgccagtcacgaattgcccgaacattacctgctgatcagaagccagaatgtcggccatactgggaaaaggatgatgcttcgatgcctctgccgtttgacctcacagacatcgtttcagaactcagaggtcagcttctggaagcaaaaccctag

SEQ ID NO: 8640 - DNA, 366 bp, synthetic construct
  misc_feature 1..366: note = Synthetic polypeptide
  source 1..366: mol_type = other DNA
tgatatggttcagctgtgtccctgggcaaatatcaacttgaattgtatctcccagaattcgcacatgttgtgggagggaccaaagaggaactggttgaatcatgaggccggtctttcccgtgctattctcatgatagtgaataagtctcacgagatctggtgggttcatcaggggtttccgcttttgcttcctcctcattttctcttgccactgccatgtaagaagtgccttttgcctcctgccatgattcagaggcctctcagctatgtggtactgccctgaagaggaaagtgaggatgactctcatctcgaaggcagggatcctgatatttggcatgttggttttaagatctcatgggacatag

SEQ ID NO: 8641 - DNA, 384 bp, synthetic construct
  misc_feature 1..384: note = Synthetic polypeptide
  source 1..384: mol_type = other DNA
ggctgggtgcagtggctcatgcctgtcatcccagcactttgggaggctgaagtgggcagatctctggaggtcaggagttcaagacctgcctggccaatatggtgaaaccccatctctactaaaaatacaaaaattacctaggcatggtggtgagcatctgtaatcccagctactcagaggctgaggtaggagaatcgcttgaacctgggaggcagaggtcttggctgttcaaccgtactttctccagaaggatcagctcaatttgctgctcagatatttgggttaagcaaccatttggtatggagcaaactgcgagcaagcattttgaacacatggatttccttgaagcaggctgacaagaaaatcagagaatgtaatttataa

SEQ ID NO: 8642 - DNA, 345 bp, synthetic construct
  misc_feature 1..345: note = Synthetic polypeptide
  source 1..345: mol_type = other DNA
ggctgggtgcagtggctcatgcctgtcatcccagcactttgggaggctgaagtgggcagatctctggaggtcaggagttcaagacctgcctggccaatatggtgaaaccccatctctactaaaaatacaaaaattacctaggcatggtggtgagcatctgtaatcccagctactcagaggctgaggtaggagaatcgcttgaacctgggaggcagaggtcttggctgttcaaccgtactttctccagaaggatcagctcaatttgctgctcagatatttgggttaagcaaccatttggtatggagcaaactgcgagcaagcattttgaacacatggatttccttg

SEQ ID NO: 8643 - DNA, 809 bp, synthetic construct
  misc_feature 1..809: note = Synthetic polypeptide
  source 1..809: mol_type = other DNA
cctggttctctggggcacgaggcttctcctcagcactctggcgcccccaacaggttcccagtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacgagaaattaatgctgatataaaacgtaaattagtgaaggaactccgatgcgttggacaaaaatatgaaaaaatcttcgaaatgcttgaaggagtgcaaggacctactgcagtcaggaagcgattttttgaatccatcatcaaggaagcagcaagatgtatgagacgagactttgttaagcaccttaagaagaaactgaaacgtatgatttga

SEQ ID NO: 8644 - DNA, 2140 bp, synthetic construct
  misc_feature 1..2140: note = Synthetic polypeptide
  source 1..2140: mol_type = other DNA
tgtgatatcatgaaatacgtatttggactttgtccaagtttcttggcatataactcctaaaatccttggaatttccaaaatgctgccttttttgtatgctaatgctggctcatgggttcagaatgggggtctggtcactggaaaggcaaaggcacaattagagagtcagccccaccccccagcctccaggaaggagagagaggctgaaggttaagttgatcaccacttgccaatggtttaatcaatcatggctagataatgaaaccttcataaaaacccaaaaggacaggtttcagcaaggttcaagatagtaaaacatgtggagagttttagaggttgaagcccagggagggcatggaaactctgcacctctccccccataccactccctagatgtctcttcatcttcatcctctgcaacatcctttataataaaccagtaaatgtgtttccttgaattctgtaagctgctccagcaaattaatcaaacccaaattggggtcatggaaaacccaatttgaagctggttggtcagaagttccagaggtctggatttgctcctggttgtgtgtggagtcttgggaactgagtcttcaacctgtgcgatatgacagatctccgggtagacagtgtcacagttgaattggaggacacccagcttggtgtctgctgcttgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcagtttcttagcgaggttgggctgttcatcatgtctggactatttcacgacccaggggctgaccaccatctatcagattgagcattactccatggatgatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtga

SEQ ID NO: 8645 - DNA, 1561 bp, synthetic construct
  misc_feature 1..1561: note = Synthetic polypeptide
  source 1..1561: mol_type = other DNA
tgtgatatcatgaaatacgtatttggactttgtccaagtttcttggcatataactcctaaaatccttggaatttccaaaatgctgccttttttgtatgctaatgctggctcatgggttcagaatgggggtctggtcactggaaaggcaaaggcacaattagagagtcagccccaccccccagcctccaggaaggagagagaggctgaaggttaagttgatcaccacttgccaatggtttaatcaatcatggctagataatgaaaccttcataaaaacccaaaaggacaggtttcagcaaggttcaagatagtaaaacatgtggagagttttagaggttgaagcccagggagggcatggaaactctgcacctctccccccataccactccctagatgtctcttcatcttcatcctctgcaacatcctttataataaaccagtaaatgtgtttccttgaattctgtaagctgctccagcaaattaatcaaacccaaattggggtcatggaaaacccaatttgaagctggttggtcagaagttccagaggtctggatttgctcctggttgtgtgtggagtcttgggaactgagtcttcaacctgtgcgatatgacagatctccgggtagacagtgtcacagttgaattggaggacacccagcttggtgtctgctgcttgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacatctcctttcagcctgcttcaggaatgagcttgtggagccccggagagaaactccaaaacaatctgacgtcttctttagacattccaagcccccaaaccgatcagtgtacccatag

SEQ ID NO: 8646 - DNA, 1630 bp, synthetic construct
  misc_feature 1..1630: note = Synthetic polypeptide
  source 1..1630: mol_type = other DNA
tgtgatatcatgaaatacgtatttggactttgtccaagtttcttggcatataactcctaaaatccttggaatttccaaaatgctgccttttttgtatgctaatgctggctcatgggttcagaatgggggtctggtcactggaaaggcaaaggcacaattagagagtcagccccaccccccagcctccaggaaggagagagaggctgaaggttaagttgatcaccacttgccaatggtttaatcaatcatggctagataatgaaaccttcataaaaacccaaaaggacaggtttcagcaaggttcaagatagtaaaacatgtggagagttttagaggttgaagcccagggagggcatggaaactctgcacctctccccccataccactccctagatgtctcttcatcttcatcctctgcaacatcctttataataaaccagtaaatgtgtttccttgaattctgtaagctgctccagcaaattaatcaaacccaaattggggtcatggaaaacccaatttgaagctggttggtcagaagttccagaggtctggatttgctcctggttgtgtgtggagtcttgggaactgagtcttcaacctgtgcgatatgacagatctccgggtagacagtgtcacagttgaattggaggacacccagcttggtgtctgctgcttgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacagatctggcaagtctgaaaatccctga

SEQ ID NO: 8647 - DNA, 1765 bp, synthetic construct
  misc_feature 1..1765: note = Synthetic polypeptide
  source 1..1765: mol_type = other DNA
tgtgatatcatgaaatacgtatttggactttgtccaagtttcttggcatataactcctaaaatccttggaatttccaaaatgctgccttttttgtatgctaatgctggctcatgggttcagaatgggggtctggtcactggaaaggcaaaggcacaattagagagtcagccccaccccccagcctccaggaaggagagagaggctgaaggttaagttgatcaccacttgccaatggtttaatcaatcatggctagataatgaaaccttcataaaaacccaaaaggacaggtttcagcaaggttcaagatagtaaaacatgtggagagttttagaggttgaagcccagggagggcatggaaactctgcacctctccccccataccactccctagatgtctcttcatcttcatcctctgcaacatcctttataataaaccagtaaatgtgtttccttgaattctgtaagctgctccagcaaattaatcaaacccaaattggggtcatggaaaacccaatttgaagctggttggtcagaagttccagaggtctggatttgctcctggttgtgtgtggagtcttgggaactgagtcttcaacctgtgcgatatgacagatctccgggtagacagtgtcacagttgaattggaggacacccagcttggtgtctgctgcttgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcaggatctggcaagtctga

SEQ ID NO: 8648 - DNA, 2128 bp, synthetic construct
  misc_feature 1..2128: note = Synthetic polypeptide
  source 1..2128: mol_type = other DNA
tgtgatatcatgaaatacgtatttggactttgtccaagtttcttggcatataactcctaaaatccttggaatttccaaaatgctgccttttttgtatgctaatgctggctcatgggttcagaatgggggtctggtcactggaaaggcaaaggcacaattagagagtcagccccaccccccagcctccaggaaggagagagaggctgaaggttaagttgatcaccacttgccaatggtttaatcaatcatggctagataatgaaaccttcataaaaacccaaaaggacaggtttcagcaaggttcaagatagtaaaacatgtggagagttttagaggttgaagcccagggagggcatggaaactctgcacctctccccccataccactccctagatgtctcttcatcttcatcctctgcaacatcctttataataaaccagtaaatgtgtttccttgaattctgtaagctgctccagcaaattaatcaaacccaaattggggtcatggaaaacccaatttgaagctggttggtcagaagttccagaggtctggatttgctcctggttgtgtgtggagtcttgggaactgagtcttcaacctgtgcgatatgacagatctccgggtagacagtgtcacagttgaattggaggacacccagcttggtgtctgctgcttgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatgcgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcagtttcttagcgaggttgggctgttcatcatgtctggactatttcacgacccaggggctgaccaccatctatcagattgagcattactccatggatgatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtga

SEQ ID NO: 8649 - DNA, 713 bp, synthetic construct
  misc_feature 1..713: note = Synthetic polypeptide
  source 1..713: mol_type = other DNA
tgtgatatcatgaaatacgtatttggactttgtccaagtttcttggcatataactcctaaaatccttggaatttccaaaatgctgccttttttgtatgctaatgctggctcatgggttcagaatgggggtctggtcactggaaaggcaaaggcacaattagagagtcagccccaccccccagcctccaggaaggagagagaggctgaaggttaagttgatcaccacttgccaatggtttaatcaatcatggctagataatgaaaccttcataaaaacccaaaaggacaggtttcagcaaggttcaagatagtaaaacatgtggagagttttagaggttgaagcccagggagggcatggaaactctgcacctctccccccataccactccctagatgtctcttcatcttcatcctctgcaacatcctttataataaaccagtaaatgtgtttccttgaattctgtaagctgctccagcaaattaatcaaacccaaattggggtcatggaaaacccaatttgaagctggttggtcagaagttccagaggtctggatttgctcctggttgtgtgtggagtcttgggaactgagtcttcaacctgtgcgatatgacagatctccgggtagacagtgtcacagttgaattggaggacacccagcttggtgtctgctgcttgtattccactgaactgaagaaactctactgccaaattg

SEQ ID NO: 8650 - DNA, 1763 bp, synthetic construct
  misc_feature 1..1763: note = Synthetic polypeptide
  source 1..1763: mol_type = other DNA
agattgataccaagaagtgggagtgcttctaacgaatgtggaagtggctttggaaatgggtaatgggtagaaactggaaagagttcggaggtgcacactagaaaaagcctacattgctgtgaattgacctttaaaggtgattctggtgaaggctcagaaagaaaagaggagagctataaagaaagccttaatcctcctagaaaatacctaagtgatcatgaacagaacgttggcagaaatatgggtaataaaggccagtctgataaggtctcagagggaaatgaggaccatgttattggacaatggagaaaaagccatcggggtgggggggaaagggaagggagagcatcaggacaaatacctaatgcatgcagggcttaaaacttagatgacaggttgatagatgcagtaaaccacatgtatacctgtgtaacaaacctgcacgttcagcacatatatcccagaacttaaagtaaaagaaaacaaatttttttaaaaagcgtcagagaacttggctgaattgtgcctgtattctagtgttttgcagaaggtagagcggtgaacactgaaattacatatttggataaggaaatttctaggcaaagtgtgaaagttgtggcttggcttctcttgacagcctacattaaaatgtgaaaagagagaaaagatttaaagacagaattgttaatcaaagagaagcagcacttaaagatttggaaaattctcaccctagccatattatgaagaatgagataacgggtacagtggttcatgcctgtagtcctaactgttagagaagtggaggcaggaggatcccttaaacccaggagtttgagacttgtctgagtaacatagtgagagtccatctcttaaaaaagaataaataaataaatgagaaggcacattgggaaagaacaccaagggtgcggccaaatgaccatctgataaggagattagtcaaccaagtggaacctgttgctcaaggtgattcagaagtaattggggctgccacctccatcacagctccaatgtgcaaaagcttgagcaggcaagcatgggacctccacagagagcccttactagagcaacatccaggatagccgagtggttatggccacaccgtgcccttgtcagatggaggtaaggccttctgcatcatctactccgtcattggcattcccttcaccctcctgttcctgacggctgtggtccagcgcatcaccgtgcacgtcacccgcaggccggtcctctacttccacatccgctggggcttctccaagcaggtggtggccatcgtccatgccgtgctccttgggtttgtcactgtgtcctgcttcttcttcatcccggccgctgtcttctcagtcctggaggatgactggaacttcctggaatccttttatttttgttttatttccctgagcaccattggcctgggggattatgtgcctggggaaggctacaatcaaaaattcagagagctctataagattgggatcacgtgttacctgctacttggccttattgccatgttggtagttctggaaaccttctgtgaactccatgagctgaaaaaattcagaaaaatgttctatgtgaagaaggacaaggacgaggatcaggtgcacatcatagagcatgaccaactgtccttctcctcgatcacagaccaggcagctggcatgaaagaggaccagaagcaaaatgagccttttgtggccacccagtcatctgcctgcgtggatggccctgcaaaccattga

SEQ ID NO: 8651 - DNA, 1724 bp, synthetic construct
  misc_feature 1..1724: note = Synthetic polypeptide
  source 1..1724: mol_type = other DNA
agattgataccaagaagtgggagtgcttctaacgaatgtggaagtggctttggaaatgggtaatgggtagaaactggaaagagttcggaggtgcacactagaaaaagcctacattgctgtgaattgacctttaaaggtgattctggtgaaggctcagaaagaaaagaggagagctataaagaaagccttaatcctcctagaaaatacctaagtgatcatgaacagaacgttggcagaaatatgggtaataaaggccagtctgataaggtctcagagggaaatgaggaccatgttattggacaatggagaaaaagccatcggggtgggggggaaagggaagggagagcatcaggacaaatacctaatgcatgcagggcttaaaacttagatgacaggttgatagatgcagtaaaccacatgtatacctgtgtaacaaacctgcacgttcagcacatatatcccagaacttaaagtaaaagaaaacaaatttttttaaaaagcgtcagagaacttggctgaattgtgcctgtattctagtgttttgcagaaggtagagcggtgaacactgaaattacatatttggataaggaaatttctaggcaaagtgtgaaagttgtggcttggcttctcttgacagcctacattaaaatgtgaaaagagagaaaagatttaaagacagaattgttaatcaaagagaagcagcacttaaagatttggaaaattctcaccctagccatattatgaagaatgagataacgggtacagtggttcatgcctgtagtcctaactgttagagaagtggaggcaggaggatcccttaaacccaggagtttgagacttgtctgagtaacatagtgagagtccatctcttaaaaaagaataaataaataaatgagaaggcacattgggaaagaacaccaagggtgcggccaaatgaccatctgataaggagattagtcaaccaagtggaacctgttgctcaaggtgattcagaagtaattggggctgccacctccatcacagctccaatgtgcaaaagcttgagcaggcaagcatgggacctccacagagagcccttactagagcaacatccaggatagccgagtggttatggccacaccgtgcccttgtcagatggaggtaaggccttctgcatcatctactccgtcattggcattcccttcaccctcctgttcctgacggctgtggtccagcgcatcaccgtgcacgtcacccgcaggccggtcctctacttccacatccgctggggcttctccaagcaggtggtggccatcgtccatgccgtgctccttgggtttgtcactgtgtcctgcttcttcttcatcccggccgctgtcttctcagtcctggaggatgactggaacttcctggaatccttttatttttgttttatttccctgagcaccattggcctgggggattatgtgcctggggaaggctacaatcaaaaattcagagagctctataagattgggatcacgtgttacctgctacttggccttattgccatgttggtagttctggaaaccttctgtgaactccatgagctgaaaaaattcagaaaaatgttctatgtgaagaaggacaaggacgaggatcaggtgcacatcatagagcatgaccaactgtccttctcctcgatcacagaccaggcagctggcatgaaagaggaccagaagcaaaatgagccttttgtggccacc

SEQ ID NO: 8652 - DNA, 796 bp, synthetic construct
  misc_feature 1..796: note = Synthetic polypeptide
  source 1..796: mol_type = other DNA
ggctgggtgcgatggctcatgcctgtaatcccagcactttgggaggctgagttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggaaagtggagaatgaggacatgaataaagaccagatcttgctggaaaaagaagctgagctccgccgcatgcaagagatgattgcaaggatgcaggcgcagatgcagatgcagatgcagggcggggatggcgatggcggggctctcgggcaccacgtgtaa

SEQ ID NO: 8653 - DNA, 383 bp, synthetic construct
  misc_feature 1..383: note = Synthetic polypeptide
  source 1..383: mol_type = other DNA
ggctgggtgcgatggctcatgcctgtaatcccagcactttgggaggctgagttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagatttta

SEQ ID NO: 8654 - DNA, 155 bp, synthetic construct
  misc_feature 1..155: note = Synthetic polypeptide
  source 1..155: mol_type = other DNA
ggctgggtgcgatggctcatgcctgtaatcccagcactttgggaggctgagttttaagacaattatctcctatattgatgagcaatttgagaggtacctgcatgacgagagcggcttgaacaggcggcacatcattgataatagggtgcattgtt

SEQ ID NO: 8655 - DNA, 118 bp, synthetic construct
  misc_feature 1..118: note = Synthetic polypeptide
  source 1..118: mol_type = other DNA
ggctgggtgcgatggctcatgcctgtaatcccagcactttgggaggctgagttttaagacaattatctcctatattgatgagcaatttgagaggtacctgcatgacgagagcggcttg

SEQ ID NO: 8656 - DNA, 193 bp, synthetic construct
  misc_feature 1..193: note = Synthetic polypeptide
  source 1..193: mol_type = other DNA
ggctgggtgcgatggctcatgcctgtaatcccagcactttgggaggctgagttttaagacaattatctcctatattgatgagcaatttgagaggtacctgcatgacgagagcggcttgaacaggcggcacatcattgataatagggtgcattgttgcttttactttatttcaccttttggacatggacttaag

SEQ ID NO: 8657 - DNA, 103 bp, synthetic construct
  misc_feature 1..103: note = Synthetic polypeptide
  source 1..103: mol_type = other DNA
ggctgggtgcgatggctcatgcctgtaatcccagcactttgggaggctgagttttaagacaattatctcctatattgatgagcaatttgagaggtacctgcat

SEQ ID NO: 8658 - DNA, 230 bp, synthetic construct
  misc_feature 1..230: note = Synthetic polypeptide
  source 1..230: mol_type = other DNA
ggctgggtgcgatggctcatgcctgtaatcccagcactttgggaggctgagttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaaca

SEQ ID NO: 8659 - DNA, 279 bp, synthetic construct
  misc_feature 1..279: note = Synthetic polypeptide
  source 1..279: mol_type = other DNA
ggctgggtgcgatggctcatgcctgtaatcccagcactttgggaggctgagttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaa

SEQ ID NO: 8660 - DNA, 2609 bp, synthetic construct
  misc_feature 1..2609: note = Synthetic polypeptide
  source 1..2609: mol_type = other DNA
ttgtcttctacgtttttttaaagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactgcatgaccataggaggccgcacccgcagcactcgcagcagccgccaccaccgcagcaggaaaggagcaagccaagcttccatgctcccgagcccaaagcccactacgagcctgctgaccgagcgcgagaggtggaagatagatttaggaaaactaaccacagctcccctgaagcccagtctaagcagacaggcagagtattggagccaccagtgccttcccgatcagagtctttttccaatggcaactccgagtctgtgcatcccgccctgcagagaccagcggagccacaggttcctgtgagaacaacatctcgctcccctgttctgtcccgtcgagattccccactgcagggcagtgggcagcagaatagccaggcaggacagagaaactccaccagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagagtacagttgaccaaaagcgtgccagccatcatgagagcaatggctttgccggtcgcattcacctcttgccagatctcttacagcaaagccattcctcctccacttcctccacctcctcctccccatcctccagccagccgacacccaccatgtccccacagacaccccaggacaagctcactgctaatgagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtag

SEQ ID NO: 8661 - DNA, 2360 bp, synthetic construct
  misc_feature 1..2360: note = Synthetic polypeptide
  source 1..2360: mol_type = other DNA
ttgtcttctacgtttttttaaagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactggagtgccgatggcgggagatggaggagcaccggcaggcagagaggctccagaggcagttgcaacaagaacaagcatatctcctgtctctacagcatgaccataggaggccgcacccgcagcactcgcagcagccgccaccaccgcagcaggaaaggagcaagccaagcttccatgctcccgagcccaaagcccactacgagcctgctgaccgagcgcgagaggttcctgtgagaacaacatctcgctcccctgttctgtcccgtcgagattccccactgcagggcagtgggcagcagaatagccaggcaggacagagaaactccaccagcagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgtaaggattgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtag

SEQ ID NO: 8662 - DNA, 2753 bp, synthetic construct
  misc_feature 1..2753: note = Synthetic polypeptide
  source 1..2753: mol_type = other DNA
ttgtcttctacgtttttttaaagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactggagtgccgatggcgggagatggaggagcaccggcaggcagagaggctccagaggcagttgcaacaagaacaagcatatctcctgtctctacagcatgaccataggaggccgcacccgcagcactcgcagcagccgccaccaccgcagcaggaaaggagcaagccaagcttccatgctcccgagcccaaagcccactacgagcctgctgaccgagcgcgagaggtggaagatagatttaggaaaactaaccacagctcccctgaagcccagtctaagcagacaggcagagtattggagccaccagtgccttcccgatcagagtctttttccaatggcaactccgagtctgtgcatcccgccctgcagagaccagcggagccacaggtacagtggtcccacctggcatctctcaagaacaatgtttcccctgtctcgcgatcccattccttcagtgacccttctcccaaatttgcacaccaccatcttcgttctcaggacccatgtccaccttcccgcagtgaggtgctcagtcagagctctgactctaagtcagaggcgcctgaccctacccaaaaggcttggtctagatcagacagtgacgaggtgcctccaagggttcctgtgagaacaacatctcgctcccctgttctgtcccgtcgagattccccactgcagggcagtgggcagcagaatagccaggcaggacagagaaactccaccagcagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgtaaggattgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtag

SEQ ID NO: 8663 - DNA, 2291 bp, synthetic construct
  misc_feature 1..2291: note = Synthetic polypeptide
  source 1..2291: mol_type = other DNA
ttgtcttctacgtttttttaaagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactgcatgaccataggaggccgcacccgcagcactcgcagcagccgccaccaccgcagcaggaaaggagcaagccaagcttccatgctcccgagcccaaagcccactacgagcctgctgaccgagcgcgagaggttcctgtgagaacaacatctcgctcccctgttctgtcccgtcgagattccccactgcagggcagtgggcagcagaatagccaggcaggacagagaaactccaccagcagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgtaaggattgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatgtaagaaagaacccacactctatgatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtag

SEQ ID NO: 8664 - DNA, 2255 bp, synthetic construct
  misc_feature 1..2255: note = Synthetic polypeptide
  source 1..2255: mol_type = other DNA
ttgtcttctacgtttttttaaagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactgcatgaccataggaggccgcacccgcagcactcgcagcagccgccaccaccgcagcaggaaaggagcaagccaagcttccatgctcccgagcccaaagcccactacgagcctgctgaccgagcgcgagaggttcctgtgagaacaacatctcgctcccctgttctgtcccgtcgagattccccactgcagggcagtgggcagcagaatagccaggcaggacagagaaactccaccagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtag

SEQ ID NO: 8665 - DNA, 2510 bp, synthetic construct
  misc_feature 1..2510: note = Synthetic polypeptide
  source 1..2510: mol_type = other DNA
ttgtcttctacgtttttttaaagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactggagtgccgatggcgggagatggaggagcaccggcaggcagagaggctccagaggcagttgcaacaagaacaagcatatctcctgtctctacagcatgaccataggaggccgcacccgcagcactcgcagcagccgccaccaccgcagcaggaaaggagcaagccaagcttccatgctcccgagcccaaagcccactacgagcctgctgaccgagcgcgagaggtggaagatagatttaggaaaactaaccacagctcccctgaagcccagtctaagcagacaggcagagtattggagccaccagtgccttcccgatcagagtctttttccaatggcaactccgagtctgtgcatcccgccctgcagagaccagcggagccacaggttcctgtgagaacaacatctcgctcccctgttctgtcccgtcgagattccccactgcagggcagtgggcagcagaatagccaggcaggacagagaaactccaccagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtag

SEQ ID NO: 8666 - DNA, 2348 bp, synthetic construct
  misc_feature 1..2348: note = Synthetic polypeptide
  source 1..2348: mol_type = other DNA
ttgtcttctacgtttttttaaagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactggagtgccgatggcgggagatggaggagcaccggcaggcagagaggctccagaggcagttgcaacaagaacaagcatatctcctgtctctacagcatgaccataggaggccgcacccgcagcactcgcagcagccgccaccaccgcagcaggaaaggagcaagccaagcttccatgctcccgagcccaaagcccactacgagcctgctgaccgagcgcgagaggttcctgtgagaacaacatctcgctcccctgttctgtcccgtcgagattccccactgcagggcagtgggcagcagaatagccaggcaggacagagaaactccaccagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtag

SEQ ID NO: 8667 - DNA, 2417 bp, synthetic construct
  misc_feature 1..2417: note = Synthetic polypeptide
  source 1..2417: mol_type = other DNA
ttgtcttctacgtttttttaaagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactgcatgaccataggaggccgcacccgcagcactcgcagcagccgccaccaccgcagcaggaaaggagcaagccaagcttccatgctcccgagcccaaagcccactacgagcctgctgaccgagcgcgagaggtggaagatagatttaggaaaactaaccacagctcccctgaagcccagtctaagcagacaggcagagtattggagccaccagtgccttcccgatcagagtctttttccaatggcaactccgagtctgtgcatcccgccctgcagagaccagcggagccacaggttcctgtgagaacaacatctcgctcccctgttctgtcccgtcgagattccccactgcagggcagtgggcagcagaatagccaggcaggacagagaaactccaccagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtag

SEQ ID NO: 8668 - DNA, 2690 bp, synthetic construct
  misc_feature 1..2690: note = Synthetic polypeptide
  source 1..2690: mol_type = other DNA
ttgtcttctacgtttttttaaagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactgcatgaccataggaggccgcacccgcagcactcgcagcagccgccaccaccgcagcaggaaaggagcaagccaagcttccatgctcccgagcccaaagcccactacgagcctgctgaccgagcgcgagaggtacagtggtcccacctggcatctctcaagaacaatgtttcccctgtctcgcgatcccattccttcagtgacccttctcccaaatttgcacaccaccatcttcgttctcaggacccatgtccaccttcccgcagtgaggtgctcagtcagagctctgactctaagtcagaggcgcctgaccctacccaaaaggcttggtctagatcagacagtgacgaggtgcctccaagggttcctgtgagaacaacatctcgctcccctgttctgtcccgtcgagattccccactgcagggcagtgggcagcagaatagccaggcaggacagagaaactccaccagcagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgtaaggattgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagagtacagttgaccaaaagcgtgccagccatcatgagagcaatggctttgccggtcgcattcacctcttgccagatctcttacagcaaagccattcctcctccacttcctccacctcctcctccccatcctccagccagccgacacccaccatgtccccacagacaccccaggacaagctcactgctaatgagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtag

SEQ ID NO: 8669 - DNA, 2741 bp, synthetic construct
  misc_feature 1..2741: note = Synthetic polypeptide
  source 1..2741: mol_type = other DNA
ttgtcttctacgtttttttaaagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactggagtgccgatggcgggagatggaggagcaccggcaggcagagaggctccagaggcagttgcaacaagaacaagcatatctcctgtctctacagcatgaccataggaggccgcacccgcagcactcgcagcagccgccaccaccgcagcaggaaaggagcaagccaagcttccatgctcccgagcccaaagcccactacgagcctgctgaccgagcgcgagaggtggaagatagatttaggaaaactaaccacagctcccctgaagcccagtctaagcagacaggcagagtattggagccaccagtgccttcccgatcagagtctttttccaatggcaactccgagtctgtgcatcccgccctgcagagaccagcggagccacaggtacagtggtcccacctggcatctctcaagaacaatgtttcccctgtctcgcgatcccattccttcagtgacccttctcccaaatttgcacaccaccatcttcgttctcaggacccatgtccaccttcccgcagtgaggtgctcagtcagagctctgactctaagtcagaggcgcctgaccctacccaaaaggcttggtctagatcagacagtgacgaggtgcctccaagggttcctgtgagaacaacatctcgctcccctgttctgtcccgtcgagattccccactgcagggcagtgggcagcagaatagccaggcaggacagagaaactccaccagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtag

SEQ ID NO: 8670 - DNA, 799 bp, synthetic construct
  misc_feature 1..799: note = Synthetic polypeptide
  source 1..799: mol_type = other DNA
ttgtcttctacgtttttttaaagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactggagtgccgatggcgggagatggaggagcaccggcaggcagagaggctccagaggcagttgcaacaagaacaagcatatctcctgtctctacagcatgaccataggaggccgcacccgcagcactcgcagcagccgccaccaccgcagcaggaaaggagcaagccaagcttccatgctcccgagcccaaagcccactacgagcctgctgaccgagcgcgagaggtacagtggtcccacctggcatctctcaagaacaatgtttcccctgtctcgcgatcccattccttcagtgacccttctcccaaatttgcacaccaccatcttcgttctcaggacccatgtccaccttcccgcagtgaggtgctcagtcagagctctgactctaagtcagaggcgcctgaccctacccaaaaggcttggtctagatcagacagtgacgaggtgcctccaagggttcctgtgagaacaacatctcgctcccctgttctgtcccgtcgagattccccactgcagggcagtgggcagca

SEQ ID NO: 8671 - DNA, 926 bp, synthetic construct
  misc_feature 1..926: note = Synthetic polypeptide
  source 1..926: mol_type = other DNA
ggccgggtgtggtggctgatcacgccactcccagcactttgggaggccaacgcgggcagatcatgaggtcaacagatcgagaccatcctggccaacatggtcctcttcctgatggatgggaacaagccatgactcaggatggagaaatttactatataaaccataagaacaagaccacctcttggctagacccaaggcttgaccctcgttttgccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggcaatgcggaatatcaatcccagcacagcaaattctccaaaatgtcaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatag

SEQ ID NO: 8672 - DNA, 890 bp, synthetic construct
  misc_feature 1..890: note = Synthetic polypeptide
  source 1..890: mol_type = other DNA
ggccgggtgtggtggctgatcacgccactcccagcactttgggaggccaacgcgggcagatcatgaggtcaacagatcgagaccatcctggccaacatggtcctcttcctgatggatgggaacaagccatgactcaggatggagaaatttactatataaaccataagaacaagaccacctcttggctagacccaaggcttgaccctcgttttgccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggtgaggccacaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatag

SEQ ID NO: 8673 - DNA, 878 bp, synthetic construct
  misc_feature 1..878: note = Synthetic polypeptide
  source 1..878: mol_type = other DNA
ggccgggtgtggtggctgatcacgccactcccagcactttgggaggccaacgcgggcagatcatgaggtcaacagatcgagaccatcctggccaacatggtcctcttcctgatggatgggaacaagccatgactcaggatggagaaatttactatataaaccataagaacaagaccacctcttggctagacccaaggcttgaccctcgttttgccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatag

SEQ ID NO: 8674 - DNA, 1352 bp, synthetic construct
  misc_feature 1..1352: note = Synthetic polypeptide
  source 1..1352: mol_type = other DNA
tatacccaaaagaagatagttgtacacctatatccacagcagcattattcatagtagccaaaaggtagaagtaacccaagtatcttatcagtgaatgaatagtaaacaaaatacggtatatgcatccagtggaagattattcagccttaaagaagaaaattctgactacatgctgctatatgattccacttacatgagatggaattgtcagccacttgaagaagcaggcaggaccagcttcagtgcctctcaggactgaggaagaatttaagaaattcattagtgataaagatgcctctatagtaggttttttcgatgattcattcagtgaggctcactccgagttcctaaaagcagccagcaacttgagggataactaccgatttgcacatacgaatgttgagtctctggtgaacgagtatgatgataatggagagggtatcatcttatttcgtccttcacatctcactaacaagtttgaggacaagactgtggcatatacagagcaaaaaatgaccagtggcaaaattaaaaagtttatccaggaaaacatttttggtatctgccctcacatgacagaagacaataaagatttgatacagggcaaggacttacttattgcttactatgatgtggactatgaaaagaacgctaaaggttccaactactggagaaacagggtaatgatggtggcaaagaaattcctggatgctgggcacaaactcaactttgctgtagctagccgcaaaacctttagccatgaactttctgattttggcttggagagcactgctggagagattcctgttgttgctatcagaactgctaaaggagagaagtttgtcatgcaggaggagttctcgcgtgatgggaaggctctggagaggttcctgcaggattactttgatggcaatctgaagagatacctgaagtctgaacctatcccagagagcaatgatgggcctgtgaaggtagtggtagcagagaattttgatgaaatagtgaataatgaaaataaagatgtgctgattgaattttatgccccttggtgtggtcactgtaagaacctggagcccaagtataaagaacttggcgagaagctcagcaaagacccaaatatcgtcatagccaagatggatgccacagccaatgatgtgccttctccatatgaagtcagaggttttcctaccatatacttctctccagccaacaagaagctaaatccaaagaaatatgaaggtggccgtgaattaagtgattttattagctatctacaaagagaagctacaaacccccctgtaattcaagaagaaaaacccaagaagaagaagaaggcacaggaggatctctaa

SEQ ID NO: 8675 - DNA, 829 bp, synthetic construct
  misc_feature 1..829: note = Synthetic polypeptide
  source 1..829: mol_type = other DNA
tatagattcctgggcttggtccccatcttacagaatcagcttctctggagttgaggcccaggaatggtcatttctaacaccctctccaggctgcacgtgggaatttggagccatggtgaactacatcaagaagacatatcccctgacccagctggtcgtcgtgggcttcagcctgggtggtaacattgtgtgcaaatacttgggggagactcaggcaaaccaagagaaggtcctgtgctgcgtcagcgtgtgccaggggtacagtgcactgagggcccaggaaaccttcatgcaatgggatcagtgccggcggttctacaacttcctcatggctgacaacatgaagaagatcatcctctcgcacaggcaagctctttttggagaccatgttaagaaaccccagagcctggaagacacggacttgagccggctctacacagcaacatccctgatgcagattgatgacaatgtgatgaggaagtttcacggctataactccctgaaggaatactatgaggaagaaagttgcatgcggtacctgcacaggatttatgttcctctcatgctggttaatgcagctgacgatccgttggtgcatgaaagtcttctaaccattccaaaatctctttcagagaaacgagagaacgtcatgtttgtgctgcctctgcatgggggccacttgggcttctttgagggctctgtgctgttccccgagcccctgacatggatggataagctggtggtggagtacgccaacgccatttgccaatgggagcgtaacaagttgcagtgctctgacacggagcaggtggaggccgacctggagtga

SEQ ID NO: 8676 - DNA, 796 bp, synthetic construct
  misc_feature 1..796: note = Synthetic polypeptide
  source 1..796: mol_type = other DNA
ggccgggcgcggtggctcacacctgtaatcccagcactttgggaggccaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggtggccctattgtggaagaagatgatgaaataaatcgagattggttggattggacctattcagcagctacattttctgtttttctcagtatcctctacttctactcctccctgagcagattcctcatggtcatgggggccaccgttgttatgtacctgcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactga

SEQ ID NO: 8677 - DNA, 272 bp, synthetic construct
  misc_feature 1..272: note = Synthetic polypeptide
  source 1..272: mol_type = other DNA
ggccgggcgcggtggctcacacctgtaatcccagcactttgggaggccaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaacc

SEQ ID NO: 8678 - DNA, 226 bp, synthetic construct
  misc_feature 1..226: note = Synthetic polypeptide
  source 1..226: mol_type = other DNA
ggccgggcgcggtggctcacacctgtaatcccagcactttgggaggccaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaa

SEQ ID NO: 8679 - DNA, 175 bp, synthetic construct
  misc_feature 1..175: note = Synthetic polypeptide
  source 1..175: mol_type = other DNA
ggccgggcgcggtggctcacacctgtaatcccagcactttgggaggccaaggcctgaagctgcccagcaggcattccaaggcctgggtcctggtttctccggttacacaccctatgggtggcttcagctttcctggttccagcagatatatgcacgacagtactacatgcaatag

SEQ ID NO: 8680 - DNA, 1083 bp, synthetic construct; identical to SEQ ID NO: 7080
  misc_feature 1..1083: note = Synthetic polypeptide
  source 1..1083: mol_type = other DNA

SEQ ID NO: 8681 - DNA, 676 bp, synthetic construct
  misc_feature 1..676: note = Synthetic polypeptide
  source 1..676: mol_type = other DNA
tgtgatggttaatactgagtgtcaacttgatggcattgaatgatgcaaagtattgaccctgagtgtgtctgttaaggtgttgacaaaggagattaacatttgagtcactgggctggaaaaggcagacccacccttaatctgtgtgggcacaatctaatcagcttcagacacagccaggatataaagcaggaagaaaaacgtgaaaaggtttgactggcttagcctcccagcctacatctttctctcgtgctttatgcttcctgccctcaaacactggactccaagttcttcagctttggaactcgaactggcttccttttgctcctcagattatgctttgatgcggcctggaagaattgatagaatcatctatgtgcctttaccggatgcagcaacaagaagggaaatatttaagctgcagtttcactccatgcctgtcagtaatgaagttgacctggatgaactcatccttcaaaccgacgcatactcaggagcagagattgtagctgtctgcagagaggcagctcttctggctctggaagaagacattcaagccaatctcatcatgaaaagacatttcactcaggccttgagcactgtgacacctagaattcctgagtcattgagacgtttttatgaagattatcaagagaagagtgggctgcatacactctga

SEQ ID NO: 8682 - DNA, 3910 bp, synthetic construct
  misc_feature 1..3910: note = Synthetic polypeptide
  source 1..3910: mol_type = other DNA
gctgggtgtggtggctcacgcctataatcccagcactttgggaagccaaggctcttttaagacacttactcttccatcagaccccaaatcaaatttgatccaacagtggttgtcacaacaaagtgatcttggagtcatttccaaaacttttcagctatcttcccatccaatacttggtgactggtctattcaagttcaagtgaatgaccagacatactatcaatcatttcaggtttcagaatatgtattaccaaaatttgaagtgactttgcagacaccattatattgttctatgaattctaagcatttaaatggtaccatcacggcaaagtatacatatgggaagccagtgaaaggagacgtaacgcttacatttttacctttatccttttggggaaagaagaaaaatattacaaaaacatttaagataaatggatctgcaaacttctcttttaatgatgaagagatgaaaaatgtaatggattcttcaaatggactttctgaatacctggatctatcttcccctggaccagtagaaattttaaccacagtgacagaatcagttacaggtatttcaagaaatgtaagcactaatgtgttcttcaagcaacatgattacatcattgagttttttgattatactactgtcttgaagccatctctcaacttcacagccactgtgaaggtaactcgtgctgatggcaaccaactgactcttgaagaaagaagaaataatgtagtcataacagtgacacagagaaactatactgagtactggagcggatctaacagtggaaatcagaaaatggaagctgttcagaaaataaattatactgtcccccaaagtggaacttttaagattgaattcccaatcctggaggattccagtgagctacagttgaaggcctatttccttggtagtaaaagtagcatggcagttcatagtctgtttaagtctcctagtaagacatacatccaactaaaaacaagagatgaaaatataaaggtgggatcgccttttgagttggtggttagtggcaacaaacgattgaaggagttaagctatatggtagtatccaggggacagttggtggctgtaggaaaacaaaattcaacaatgttctctttaacaccagaaaattcttggactccaaaagcctgtgtaattgtgtattatattgaagatgatggggaaattataagtgatgttctaaaaattcctgttcagcttgtttttaaaaataagataaagctatattggagtaaagtgaaagctgaaccatctgagaaagtctctcttaggatctctgtgacacagcctgactccatagttgggattgtagctgttgacaaaagtgtgaatctgatgaatgcctctaatgatattacaatggaaaatgtggtccatgagttggaactttataacacaggatattatttaggcatgttcatgaattcttttgcagtctttcaggaatgtggactctgggtattgacagatgcaaacctcacgaaggattatattgatggtgtttatgacaatgcagaatatgctgagaggtttatggaggaaaatgaaggacatattgtagatattcatgacttttctttgggtagcagtccacatgtccgaaagcattttccagagacttggatttggctagacaccaacatgggttacaggatttaccaagaatttgaagtaactgtacctgattctatcacttcttgggtggctactggttttgtgatctctgaggacctgggtcttggactaacaactactccagtggagctccaagccttccaaccatttttcatttttttgaatcttccctactctgttatcagaggtgaagaatttgctttggaaataactatattcaattatttgaaagatgccactgaggttaaggtaatcattgagaaaagtgacaaatttgatattctaatgacttcaaatgaaataaatgccacaggccaccagcagacccttctggttcccagtgaggatggggcaactgttctttttcccatcaggccaacacatctgggagaaattcctatcacagtcacagctctttcacccactgcttctgatgctgtcacccagatgattttagtaaaggctgaaggaatagaaaaatcatattcacaatccatcttattagacttgactgacaataggctacagagtaccctgaaaactttgagtttctcatttcctcctaatacagtgactggcagtgaaagagttcagatcactgcaattggagatgttcttggtccttccatcaatggcttagcctcattgattcggatgccttatggctgtggtgaacagaacatgataaattttgctccaaatatttacattttggattatctgactaaaaagaaacaactgacagataatttgaaagaaaaagctctttcatttatgaggcaaggttaccagagagaacttctctatcagagggaagatggctctttcagtgcttttgggaattatgacccttctgggagcacttggttgtcagcttttgttttaagatgtttccttgaagccgatccttacatagatattgatcagaatgtgttacacagaacatacacttggcttaaaggacatcagaaatccaacggtgaattttgggatccaggaagagtgattcatagtgagcttcaaggtggcaataaaagtccagtaacacttacagcctatattgtaacttctctcctgggatatagaaagtatcagcctaacattgatgtgcaagagtctatccattttttggagtctgaattcagtagaggaatttcagacaattatactctagcccttataacttatgcattgtcatcagtggggagtcctaaagcgaaggaagctttgaatatgctgacttggagagcagaacaagaaggtggcatgcaattctgggtgtcatcagagtccaaactttctgactcctggcagccacgctccctggatattgaagttgcagcctatgcactgctctcacacttcttacaatttcagacttctgagggaatcccaattatgaggtggctaagcaggcaaagaaatagcttgggtggttttgcatctactcaggataccactgtggctttaaaggctctgtctgaatttgcagccctaatgaatacagaaaggacaaatatccaagtgaccgtgacggggcctagctcaccaagtcctgtaaagtttctgattgacacacacaaccgcttactccttcagacagcagagcttgctgtggtacagccaacggcagttaatatttccgcaaatggttttggatttgctatttgtcagctcaatgttgtatataatgtgaaggcttctgggtcttctagaagacgaagatctatccaaaatcaagaagcctttgatttagatgttgctgtaaaagaaaataaagatgatctcaatcatgtggatttgaatgtgtgtacaagcttttcgggcccgggtaggagtggcatggctcttatggaagttaacctattaagtggctttatggtgccttcagaagcaatttctctgagcgagacagtgaagaaagtggaatatgatcatggaaaactcaacctctatttagattctgtaaatgaaacccagttttgtgttaatattcctgctgtgagaaactttaaagtttcaaatacccaagatgcttcagtgtccatagtggattactatgagccaaggagacaggctgtgagaagttacaactctgaagtgaagctgtcctcctgtgacctttgcagtgatgtccagggctgccgtccttgtgaggatggagcttcaggctcccatcatcactcttcagtcatttttattttctgtttcaagcttctgtactttatggaactttggctgtga

SEQ ID NO: 8683 - DNA, 4090 bp, synthetic construct
  misc_feature 1..4090: note = Synthetic polypeptide
  source 1..4090: mol_type = other DNA
gctgggtgtggtggctcacgcctataatcccagcactttgggaagccaaggctcttttaagacacttactcttccatcactacctctgaacagtgcagatgagatttatgagctacgtgtaaccggacgtacccaggatgagattttattctctaatagtacccgcttatcatttgagaccaagagaatatctgtcttcattcaaacagacaaggccttatacaagccaaagcaagaagtgaagtttcgcattgttacactcttctcagattttaagccttacaaaacctctttaaacattctcattaaggaccccaaatcaaatttgatccaacagtggttgtcacaacaaagtgatcttggagtcatttccaaaacttttcagctatcttcccatccaatacttggtgactggtctattcaagttcaagtgaatgaccagacatactatcaatcatttcaggtttcagaatatgtattaccaaaatttgaagtgactttgcagacaccattatattgttctatgaattctaagcatttaaatggtaccatcacggcaaagtatacatatgggaagccagtgaaaggagacgtaacgcttacatttttacctttatccttttggggaaagaagaaaaatattacaaaaacatttaagataaatggatctgcaaacttctcttttaatgatgaagagatgaaaaatgtaatggattcttcaaatggactttctgaatacctggatctatcttcccctggaccagtagaaattttaaccacagtgacagaatcagttacaggtatttcaagaaatgtaagcactaatgtgttcttcaagcaacatgattacatcattgagttttttgattatactactgtcttgaagccatctctcaacttcacagccactgtgaaggtaactcgtgctgatggcaaccaactgactcttgaagaaagaagaaataatgtagtcataacagtgacacagagaaactatactgagtactggagcggatctaacagtggaaatcagaaaatggaagctgttcagaaaataaattatactgtcccccaaagtggaacttttaagattgaattcccaatcctggaggattccagtgagctacagttgaaggcctatttccttggtagtaaaagtagcatggcagttcatagtctgtttaagtctcctagtaagacatacatccaactaaaaacaagagatgaaaatataaaggtgggatcgccttttgagttggtggttagtggcaacaaacgattgaaggagttaagctatatggtagtatccaggggacagttggtggctgtaggaaaacaaaattcaacaatgttctctttaacaccagaaaattcttggactccaaaagcctgtgtaattgtgtattatattgaagatgatggggaaattataagtgatgttctaaaaattcctgttcagcttgtttttaaaaataagataaagctatattggagtaaagtgaaagctgaaccatctgagaaagtctctcttaggatctctgtgacacagcctgactccatagttgggattgtagctgttgacaaaagtgtgaatctgatgaatgcctctaatgatattacaatggaaaatgtggtccatgagttggaactttataacacaggatattatttaggcatgttcatgaattcttttgcagtctttcaggaatgtggactctgggtattgacagatgcaaacctcacgaaggattatattgatggtgtttatgacaatgcagaatatgctgagaggtttatggaggaaaatgaaggacatattgtagatattcatgacttttctttgggtagcagtccacatgtccgaaagcattttccagagacttggatttggctagacaccaacatgggttacaggatttaccaagaatttgaagtaactgtacctgattctatcacttcttgggtggctactggttttgtgatctctgaggacctgggtcttggactaacaactactccagtggagctccaagccttccaaccatttttcatttttttgaatcttccctactctgttatcagaggtgaagaatttgctttggaaataactatattcaattatttgaaagatgccactgaggttaaggtaatcattgagaaaagtgacaaatttgatattctaatgacttcaaatgaaataaatgccacaggccaccagcagacccttctggttcccagtgaggatggggcaactgttctttttcccatcaggccaacacatctgggagaaattcctatcacagtcacagctctttcacccactgcttctgatgctgtcacccagatgattttagtaaaggctgaaggaatagaaaaatcatattcacaatccatcttattagacttgactgacaataggctacagagtaccctgaaaactttgagtttctcatttcctcctaatacagtgactggcagtgaaagagttcagatcactgcaattggagatgttcttggtccttccatcaatggcttagcctcattgattcggatgccttatggctgtggtgaacagaacatgataaattttgctccaaatatttacattttggattatctgactaaaaagaaacaactgacagataatttgaaagaaaaagctctttcatttatgaggcaaggttaccagagagaacttctctatcagagggaagatggctctttcagtgcttttgggaattatgacccttctgggagcacttggttgtcagcttttgttttaagatgtttccttgaagccgatccttacatagatattgatcagaatgtgttacacagaacatacacttggcttaaaggacatcagaaatccaacggtgaattttgggatccaggaagagtgattcatagtgagcttcaaggtggcaataaaagtccagtaacacttacagcctatattgtaacttctctcctgggatatagaaagtatcagcctaacattgatgtgcaagagtctatccattttttggagtctgaattcagtagaggaatttcagacaattatactctagcccttataacttatgcattgtcatcagtggggagtcctaaagcgaaggaagctttgaatatgctgacttggagagcagaacaagaaggtggcatgcaattctgggtgtcatcagagtccaaactttctgactcctggcagccacgctccctggatattgaagttgcagcctatgcactgctctcacacttcttacaatttcagacttctgagggaatcccaattatgaggtggctaagcaggcaaagaaatagcttgggtggttttgcatctactcaggataccactgtggctttaaaggctctgtctgaatttgcagccctaatgaatacagaaaggacaaatatccaagtgaccgtgacggggcctagctcaccaagtcctcttgctgtggtacagccaacggcagttaatatttccgcaaatggttttggatttgctatttgtcagctcaatgttgtatataatgtgaaggcttctgggtcttctagaagacgaagatctatccaaaatcaagaagcctttgatttagatgttgctgtaaaagaaaataaagatgatctcaatcatgtggatttgaatgtgtgtacaagcttttcgggcccgggtaggagtggcatggctcttatggaagttaacctattaagtggctttatggtgccttcagaagcaatttctctgagcgagacagtgaagaaagtggaatatgatcatggaaaactcaacctctatttagattctgtaaatgaaacccagttttgtgttaatattcctgctgtgagaaactttaaagtttcaaatacccaagatgcttcagtgtccatagtggattactatgagccaaggagacaggctgtgagaagttacaactctgaagtgaagctgtcctcctgtgacctttgcagtgatgtccagggctgccgtccttgtgaggatggagcttcaggctcccatcatcactcttcagtcatttttattttctgtttcaagcttctgtactttatggaactttggctgtga

SEQ ID NO: 8684 - DNA, 4141 bp, synthetic construct
  misc_feature 1..4141: note = Synthetic polypeptide
  source 1..4141: mol_type = other DNA
gctgggtgtggtggctcacgcctataatcccagcactttgggaagccaaggctcttttaagacacttactcttccatcactacctctgaacagtgcagatgagatttatgagctacgtgtaaccggacgtacccaggatgagattttattctctaatagtacccgcttatcatttgagaccaagagaatatctgtcttcattcaaacagacaaggccttatacaagccaaagcaagaagtgaagtttcgcattgttacactcttctcagattttaagccttacaaaacctctttaaacattctcattaaggaccccaaatcaaatttgatccaacagtggttgtcacaacaaagtgatcttggagtcatttccaaaacttttcagctatcttcccatccaatacttggtgactggtctattcaagttcaagtgaatgaccagacatactatcaatcatttcaggtttcagaatatgtattaccaaaatttgaagtgactttgcagacaccattatattgttctatgaattctaagcatttaaatggtaccatcacggcaaagtatacatatgggaagccagtgaaaggagacgtaacgcttacatttttacctttatccttttggggaaagaagaaaaatattacaaaaacatttaagataaatggatctgcaaacttctcttttaatgatgaagagatgaaaaatgtaatggattcttcaaatggactttctgaatacctggatctatcttcccctggaccagtagaaattttaaccacagtgacagaatcagttacaggtatttcaagaaatgtaagcactaatgtgttcttcaagcaacatgattacatcattgagttttttgattatactactgtcttgaagccatctctcaacttcacagccactgtgaaggtaactcgtgctgatggcaaccaactgactcttgaagaaagaagaaataatgtagtcataacagtgacacagagaaactatactgagtactggagcggatctaacagtggaaatcagaaaatggaagctgttcagaaaataaattatactgtcccccaaagtggaacttttaagattgaattcccaatcctggaggattccagtgagctacagttgaaggcctatttccttggtagtaaaagtagcatggcagttcatagtctgtttaagtctcctagtaagacatacatccaactaaaaacaagagatgaaaatataaaggtgggatcgccttttgagttggtggttagtggcaacaaacgattgaaggagttaagctatatggtagtatccaggggacagttggtggctgtaggaaaacaaaattcaacaatgttctctttaacaccagaaaattcttggactccaaaagcctgtgtaattgtgtattatattgaagatgatggggaaattataagtgatgttctaaaaattcctgttcagcttgtttttaaaaataagataaagctatattggagtaaagtgaaagctgaaccatctgagaaagtctctcttaggatctctgtgacacagcctgactccatagttgggattgtagctgttgacaaaagtgtgaatctgatgaatgcctctaatgatattacaatggaaaatgtggtccatgagttggaactttataacacaggatattatttaggcatgttcatgaattcttttgcagtctttcaggaatgtggactctgggtattgacagatgcaaacctcacgaaggattatattgatggtgtttatgacaatgcagaatatgctgagaggtttatggaggaaaatgaaggacatattgtagatattcatgacttttctttgggtagcagtccacatgtccgaaagcattttccagagacttggatttggctagacaccaacatgggttacaggatttaccaagaatttgaagtaactgtacctgattctatcacttcttgggtggctactggttttgtgatctctgaggacctgggtcttggactaacaactactccagtggagctccaagccttccaaccatttttcatttttttgaatcttccctactctgttatcagaggtgaagaatttgctttggaaataactatattcaattatttgaaagatgccactgaggttaaggtaatcattgagaaaagtgacaaatttgatattctaatgacttcaaatgaaataaatgccacaggccaccagcagacccttctggttcccagtgaggatggggcaactgttctttttcccatcaggccaacacatctgggagaaattcctatcacagtcacagctctttcacccactgcttctgatgctgtcacccagatgattttagtaaaggctgaaggaatagaaaaatcatattcacaatccatcttattagacttgactgacaataggctacagagtaccctgaaaactttgagtttctcatttcctcctaatacagtgactggcagtgaaagagttcagatcactgcaattggagatgttcttggtccttccatcaatggcttagcctcattgattcggatgccttatggctgtggtgaacagaacatgataaattttgctccaaatatttacattttggattatctgactaaaaagaaacaactgacagataatttgaaagaaaaagctctttcatttatgaggcaaggttaccagagagaacttctctatcagagggaagatggctctttcagtgcttttgggaattatgacccttctgggagcacttggttgtcagcttttgttttaagatgtttccttgaagccgatccttacatagatattgatcagaatgtgttacacagaacatacacttggcttaaaggacatcagaaatccaacggtgaattttgggatccaggaagagtgattcatagtgagcttcaaggtggcaataaaagtccagtaacacttacagcctatattgtaacttctctcctgggatatagaaagtatcagcctaacattgatgtgcaagagtctatccattttttggagtctgaattcagtagaggaatttcagacaattatactctagcccttataacttatgcattgtcatcagtggggagtcctaaagcgaaggaagctttgaatatgctgacttggagagcagaacaagaaggtggcatgcaattctgggtgtcatcagagtccaaactttctgactcctggcagccacgctccctggatattgaagttgcagcctatgcactgctctcacacttcttacaatttcagacttctgagggaatcccaattatgaggtggctaagcaggcaaagaaatagcttgggtggttttgcatctactcaggataccactgtggctttaaaggctctgtctgaatttgcagccctaatgaatacagaaaggacaaatatccaagtgaccgtgacggggcctagctcaccaagtcctgtaaagtttctgattgacacacacaaccgcttactccttcagacagcagagcttgctgtggtacagccaacggcagttaatatttccgcaaatggttttggatttgctatttgtcagctcaatgttgtatataatgtgaaggcttctgggtcttctagaagacgaagatctatccaaaatcaagaagcctttgatttagatgttgctgtaaaagaaaataaagatgatctcaatcatgtggatttgaatgtgtgtacaagcttttcgggcccgggtaggagtggcatggctcttatggaagttaacctattaagtggctttatggtgccttcagaagcaatttctctgagcgagacagtgaagaaagtggaatatgatcatggaaaactcaacctctatttagattctgtaaatgaaacccagttttgtgttaatattcctgctgtgagaaactttaaagtttcaaatacccaagatgcttcagtgtccatagtggattactatgagccaaggagacaggctgtgagaagttacaactctgaagtgaagctgtcctcctgtgacctttgcagtgatgtccagggctgccgtccttgtgaggatggagcttcaggctcccatcatcactcttcagtcatttttattttctgtttcaagcttctgtactttatggaactttggctgtga

SEQ ID NO: 8685 - DNA, 1995 bp, synthetic construct
  misc_feature 1..1995: note = Synthetic polypeptide
  source 1..1995: mol_type = other DNA
ctctccctcctctccccctccccctccccctctccccacggtctccctctccctctctttccacggtctccctctgatgcccagccgaggctggactgtactgctgccatctcggctcactgcaacctccctgcctgattctcctgcctcagcctgccaagtgcctgcgattgcaggcacgcgccgccacgcctgactggttttcgtatttttttggtggagacggggtttcgctgtgttggctgggctggtctccaactcctaaccgcgagtgatccgccagcctcggcatcccgaggtgccgggattgcagacggagtctcgttcactcagtgctcagtggtgcccaggctggagtgcagtggcgtgatctcggctcgctacaacctccacctcccagccgcctgccttggcctcccaaagtgccgagattgcagcctctgcccggccgccaccctgtctgggaagtgaggagcgcctcttcccggccgcccattgtctgggatgtgaggagcccctctgcctggctgcccagtctggaaagtgaggagcgtctctgccgggccgccatcccatctaggaagtgaggagcgcctcttcccggccgccatcccatctaggaagtgaggagcgtctctgcccgctgcccatcgtctgagatgtggggagcgcctctgccctgctgccccgtctgggatgtgaggagcgtctctgcccggctgccccgtctgagaagtgaggagaccctctgcctggcaactgccccgtctgagaagtgcggagcccctccgcccggcagccaccccgtctgagaaaattgcagatttccaggatgtcctgaaggagccctcaattgcattggaaaagctgcgggaactcagctttagtggcatcccctgtgagggcggactgcggtgcctctgctggaagattctcttgaactaccttcccttggagagagcctcatggacctccatcctggccaagcagagggagctgtatgcccagttcctgagggaaatgatcatccagcctggcattgccaaggccaacatgggtgtgtccagggaggatgtgacttttgaggaccatccactcaaccccaaccctgacagccggtggaacacgtacttcaaggacaacgaggtgctgctgcagatcgacaaagatgtccggaggttgtgcccagacatttccttcttccagagggccactgactacccttgcctcctcatcctggacccccagaatgagtttgaaacccttcgtaagagagtggaacagacaacactgaaatctcagacggtggcccggaaccggagtggggtcacaaatatgagctccccacacaagaactctgtgccatcatccctaaatgagtatgaggtgctgcccaatggctgtgaggcccactgggaggtggtggagcggatcctgttcatctacgccaagctcaaccctggcatcgcttatgtgcaaggcatgaatgaaatcgtggggcccctctactacacctttgccaccgaccccaatagtgagtggaaagagcacgccgaggcagacacctttttctgcttcaccaacctcatggccgagatccgggacaactttatcaagagcctggatgactcgcagtgtggcatcacctacaagatggagaaggtttactccaccttgaaagataaggatgtggagctctacctgaaactgcaagagcagaacatcaagcctcagttctttgccttccgctggctgacactgctgctgtcccaggagttcttgctgcctgacgtcatccgcatctgggactccctcttcgccgatgacaaccgctttgacttcctcctcctcgtctgctgcgccatgctcatgctgatccgggagcagttgctggaaggggacttcactgtgaatatgcggctgctgcaggactaccccatcacagatgtctgccagatcctgcagaaagccaaggagctccaagactcaaagtag

SEQ ID NO: 8686 - DNA, 1620 bp, synthetic construct
  misc_feature 1..1620: note = Synthetic polypeptide
  source 1..1620: mol_type = other DNA
ctctccctcctctccccctccccctccccctctccccacggtctccctctccctctctttccacggtctccctctgatgcccagccgaggctggactgtactgctgccatctcggctcactgcaacctccctgcctgattctcctgcctcagcctgccaagtgcctgcgattgcaggcacgcgccgccacgcctgactggttttcgtatttttttggtggagacggggtttcgctgtgttggctgggctggtctccaactcctaaccgcgagtgatccgccagcctcggcatcccgaggtgccgggattgcagacggagtctcgttcactcagtgctcagtggtgcccaggctggagtgcagtggcgtgatctcggctcgctacaacctccacctcccagccgcctgccttggcctcccaaagtgccgagattgcagcctctgcccggccgccaccctgtctgggaagtgaggagcgcctcttcccggccgcccattgtctgggatgtgaggagcccctctgcctggctgcccagtctggaaagtgaggagcgtctctgccgggccgccatcccatctaggaagtgaggagcgcctcttcccggccgccatcccatctaggaagtgaggagcgtctctgcccgctgcccatcgtctgagatgtggggagcgcctctgccctgctgccccgtctgggatgtgaggagcgtctctgcccggctgccccgtctgagaagtgaggagaccctctgcctggcaactgccccgtctgagaagtgcggagcccctccgcccggcagccaccccgtctgagaaaattgcagatttccaggatgtcctgaaggagccctcaattgcattggaaaagctgcgggaactcagctttagtggcatcccctgtgagggcggactgcggtgcctctgctggaagattctcttgaactaccttcccttggagagagcctcatggacctccatcctggccaagcagagggagctgtatgcccagttcctgagggaaatgatcatccagcctggcattgccaaggccaacatgggtgtgtccagggaggatgtgacttttgaggaccatccactcaaccccaaccctgacagccggtggaacacgtacttcaaggacaacgaggtgctgctgcagatcgacaaagatgtccggaggttgtgcccagacatttccttcttccagagggccactgactacccttgcctcctcatcctggacccccagaatgagtttgaaacccttcgtaagagagtggaacagacaacactgaaatctcagacggtggcccggaaccggagtggggtcacaaatcaagagcagaacatcaagcctcagttctttgccttccgctggctgacactgctgctgtcccaggagttcttgctgcctgacgtcatccgcatctgggactccctcttcgccgatgacaaccgctttgacttcctcctcctcgtctgctgcgccatgctcatgctgatccgggagcagttgctggaaggggacttcactgtgaatatgcggctgctgcaggactaccccatcacagatgtctgccagatcctgcagaaagccaaggagctccaagactcaaagtag

SEQ ID NO: 8687 - DNA, 1691 bp, synthetic construct; identical to SEQ ID NO: 7480
  misc_feature 1..1691: note = Synthetic polypeptide
  source 1..1691: mol_type = other DNA

SEQ ID NO: 8688 - DNA, 1727 bp, synthetic construct; identical to SEQ ID NO: 7481
  misc_feature 1..1727: note = Synthetic polypeptide
  source 1..1727: mol_type = other DNA

SEQ ID NO: 8689 - DNA, 629 bp, synthetic construct; identical to SEQ ID NO: 7482
  misc_feature 1..629: note = Synthetic polypeptide
  source 1..629: mol_type = other DNA

SEQ ID NO: 8690 - DNA, 1553 bp, synthetic construct; identical to SEQ ID NO: 7483
  misc_feature 1..1553: note = Synthetic polypeptide
  source 1..1553: mol_type = other DNA

SEQ ID NO: 8691 - DNA, 959 bp, synthetic construct
  misc_feature 1..959: note = Synthetic polypeptide
  source 1..959: mol_type = other DNA
cacggtctccctctcatgcggagccgaagctggactgtactgctgccatctcggctcactgcaacctccctgcctgattctcctgcctcagcctgccgagtgcctgcgattgcaggcacgcgccgccacgcctgactggttttggtggagaccgggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcactacaacctacacctcccagccgcctgccttggcctcccaaagtgccgagattgcagcctctgcccggccgccaccccgtctgggaagtgaggagtgtctctgcctggccgcccatcgtcggggatgtgaggagcccctctgcctggctgcccagtctggaaagtgaggagcgtctccacccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagtgcctctgcccggccgagaccccgtctgggaggtgaggagcgtctctgcccggccgccccgtctgagaagtgaggagaccctctgcctggcaaccaccccgtctgagaagtgagcatatgacggaggaggagatgttggattgctttgcttcactgtttggcctgaatcccgagggatggaaatccgagcctgcaacctgctccgtcaaaggttcagaaatttgccttgaagaagaacttccagacgaaatcactgcagaaatattcgcgactgaaattcttggcttaaccatttcagaagattccggccaggatggtcagtga

SEQ ID NO: 8692 - DNA, 316 bp, synthetic construct
  misc_feature 1..316: note = Synthetic polypeptide
  source 1..316: mol_type = other DNA
ggccgggcgcggtggctcacgcctgtaatcccagcactttgggaggccgaggcgggcagatcacgaggtgctgcttcgcgtaaaagaaaacgaactccagtacctaaagaaggaggtgcagtgcctccgggacgagctccagatgatgcagaaggacaagcgcttcacctcgggaaagtaccaggacgtctatgtggagctgagccacatcaagacacggtctgagcgggagatcgagcagctgaaggagcacctgcgtcttgccatggccgccctccaggagaaggagtcgatgcgcaacagcctggctgagtag

SEQ ID NO: 8693 - DNA, 1382 bp, synthetic construct
  misc_feature 1..1382: note = Synthetic polypeptide
  source 1..1382: mol_type = other DNA
ttctcccaaaagcttatccccagtctaataagaaaaacatcagacaaattccagtagaggggcatcctacaagatacctgaccagcattcccaaaattgtcacagcgaagaggagcttatggagacatgcaactaagcataatgtggtgtcctagatggaatcgtggaacagaaatagctcctggtggacccatgtggaaatgggacctccagatcccattctgggagtcactgaagcctttaagagggacaccaatagcaaaaagatgaatctgggagttggtgcctaccgggatgataatggaaagccttacgttctgcctagcgtccgcaaggcagaggcccagattgccgcaaaaaatttggacaaggaatacctgcccattgggggactggctgaattttgcaaggcatctgcagaactagccctgggtgagaacagcgaagtcttgaagagtggccggtttgtcactgtgcagaccatttctggaactggagccttaaggatcggagccagttttctgcaaagattttttaagttcagccgagatgtctttctgcccaaaccaacctggggaaaccacacacccatcttcagggatgctggcatgcagctacaaggttatcggtattatgaccccaagacttgcggttttgacttcacaggcgctgtggaggatatttcaaaaataccagagcagagtgttcttcttctgcatgcctgcgcccacaatcccacgggagtggacccgcgtccggaacagtggaaggaaatagcaacagtggtgaagaaaaggaatctctttgcgttctttgacatggcctaccaaggctttgccagtggtgatggtgataaggatgcctgggctgtgcgccacttcatcgaacagggcattaatgtttgcctctgccaatcatatgccaagaacatgggcttatatggtgagcgtgtaggagccttcactatggtctgcaaagatgcggatgaagccaaaagggtagagtcacagttgaagatcttgatccgtcccatgtattccaaccctcccctcaatggggcccggattgctgctgccattctgaacaccccagatttgcgaaaacaatggctgcaagaagtgaaagtcatggctgaccgcatcattggcatgcggactcaactggtctccaacctcaagaaggagggttccacccacaattggcaacacatcaccgaccaaattggcatgttctgtttcacagggctaaagcctgaacaggtggagcggctgatcaaggagttctccatctacatgacaaaagatggccgcatctctgtggcaggggtcacctccagcaacgtgggctaccttgcccatgccattcaccaggtcaccaagtaa

SEQ ID NO: 8694 - DNA, 1253 bp, synthetic construct
  misc_feature 1..1253: note = Synthetic polypeptide
  source 1..1253: mol_type = other DNA
ttctcccaaaagcttatccccagtctaataagaaaaacatcagacaaattccagtagaggggcatcctacaagatacctgaccagcattcccaaaattgtcacagcgaagaggagcttatggagacatgcaactaagcataatgtggtgtcctagatggaatcgtggaacagaaatagctcctggtggacccatgtggaaatgggacctccagatcccattctgggagtcactgaagcctttaagagggacaccaatagcaaaaagatgaatctgggagttggtgcctaccgggatgataatggaaagccttacgttctgcctagcgtccgcaagtttgtcactgtgcagaccatttctggaactggagccttaaggatcggagccagttttctgcaaagattttttaagttcagccgagatgtctttctgcccaaaccaacctggggaaaccacacacccatcttcagggatgctggcatgcagctacaaggttatcggtattatgaccccaagacttgcggttttgacttcacaggcgctgtggaggatatttcaaaaataccagagcagagtgttcttcttctgcatgcctgcgcccacaatcccacgggagtggacccgcgtccggaacagtggaaggaaatagcaacagtggtgaagaaaaggaatctctttgcgttctttgacatggcctaccaaggctttgccagtggtgatggtgataaggatgcctgggctgtgcgccacttcatcgaacagggcattaatgtttgcctctgccaatcatatgccaagaacatgggcttatatggtgagcgtgtaggagccttcactatggtctgcaaagatgcggatgaagccaaaagggtagagtcacagttgaagatcttgatccgtcccatgtattccaaccctcccctcaatggggcccggattgctgctgccattctgaacaccccagatttgcgaaaacaatggctgcaagaagtgaaagtcatggctgaccgcatcattggcatgcggactcaactggtctccaacctcaagaaggagggttccacccacaattggcaacacatcaccgaccaaattggcatgttctgtttcacagggctaaagcctgaacaggtggagcggctgatcaaggagttctccatctacatgacaaaagatggccgcatctctgtggcaggggtcacctccagcaacgtgggctaccttgcccatgccattcaccaggtcaccaagtaa

SEQ ID NO: 8695 - DNA, 625 bp, synthetic construct; identical to SEQ ID NO: 6804
  misc_feature 1..625: note = Synthetic polypeptide
  source 1..625: mol_type = other DNA

SEQ ID NO: 8696 - DNA, 598 bp, synthetic construct; identical to SEQ ID NO: 6805
  misc_feature 1..598: note = Synthetic polypeptide
  source 1..598: mol_type = other DNA

SEQ ID NO: 8697 - DNA, 127 bp, synthetic construct
  misc_feature 1..127: note = Synthetic polypeptide
  source 1..127: mol_type = other DNA
ggccaggtgcaatgggtcaagcctgcaatccccacaccaaggtgggagtattgcttgaaaccaggagttcaagaccagcctaggcaagaaagtattggcatactccacacatctgtaccattcttga

SEQ ID NO: 8698 - DNA, 689 bp, synthetic construct
  misc_feature 1..689: note = Synthetic polypeptide
  source 1..689: mol_type = other DNA
cagccgcctgccttggcctcccaaagtgccgagattgcagcctctgcccggccgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcagccgccatcacatctaggaagtgaggagcgtctctgcccggccgcccatcgtctgagatgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagccgccccgtctgagaagtgaggagcctctccacccggcagccaccccatctgggaatgctacagttgaaactccagcagcgccggacccgggaagaactggtgagccaagggatcatgccgcctttgaaaagtccagccgcatttcatgagcagagaaggagcttggagcgggccaggacagaggactatctcaaacggaagattcgttcccggccggagagatcggagctggtcaggatgcacattttggaag

SEQ ID NO: 8699 - DNA, 809 bp, synthetic construct
  misc_feature 1..809: note = Synthetic polypeptide
  source 1..809: mol_type = other DNA
cctggttctctggggcacgaggcttctcctcagcactctggcgcccccaacaggttcccagtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaagggaatgtgacagtccttcgtatcagaaaaggcagaggatggccctgttggcaaggaaacaaggagcaggagacagccttattgcaggctctgccatgtccaaagcaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 8700 - DNA, 394 bp, synthetic construct
  misc_feature 1..394: note = Synthetic polypeptide
  source 1..394: mol_type = other DNA
gtgactgcaggtgcaaacggaggttcttcagaagaggcagcaggagaaagcccatatgatgaatgctattaagaaatatcagaaaggcttctctgataaactggatttccttgagggagatcagaaacctctggcacagcgcaagaaggcaggagccaaaggccagcagatgaggaaggggcccagtgctaaacgacggtataaaaaccagaagtttggttttggtggaaagaagaaaggctcaaagtggaacactcgggagagctatgatgatgtatctagcttccgggccaagacagctcatggcagaggcctcaagaggcctggcaagaaagggtcaaataagagacctggaaaacgaacaagagagaagatgaagaacagaacacactaa

SEQ ID NO: 8701 - DNA, 809 bp, synthetic construct; identical to SEQ ID NO: 8699
  misc_feature 1..809: note = Synthetic polypeptide
  source 1..809: mol_type = other DNA

SEQ ID NO: 8702 - DNA, 740 bp, synthetic construct; identical to SEQ ID NO: 7794
  misc_feature 1..740: note = Synthetic polypeptide
  source 1..740: mol_type = other DNA

SEQ ID NO: 8703 - DNA, 1759 bp, synthetic construct; identical to SEQ ID NO: 6644
  misc_feature 1..1759: note = Synthetic polypeptide
  source 1..1759: mol_type = other DNA

SEQ ID NO: 8704 - DNA, 588 bp, synthetic construct
  misc_feature 1..588: note = Synthetic polypeptide
  source 1..588: mol_type = other DNA
ggccaggcgaggtggctcacacctgtaatcccagcactttgggaggccgaggcatgcggatcacctgagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgagaaaccagcctggacaccaagtctgtgtcagaaggccacctcaagaggaacatcgtggtgaagaccgtggagatgcgggatggagaggtcattaaggagtccaagcaggagcacaaggatgtgatgtga

SEQ ID NO: 8705 - DNA, 585 bp, synthetic construct
  misc_feature 1..585: note = Synthetic polypeptide
  source 1..585: mol_type = other DNA
ggccaggcgaggtggctcacacctgtaatcccagcactttgggaggccgaggcatgcggatcacctgagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgagggggcaaaagcaccaaagacggggaaaatcacaaggtcacaagatatctcaaaagcctcacaatacgagttataccaatacaggctcaccagattgtaaatggaacgccgccggctcgcggttag

SEQ ID NO: 8706 - DNA, 606 bp, synthetic construct
  misc_feature 1..606: note = Synthetic polypeptide
  source 1..606: mol_type = other DNA
ggccaggcgaggtggctcacacctgtaatcccagcactttgggaggccgaggcatgcggatcacctgagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgaggtcagtacagcagggcctcgtgggaagggcactggagtcctgccccctcctccagggcctgtaggttgctccagactgggactgaggatcagggcaaagggatccagctctccctgggggccttcgtgacactgcagcgctcctag

SEQ ID NO: 8707 - DNA, 384 bp, synthetic construct
  misc_feature 1..384: note = Synthetic polypeptide
  source 1..384: mol_type = other DNA
ggccaggcgaggtggctcacacctgtaatcccagcactttgggaggccgaggcatgcggatcacctgagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacc

SEQ ID NO: 8708 - DNA, 193 bp, synthetic construct
  misc_feature 1..193: note = Synthetic polypeptide
  source 1..193: mol_type = other DNA
ggccaggcgaggtggctcacacctgtaatcccagcactttgggaggccgaggcatgcggatcacctgagtttgcagacctgacagacgctgctgcccgcaacgcggagctgctccgccaggccaagcacgaagccaacgactaccggcgccagttgcagtccttgacctgcgacctggagtctctgcgcggca

SEQ ID NO: 8709 - DNA, 170 bp, synthetic construct
  misc_feature 1..170: note = Synthetic polypeptide
  source 1..170: mol_type = other DNA
ggccaggcgaggtggctcacacctgtaatcccagcactttgggaggccgaggcatgcggatcacctgagtttgcagacctgacagacgctgctgcccgcaacgcggagctgctccgccaggccaagcacgaagccaacgactaccggcgccagttgcagtccttgacctg

SEQ ID NO: 8710 - DNA, 168 bp, synthetic construct
  misc_feature 1..168: note = Synthetic polypeptide
  source 1..168: mol_type = other DNA
tggttctcaaagtgtggttcccagaacagcagcttcagcatcacctgagtttttaaaattgcatatccatccttggactcctccccagacctactgaatcagaaactctggagagacgttttctttggaccaaagatctctttcgtgattccttgcaacaatcaatga

SEQ ID NO: 8711 - DNA, 193 bp, synthetic construct; identical to SEQ ID NO: 7535
  misc_feature 1..193: note = Synthetic polypeptide
  source 1..193: mol_type = other DNA

SEQ ID NO: 8712 - DNA, 1066 bp, synthetic construct; identical to SEQ ID NO: 7536
  misc_feature 1..1066: note = Synthetic polypeptide
  source 1..1066: mol_type = other DNA

SEQ ID NO: 8713 - DNA, 1063 bp, synthetic construct; identical to SEQ ID NO: 7537
  misc_feature 1..1063: note = Synthetic polypeptide
  source 1..1063: mol_type = other DNA

SEQ ID NO: 8714 - DNA, 404 bp, synthetic construct; identical to SEQ ID NO: 7538
  misc_feature 1..404: note = Synthetic polypeptide
  source 1..404: mol_type = other DNA

SEQ ID NO: 8715 - DNA, 925 bp, synthetic construct; identical to SEQ ID NO: 7539
  misc_feature 1..925: note = Synthetic polypeptide
  source 1..925: mol_type = other DNA

SEQ ID NO: 8716 - DNA, 1093 bp, synthetic construct; identical to SEQ ID NO: 7540
  misc_feature 1..1093: note = Synthetic polypeptide
  source 1..1093: mol_type = other DNA

SEQ ID NO: 8717 - DNA, 261 bp, synthetic construct
  misc_feature 1..261: note = Synthetic polypeptide
  source 1..261: mol_type = other DNA
ggctggacgtggtggctcacgcctgtaattccaacactctgggaggccgaggcaggtggatcacttgaggtcaggagttcgagaccagcctggccaacatggcgaaaccccgtgtcttctaaaaatacaaaatttagccaggtgtgatggcatgcgcctgtaatcccagctactcagaggctgagaccaaaaagaagaatgtacttcatctggttgggctggattccctctgataagccttcccagttgactgaaagatga

SEQ ID NO: 8718 - DNA, 233 bp, synthetic construct
  misc_feature 1..233: note = Synthetic polypeptide
  source 1..233: mol_type = other DNA
ggctggacgtggtggctcacgcctgtaattccaacactctgggaggccgaggcaggtggatcacttgaggtcaggagttcgagaccagcctggccaacatggcgaaaccccgtgtcttctaaaaatacaaaatttagccaggtgtgatggcatgcgcctgtaatcccagctactcagaggctgagaccaaaaagaagaatgtacttcatctggttgggctggattccctctga

SEQ ID NO: 8719 - DNA, 560 bp, synthetic construct; identical to SEQ ID NO: 6322
  misc_feature 1..560: note = Synthetic polypeptide
  source 1..560: mol_type = other DNA

SEQ ID NO: 8720 - DNA, 735 bp, synthetic construct
  misc_feature 1..735: note = Synthetic polypeptide
  source 1..735: mol_type = other DNA
cctgggttctagacctggttctgccaattgcttgtcatgtgatgttgggttgaaaaaaatgatgacgaccaaaagattgaacaagatggtatcaaaccagaagataaagctcataaggccgcaaccaaaattcaggctagcttccgtggacacataacaaggaaaaagctcaaaggagagaagaaggatgatgtccaagctgctgaggctgaagctaataagaaggatgaagcccctgttgccgatggggtggagaagaagggagaaggcaccactactgccgaagcagccccagccactggctccaagcctgatgagcccggcaaagcaggagaaactccttccgaggagaagaagggggagggtgatgctgccacagagcaggcagccccccaggctcctgcatcctcagaggagaaggccggctcagctgagacagaaagtgccactaaagcttccactgataactcgccgtcctccaaggctgaagatgccccagccaaggaggagcctaaacaagccgatgtgcctgctgctgtcactgctgctgctgccaccacccctgccgcagaggatgctgctgccaaggcaacagcccagcctccaacggagactggggagagcagccaagctgaagagaacatagaagctgtagatgaaaccaaacctaaggaaagtgcccggcaggacgagggtaaagaagaggaacctgaggctgaccaagaacatgcctga

SEQ ID NO: 8721 - DNA, 1133 bp, synthetic construct; identical to SEQ ID NO: 7332
  misc_feature 1..1133: note = Synthetic polypeptide
  source 1..1133: mol_type = other DNA

SEQ ID NO: 8722 - DNA, 1172 bp, synthetic construct; identical to SEQ ID NO: 7333
  misc_feature 1..1172: note = Synthetic polypeptide
  source 1..1172: mol_type = other DNA

SEQ ID NO: 8723 - DNA, 871 bp, synthetic construct; identical to SEQ ID NO: 437
  misc_feature 1..871: note = Synthetic polypeptide
  source 1..871: mol_type = other DNA

SEQ ID NO: 8724 - DNA, 421 bp, synthetic construct; identical to SEQ ID NO: 441
  misc_feature 1..421: note = Synthetic polypeptide
  source 1..421: mol_type = other DNA

SEQ ID NO: 8725 - DNA, 638 bp, synthetic construct; identical to SEQ ID NO: 442
  misc_feature 1..638: note = Synthetic polypeptide
  source 1..638: mol_type = other DNA

SEQ ID NO: 8726 - DNA, 337 bp, synthetic construct; identical to SEQ ID NO: 443
  misc_feature 1..337: note = Synthetic polypeptide
  source 1..337: mol_type = other DNA

SEQ ID NO: 8727 - DNA, 148 bp, synthetic construct; identical to SEQ ID NO: 6388
  misc_feature 1..148: note = Synthetic polypeptide
  source 1..148: mol_type = other DNA

SEQ ID NO: 8728 - DNA, 1100 bp, synthetic construct; identical to SEQ ID NO: 6389
  misc_feature 1..1100: note = Synthetic polypeptide
  source 1..1100: mol_type = other DNA

SEQ ID NO: 8729 - DNA, 464 bp, synthetic construct; identical to SEQ ID NO: 6390
  misc_feature 1..464: note = Synthetic polypeptide
  source 1..464: mol_type = other DNA

SEQ ID NO: 8730 - DNA, 280 bp, synthetic construct; identical to SEQ ID NO: 6391
  misc_feature 1..280: note = Synthetic polypeptide
  source 1..280: mol_type = other DNA

SEQ ID NO: 8731 - DNA, 369 bp, synthetic construct; identical to SEQ ID NO: 7297
  misc_feature 1..369: note = Synthetic polypeptide
  source 1..369: mol_type = other DNA

SEQ ID NO: 8732 - DNA, 1029 bp, synthetic construct
  misc_feature 1..1029: note = Synthetic polypeptide
  source 1..1029: mol_type = other DNA
ggacaggcgcggtggctcacgcctgtaatcccagcacttgggaggccaaggcagccggatcacctgaggtcaggagttcaagcagccacgtcacctgagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggccctcagtaccgcctggagaagcagagcgagcccaatgtcgccgttgacctggacagcactttggagagccagagcgcatgggagttctgcctggtccgcgagaacagtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtga

SEQ ID NO: 8733 - DNA, 1170 bp, synthetic construct
  misc_feature 1..1170: note = Synthetic polypeptide
  source 1..1170: mol_type = other DNA
ggacaggcgcggtggctcacgcctgtaatcccagcacttgggaggccaaggcagccggatcacctgaggtcaggagttcaagcagccacgtcacctgagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggccctcagtaccgcctggagaagcagagcgagcccaatgtcgccgttgacctggacagcactttggagagccagagcgcatgggagttctgcctggtccgcgagaacagttcaagggcagacggggtttttgaggaggattcgcaaattgacatagccacagtacaggatatgcttagcagccaccattacaagtcattcaaagtcagcatgatccacagactgcgattcacaaccgacgtacagctaggtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtga

SEQ ID NO: 8734 - DNA, 1062 bp, synthetic construct
  misc_feature 1..1062: note = Synthetic polypeptide
  source 1..1062: mol_type = other DNA
ggacaggcgcggtggctcacgcctgtaatcccagcacttgggaggccaaggcagccggatcacctgaggtcaggagttcaagcagccacgtcacctgagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggttcaagggcagacggggtttttgaggaggattcgcaaattgacatagccacagtacaggatatgcttagcagccaccattacaagtcattcaaagtcagcatgatccacagactgcgattcacaaccgacgtacagctaggtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtga

SEQ ID NO: 8735 - DNA, 573 bp, synthetic construct
  misc_feature 1..573: note = Synthetic polypeptide
  source 1..573: mol_type = other DNA
ggacaggcgcggtggctcacgcctgtaatcccagcacttgggaggccaaggcagccggatcacctgaggtcaggagttcaagcagccacgtcacctgagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggtgcttgtgactaa

SEQ ID NO: 8736 - DNA, 299 bp, synthetic construct
  misc_feature 1..299: note = Synthetic polypeptide
  source 1..299: mol_type = other DNA
ggacaggcgcggtggctcacgcctgtaatcccagcacttgggaggccaaggcagccggatcacctgaggtcaggagttcaagcagccacgtcacctgagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgca

SEQ ID NO: 8737 - DNA, 1290 bp, synthetic construct; identical to SEQ ID NO: 6392
  misc_feature 1..1290: note = Synthetic polypeptide
  source 1..1290: mol_type = other DNA

SEQ ID NO: 8738 - DNA, 1047 bp, synthetic construct
  misc_feature 1..1047: note = Synthetic polypeptide
  source 1..1047: mol_type = other DNA
aacaccactggccaagaattggtaattgtggaagccagatggagatgattggtatatggaggctgcatagagcctggacctgggcactggggtgagctgagccggacaccagtcccatctaaaccccaggacaaagtggaagcagctgaggcaacaccagtggccctggacagtgacacctccggggctgaaaatgcagcagtgagtgctatgctgcacgctgtagccgccagccgcctgcctgtttgcagccagcagcagggtgaacccgacttgacagagcatgagaaagtggccatcctggcccagctgtaccacgagaagccactggtgttcctggagcgcttccgcacaggcctccgtgaggagcatctggcctgctttggccacgtgcgtggcgaccaccgtgcagacttctactgtgctgaggtggcccggcagggcactgcccggccccgcaccctgcgtacccgcctgcgtaaccggcgctatgctgccctgcgagagctgatccaagggggcgagtacttcagtgatgagcagatgcggttccgggcccccctgctatatgagcagtacatcgggcagtatctcacccaggaggagctcagtgcccgcaccccaacccaccagccccccaagcccgggtcccccgggagacctgcttgcccgctctccaacttgctgctccagtcctacgaggagcgggagctacagcagcgtctgctccaacagcaggaggaggaggaggcctgcttggaggaagaggaagaggaggaggacagtgacgaggaagaccagaggtcaggcaaggactcggaggcctgggttcccgactcggaggagaggctgatcctgcgagaggagttcaccagccgcatgcaccagcgcttcctagatggcaaggacggggactttgactacagcacagtagacgacaaccccgacttcgacaacctcgacatcgtggcacgggatgaggaggagaggtactttgatgaggaagaacctgaggatgcgcccagcccagagctggatggggactga

SEQ ID NO: 8739 - DNA, 756 bp, synthetic construct
  misc_feature 1..756: note = Synthetic polypeptide
  source 1..756: mol_type = other DNA
cagggccacctggtaaaggtatggaggtgagccagccatgagagggtatcttgtggccatattcctgagtgctgtcttcctctattatgtactgcattgcatattatggggaacgaatgtctattgggtggcacctgtggaaatgaaacggagaaataagatccagccttgtttatcaaagccagcttttgcctctctgctgaggtttcatcagtttcacccttttctgtgtgcggctgattttagaaagattgcttccttgtatggtagcgataagtttgatttgccctatgggatgagaacatcagcggaatattttcgacttgctctttcaaaactgcagagttgtgatctctttgatgagtttgacaacataccctgtaaaaagtgtgtggtggttggtaatggaggagttttgaagaataagacattaggagaaaaaatcgactcctatgatgtaataataagaatgaataatggtcctgttttaggacatgaagaagaagttgggagaaggacaaccttccgacttttttatccagaatctgttttttcagatcctattcacaatgaccctaatacgacagtgattctcactgcttttaagccacatgatttaaggtggctgttggaattgttgatgggtgacaaaataaacactaatggtttttggaagaaaccagccttaaacctgatttataaaccttatcaaatccgaatattagatcctttcattatcagaacagcagcttatga

SEQ ID NO: 8740 - DNA, 742 bp, synthetic construct; identical to SEQ ID NO: 6357
  misc_feature 1..742: note = Synthetic polypeptide
  source 1..742: mol_type = other DNA

SEQ ID NO: 8741 - DNA, 590 bp, synthetic construct; identical to SEQ ID NO: 6358
  misc_feature 1..590: note = Synthetic polypeptide
  source 1..590: mol_type = other DNA

SEQ ID NO: 8742 - DNA, 577 bp, synthetic construct; identical to SEQ ID NO: 6359
  misc_feature 1..577: note = Synthetic polypeptide
  source 1..577: mol_type = other DNA

SEQ ID NO: 8743 - DNA, 430 bp, synthetic construct; identical to SEQ ID NO: 6360
  misc_feature 1..430: note = Synthetic polypeptide
  source 1..430: mol_type = other DNA

SEQ ID NO: 8744 - DNA, 670 bp, synthetic construct; identical to SEQ ID NO: 6361
  misc_feature 1..670: note = Synthetic polypeptide
  source 1..670: mol_type = other DNA

SEQ ID NO: 8745 - DNA, 1293 bp, synthetic construct
  misc_feature 1..1293: note = Synthetic polypeptide
  source 1..1293: mol_type = other DNA
gcgagaacacggttttgggaggtcatcagtgatgagcatgggattgaccccactggcagttaccatggagacagtgatttgcagctggagagaatcaatgtttactacaatgaagccactggtaacaaatatgttcctcgggccatcctcgtggatctggagccaggcacgatggattcggttaggtctggaccattcggccagatcttcagaccagacaatttcgtgtttggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccaccagctggtggaaaacacagatgaaacctactgcattgacaacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcgtag

SEQ ID NO: 8746 - DNA, 147 bp, synthetic construct; identical to SEQ ID NO: 6327
  misc_feature 1..147: note = Synthetic polypeptide
  source 1..147: mol_type = other DNA

SEQ ID NO: 8747 - DNA, 1833 bp, synthetic construct
  misc_feature 1..1833: note = Synthetic polypeptide
  source 1..1833: mol_type = other DNA
ttttctatctcagtccaaggaaagggcctagaagccccagtaagaatgaatatttccagggactagattttgggttccaaatatggtttcccaccaaaaggaggcaatgttttttagagaagttcctgatttcttaatgtggggcaaagaagtcctggaacatattgtgttggaaagcaagaacgtgctcaaaaactgatggaaacatgtcaaaaaggcacaggagcctatttgaaagtttcctaccatcaaaacttgaaacaatttgaacatctaaaagaataatggtaggtatggattataacacattatgtgagagagaatttgtaagtccgtaattatactttaaaattaaaaaaaactcactttgttacaaagagaaaaaatggggaaatatacagttgttctttacagaagaaatgacacttaaaatgtagaaaaaatataaaattacaaaatcactaatttgcactaatgattgactccaggcaaggatcatcagtcattggatgttaaaaccattggaagaaaggctgtaggtgaacaggatatttacatggtctcaaggtggaaaacagaccaaagtattatggaagagagtttcatggcatgatctccagagaagcagccgaccagctcttgattgtggctgaggggagctacctcatccgggagagccagcggcagccagggacctacactttggctttaagatttggaagtcaaaccagaaacttcaggctctactacgatggcaagcactttgttggggagaaacgctttgagtccatccacgatctggtgactgatggcttgattactctctatattgaaaccaaggcagcagaatacattgccaagatgacgataaacccaatttatgagcacgtaggatacacaaccttaaacagagagccagcatacaaaaaacatatgccagtcctgaaagagacacatgatgagagagattctacaggccaggatggggtgtcagagaaaaggttgacatcacttgttagaagagcaactctgaaagaaaacgagcaaattccaaaatatgaaaagattcacaatttcaaggtgcatacattcagagggccacactggtgtgaatactgtgccaactttatgtggggtctcattgctcagggagtgaaatgtgcagattgtggtttgaatgttcataagcagtgttccaagatggtcccaaatgactgtaagccagacttgaagcatgtcaaaaaggtgtacagctgtgaccttacgacgctcgtgaaagcacataccactaagcggccaatggtggtagacatgtgcatcagggagattgagtctagaggtcttaattctgaaggactataccgagtatcaggatttagtgacctaattgaagatgtcaagatggctttcgacagagatggtgagaaggcagatatttctgtgaacatgtatgaagatatcaacattatcactggtgcacttaaactgtacttcagggatttgccaattccactcattacatatgatgcctaccctaagtttatagaatctgccaaaattatggatccggatgagcaattggaaacccttcatgaagcactgaaactactgccacctgctcactgcgaaaccctccggtacctcatggcacatctaaagagagtgaccctccacgaaaaggagaatcttatgaatgcagagaaccttggaatcgtctttggacccacccttatgagatctccagaactagacgccatggctgcattgaatgatatacggtatcagagactggtggtggagctgcttatcaaaaacgaagacattttattttaa

SEQ ID NO: 8748 - DNA, 1755 bp, synthetic construct
  misc_feature 1..1755: note = Synthetic polypeptide
  source 1..1755: mol_type = other DNA
ttttctatctcagtccaaggaaagggcctagaagccccagtaagaatgaatatttccagggactagattttgggttccaaatatggtttcccaccaaaaggaggcaatgttttttagagaagttcctgatttcttaatgtggggcaaagaagtcctggaacatattgtgttggaaagcaagaacgtgctcaaaaactgatggaaacatgtcaaaaaggcacaggagcctatttgaaagtttcctaccatcaaaacttgaaacaatttgaacatctaaaagaataatggtaggtatggattataacacattatgtgagagagaatttgtaagtccgtaattatactttaaaattaaaaaaaactcactttgttacaaagagaaaaaatggggaaatatacagttgttctttacagaagaaatgacacttaaaatgtagaaaaaatataaaattacaaaatcactaatttgcactaatgattgactccaggcaaggatcatcagtcattggatgttaaaaccattggaagaaaggctgtaggtgaacaggatatttacatggtctcaaggtggaaaacagaccaaagtattatggaagagagtttcatggcatgatctccagagaagcagccgaccagctcttgattgtggctgaggggagctacctcatccgggagagccagcggcagccagggacctacactttggctttaagatttggaagtcaaaccagaaacttcaggctctactacgatggcaagcactttgttggggagaaacgctttgagtccatccacgatctggtgactgatggcttgattactctctatattgaaaccaaggcagcagaatacattgccaagatgacgataaacccaatttatgagcacgtaggatacacaaccttaaacagagagccagcatacaaaaaacatatgccagtcctgaaagagacacatgatgagagagattctacaggccaggatggggtgtcagagaaaagggtgcatacattcagagggccacactggtgtgaatactgtgccaactttatgtggggtctcattgctcagggagtgaaatgtgcagattgtggtttgaatgttcataagcagtgttccaagatggtcccaaatgactgtaagccagacttgaagcatgtcaaaaaggtgtacagctgtgaccttacgacgctcgtgaaagcacataccactaagcggccaatggtggtagacatgtgcatcagggagattgagtctagaggtcttaattctgaaggactataccgagtatcaggatttagtgacctaattgaagatgtcaagatggctttcgacagagatggtgagaaggcagatatttctgtgaacatgtatgaagatatcaacattatcactggtgcacttaaactgtacttcagggatttgccaattccactcattacatatgatgcctaccctaagtttatagaatctgccaaaattatggatccggatgagcaattggaaacccttcatgaagcactgaaactactgccacctgctcactgcgaaaccctccggtacctcatggcacatctaaagagagtgaccctccacgaaaaggagaatcttatgaatgcagagaaccttggaatcgtctttggacccacccttatgagatctccagaactagacgccatggctgcattgaatgatatacggtatcagagactggtggtggagctgcttatcaaaaacgaagacattttattttaa

SEQ ID NO: 8749 - DNA, 792 bp, synthetic construct; identical to SEQ ID NO: 6418
  misc_feature 1..792: note = Synthetic polypeptide
  source 1..792: mol_type = other DNA

SEQ ID NO: 8750 - DNA, 369 bp, synthetic construct; identical to SEQ ID NO: 6419
  misc_feature 1..369: note = Synthetic polypeptide
  source 1..369: mol_type = other DNA

SEQ ID NO: 8751 - DNA, 249 bp, synthetic construct; identical to SEQ ID NO: 6420
  misc_feature 1..249: note = Synthetic polypeptide
  source 1..249: mol_type = other DNA

SEQ ID NO: 8752 - DNA, 369 bp, synthetic construct; identical to SEQ ID NO: 6421
  misc_feature 1..369: note = Synthetic polypeptide
  source 1..369: mol_type = other DNA

SEQ ID NO: 8753 - DNA, 843 bp, synthetic construct; identical to SEQ ID NO: 6422
  misc_feature 1..843: note = Synthetic polypeptide
  source 1..843: mol_type = other DNA

SEQ ID NO: 8754 - DNA, 906 bp, synthetic construct
  misc_feature 1..906: note = Synthetic polypeptide
  source 1..906: mol_type = other DNA
cagttgacccttgaacacttgaacaacacaggtttggacatcgagggtccactgataatgtggattttcttccacctctgccacccctgagacagcaagacaaatacctcctcttcctcttcctccttcttcccagcctactcaacatgaagacaatgaagatgaagagctttatgatgatccactccgacttaattaataattgtctacatgggctggtgtgaagcccgggagcaagaccccctccaggacagagtgtactccccgaccttcctggccctgaggggctcatgtctctacaagtttctggcacctccagtgaccacctgggactggacgagagcagagaaaacattctcagtttatgagattatgtgcaagatcctcaaggacagtgacctgctggaccgacggaaacagtgcttcaccgtgcagtctgagtctggggaggacctgtacttctcagtggagctggaaagtgacctcgcccagtgggaaagagccttccagacagcaacctttctagaagtagaacggatacagtgcaagacctatgcatgtgtgctagaaagtcatctaatgggactcacaattgatttcagcacaggatttatctgctttgatgctgcaacaaaggctgtcctttggaggtataaattctctcagcttaaaggttcttcagatgatggcaagagcaaaatcaaatttttgtttcagaatccagatactaaacagattgaagcaaaggagttggaattttctaatttatttgctgttcttcactgcattcattccttctttgctgccaaggtagcttgtttggaccctctatttttaggcaatcaagctactgcttctactgctgccagctctgctaccacgagcaaagcaaagtatacaacttga

SEQ ID NO: 8755 - DNA, 795 bp, synthetic construct
  misc_feature 1..795: note = Synthetic polypeptide
  source 1..795: mol_type = other DNA
cagttgacccttgaacacttgaacaacacaggtttggacatcgagggtccactgataatgtggattttcttccacctctgccacccctgagacagcaagacaaatacctcctcttcctcttcctccttcttcccagcctactcaacatgaagacaatgaagatgaagagctttatgatgatccactccgacttaattaataattgtctacatgggctggtgtgaagcccgggagcaagaccccctccaggacagagtgtactccccgaccttcctggccctgaggggctcatgtctctacaagtttctggcacctccagtgaccacctgggactggacgagagcagagaaaacattctcagtttatgagattatgtgcaagatcctcaaggacagtgacctgctggaccgacggaaacagtgcttcaccgtgcagtctgagtctggggaggacctgtacttctcagtggagctggaaagtgacctcgcccagtgggaaagagccttccagacagcaacctttctagaagtagaacggatacagtgcaagacctatgcatgtgtgctagaaagtcatctaatgggactcacaattgatttcagcacaggatttatctgctttgatgctgcaacaaaggagttggaattttctaatttatttgctgttcttcactgcattcattccttctttgctgccaaggtagcttgtttggaccctctatttttaggcaatcaagctactgcttctactgctgccagctctgctaccacgagcaaagcaaagtatacaacttga

SEQ ID NO: 8756 - DNA, 399 bp, synthetic construct
  misc_feature 1..399: note = Synthetic polypeptide
  source 1..399: mol_type = other DNA
cagttgacccttgaacacttgaacaacacaggtttggacatcgagggtccactgataatgtggattttcttccacctctgccacccctgagacagcaagacaaatacctcctcttcctcttcctccttcttcccagcctactcaacatgaagacaatgaagatgaagagctttatgatgatccactccgacttaattaataattgtctacatgggctggtgtgaagcccgggagcaagaccccctccaggacagagtgtactccccgaccttcctggccctgaggggctcatgtctctacaagtttctggcacctccagtgaccacctgggactggacgagagcagagaaaacattctcagtttatgagattatgtgcaagatcctcaagcctgtgtaa

SEQ ID NO: 8757 - DNA, 393 bp, synthetic construct
  misc_feature 1..393: note = Synthetic polypeptide
  source 1..393: mol_type = other DNA
cagttgacccttgaacacttgaacaacacaggtttggacatcgagggtccactgataatgtggattttcttccacctctgccacccctgagacagcaagacaaatacctcctcttcctcttcctccttcttcccagcctactcaacatgaagacaatgaagatgaagagctttatgatgatccactccgacttaattaataattgtctacatgggctggtgtgaagcccgggagcaagaccccctccaggacagagtgtactccccgaccttcctggccctgaggggctcatgtctctacaagtttctggcacctccagtgaccacctgggactggacgagagcagagaaaacattctcagtttatgagattatgtgcaagatcctcaagtga

SEQ ID NO: 8758 - DNA, 463 bp, synthetic construct
  misc_feature 1..463: note = Synthetic polypeptide
  source 1..463: mol_type = other DNA
gtggtggaaagtccgtggaatctggggacagaagaccagagttcaagttgaagtcctgcttcctactcactgtgtgttttaaggaggtcctcagaactccctgagtatgagcagccccatctctcagacaccgtcatgggtagatggacttctcttctaccacaaacagacccactacagccccggaagcactcccttggtgggctggctgcgcccctacatggtgtcagatgtccttggtgtagctgtgccggctggcccgctgaccaccaagccagactatgctgggcaccagctccagcagattatggagcacaagaagagccagaaggaaggcatgaaggagaaactcacacacaaggcctctgagaatgggcactatgaattggagcacctgtctactcccaagttgaagggttcttcccatagcccagaccaccctggatgcctcatggagaattaa

SEQ ID NO: 8759 - DNA, 220 bp, synthetic construct; identical to SEQ ID NO: 7991
  misc_feature 1..220: note = Synthetic polypeptide
  source 1..220: mol_type = other DNA

SEQ ID NO: 8760 - DNA, 334 bp, synthetic construct; identical to SEQ ID NO: 7992
  misc_feature 1..334: note = Synthetic polypeptide
  source 1..334: mol_type = other DNA

SEQ ID NO: 8761 - DNA, 163 bp, synthetic construct; identical to SEQ ID NO: 480
  misc_feature 1..163: note = Synthetic polypeptide
  source 1..163: mol_type = other DNA

SEQ ID NO: 8762 - DNA, 104 bp, synthetic construct; identical to SEQ ID NO: 481
  misc_feature 1..104: note = Synthetic polypeptide
  source 1..104: mol_type = other DNA

SEQ ID NO: 8763 - DNA, 348 bp, synthetic construct; identical to SEQ ID NO: 6363
  misc_feature 1..348: note = Synthetic polypeptide
  source 1..348: mol_type = other DNA

SEQ ID NO: 8764 - DNA, 238 bp, synthetic construct; identical to SEQ ID NO: 6378
  misc_feature 1..238: note = Synthetic polypeptide
  source 1..238: mol_type = other DNA

SEQ ID NO: 8765 - DNA, 158 bp, synthetic construct; identical to SEQ ID NO: 7602
  misc_feature 1..158: note = Synthetic polypeptide
  source 1..158: mol_type = other DNA

SEQ ID NO: 8766 - DNA, 175 bp, synthetic construct
  misc_feature 1..175: note = Synthetic polypeptide
  source 1..175: mol_type = other DNA
gtccccgcccagaggtccgaccaccgccagccaagcagcgtccccctcagaagtccaagcaacagccgcgcagcagccccctcagagggccaggcgccagccgtggggggtcccccgtcaaagcttctaggttctggtaacaccatctcttcccttttgttccccagccctaaga

SEQ ID NO: 8767 - DNA, 214 bp, synthetic construct
  misc_feature 1..214: note = Synthetic polypeptide
  source 1..214: mol_type = other DNA
gtccccgcccagaggtccgaccaccgccagccaagcagcgtccccctcagaagtccaagcaacagccgcgcagcagccccctcagagggccaggcgccagccgtggggggtcccccgtcaaagcttctaggttctggtaacaccatctcttcccttttgttccccagccctaagattgaaaaggaagatcaggccaaccccaaagaagaagtga

SEQ ID NO: 8768 - DNA, 157 bp, synthetic construct
  misc_feature 1..157: note = Synthetic polypeptide
  source 1..157: mol_type = other DNA
ctcaccttggaccccttccctccttgcgctctgcttgatgtttaatcccatggaatcaatcaaattaaatcatcatgactacattgattccccatcgctgaaggacagaattcattgtgtggcatttgtatttgatgccagctctattcaatacttc

SEQ ID NO: 8769 - DNA, 535 bp, synthetic construct
  misc_feature 1..535: note = Synthetic polypeptide
  source 1..535: mol_type = other DNA
ctcaccttggaccccttccctccttgcgctctgcttgatgtttaatcccatggaatcaatcaaattaaatcatcatgactacattgattccccatcgctgaaggacagaattcattgtgtggcatttgtatttgatgccagctctattcaatacttctcctctcagatgatagtaaagatcaaaagaattcgaagggagttggtaaacgctggtgtggtacatgtggctttgctcactcatgtggatagcatggatttgattacaaaaggtgaccttatagaaatagagagatgtgagcctgtgaggtccaagctagaggaagtccaaagaaaacttggatttgctctttctgacatctcggtggttagcaattattcctctgagtgggagctggaccctgtaaaggatgttctaattctttctgctctgagacgaatgctatgggctgcagatgacttcttagaggatttgccttttgagcaaatagggaatctaagggaggaaattatcaactgtgcacaaggaaaaaaatag

SEQ ID NO: 8770 - DNA, 1292 bp, synthetic construct
  misc_feature 1..1292: note = Synthetic polypeptide
  source 1..1292: mol_type = other DNA
gccgggcacgatggctcacacctgtaaactcagcactttgggaggccaagatttctgctcatggcagatcttcttccaatgtaaacggtggacctgagcttgaccgttgcataagtcctgaaggtgtgaatggaaacagatgctctgaatcatcaactcttcttgagaaatacaaaattggaaaggtcattggtgatggcaattttgcagtagtcaaagagtgtatagacaggtccactggaaaggagtttgccctaaagattatagacaaagccaaatgttgtggaaaggaacacctgattgagaatgaagtgtcaatactgcgccgagtgaaacatcccaatatcattatgctggtcgaggagatggaaacagcaactgagctctttctggtgatggaattggtcaaaggtggagatctctttgatgcaattacttcgtcgaccaagtacactgagagagatggcagtgccatggtgtacaacttagccaatgccctcaggtatctccatggcctcagcatcgtgcacagagacatcaaaccagagaatctcttggtgtgtgaatatcctgatggaaccaagtctttgaaactgggagactttgggcttgcgactgtggtagaaggccctttatacacagtctgtggcacacccacttatgtggctccagaaatcattgctgaaactggctatggcctgaaggtggacatttgggcagctggtgtgatcacatacatacttctctgtggattcccaccattccgaagtgagaacaatctccaggaagatctcttcgaccagatcttggctgggaagctggagtttccggccccctactgggataacatcacggactctgccaaggaattaatcagtcaaatgcttcaggtaaatgttgaagctcggtgtaccgcgggacaaatcctgagtcacccctgggtgtcagatgatgcctcccaggagaataacatgcaagctgaggtgacaggtaaactaaaacagcactttaataatgcgctccccaaacagaacagcactaccaccggggtctccgtcatcatgaacacggctctagataaggaggggcagattttctgcagcaagcactgtcaagacagcggcaggcctgggatggagcccatctctccagttcctccctcagtggaggagatccctgtgcctggggaagcagtcccggcccccacccctccggaatctcccaccccccaccctcctcccgctgccccgggtggtgagcgggcaggaacctggcgccgccaccgagactga

SEQ ID NO: 8771 - DNA, 1082 bp, synthetic construct
  misc_feature 1..1082: note = Synthetic polypeptide
  source 1..1082: mol_type = other DNA
gccgggcacgatggctcacacctgtaaactcagcactttgggaggccaagatttctgctcatggcagatcttcttccaatgtaaacggtggacctgagcttgaccgttgcataagtcctgaaggtgtgaatggaaacagatgctctgaatcatcaactcttcttgagaaatacaaaattggaaaggtcattggtgatggcaattttgcagtagtcaaagagtgtatagacaggtccactggaaaggagtttgccctaaagattatagacaaagccaaatgttgtggaaaggaacacctgattgagaatgaagtgtcaatactgcgccgagtgaaacatcccaatatcattatgctggtcgaggagatggaaacagcaactgagctctttctggtgatggaattggtcaaaggtggagatctctttgatgcaattacttcgtcgaccaagtacactgagagagatggcagtgccatggtgtacaacttagccaatgccctcaggtatctccatggcctcagcatcgtgcacagagacatcaaaccagagaatctcttggtgtgtgaatatcctgatggaaccaagtctttgaaactgggagactttgggcttgcgactgtggtagaaggccctttatacacagtctgtggcacacccacttatgtggctccagaaatcattgctgaaactggctatggcctgaaggtggacatttgggcagctggtgtgatcacatacatacttctctgtggattcccaccattccgaagtgagaacaatctccaggaagatctcttcgaccagatcttggctgggaagctggagtttccggccccctactgggataacatcacggactctgccaaggaattaatcagtcaaatgcttcaggtaaatgttgaagctcggtgtaccgcgggacaaatcctgagtcacccctgggtgtcagatgatgcctcccaggagaataacatgcaagctgaggtgacaggtaaactaaaacagcactttaataatgcgctccccaaacagaacagcactaccaccggggtctccgtcatcatgtttgatttgacagtttga

SEQ ID NO: 8772 - DNA, 354 bp, synthetic construct
  misc_feature 1..354: note = Synthetic polypeptide
  source 1..354: mol_type = other DNA
gtctctccacttccactccagccccctacagctcatcctccagcaggcagccaagggcacttttaggatctcacatcaggtccttgcctcacattctgcactggcttcccaagtaattaaagtaaaatccaaattccagctcacagcttagaaaactcagcaggactggcctctgtcctatcccacaccccacctcagtccctcaagctcatctcctgtcattcctgcccatttctggaccccagccactcctcaaacagggtgaggatgcagtgtccaaggcaccatcttgaactcatcatcgccaaatatgtgagcaccttgatgttggacttcccaacctccagaccctga

SEQ ID NO: 8773 - DNA, 354 bp, synthetic construct
  misc_feature 1..354: note = Synthetic polypeptide
  source 1..354: mol_type = other DNA
gtctctccacttccactccagccccctacagctcatcctccagcaggcagccaagggcacttttaggatctcacatcaggtccttgcctcacattctgcactggcttcccaagtaattaaagtaaaatccaaattccagctcacagcttagaaaactcagcaggactggcctctgtcctatcccacaccccacctcagtccctcaagctcatctcctgtcattcctgcccatttctggaccccagccactcctcaaacagggtgaggatgcagtgtccaaggcaccatcttgaactcatcatcgccaaatatgtgagcaccttgatgttggacttcccaacctccagaccgtaa

SEQ ID NO: 8774 - DNA, 336 bp, synthetic construct; identical to SEQ ID NO: 7520
  misc_feature 1..336: note = Synthetic polypeptide
  source 1..336: mol_type = other DNA

SEQ ID NO: 8775 - DNA, 346 bp, synthetic construct; identical to SEQ ID NO: 7521
  misc_feature 1..346: note = Synthetic polypeptide
  source 1..346: mol_type = other DNA

SEQ ID NO: 8776 - DNA, 1675 bp, synthetic construct
  misc_feature 1..1675: note = Synthetic polypeptide
  source 1..1675: mol_type = other DNA
tactatagtttggatacttgtctccccaaacctcattgtgaaatgtgatccccagtgctggaggtggggcctaatggatggtggttgggtcatggggacagctccccatgagttcgttcttgctgtattagttccctccaaagctggttgttaaaaagaacctggtgcctccccctgtctctcttccttcctctcttaccatgtgatctggacacactggctccactttgccttctaccataagtggaatcagcctgaagcccccaccagaagcagatgcttgcgccatgcttcttgcacagcctgcaggactgtaagcacagacacctccagcttgcgaagggcagatccgaaaggccggagtgcgctgttggctgatatccagcaaggaactcgcctgcgcaaagtcacgcagatcaacgaccgcagtgccccgcagatcgagagttctaaaggaaccaacaaagaaggaggaggttctgcaaacacacgaggcgcgagcacacctcccaccctgggagatctgtttgctggtggctttcctgtattgcgaccagcaggccagcgggatgtagcaggtggcaagacagggcagggccctggctcccgcgcgccctctcccaggcttcccaacaaaaccatcagcggcccgcttatcccgcctgcctctcccaggctaggcaatacctccgaggcgcatggcgctgccaggacagccccgcctcgccccaacgtgcctgccccgccccctcccaccccaccccctccgcctccacccttacccccgccccttccctcttcctcccccatcaaaactccgcttgtgtccccacccggcccactgaccaaagggaacctcccggtggttgcaccccccgtcccctgtgcgccaccacctccacctccgccacctcccccaacgccacccccgctgcccccggcctcggttcttagtgacaaggcagtgaagcctcagctggctcccttgcacctcccgcccatcccgcccccgctccctctgctcccaccttgtgggtatccggggctcaaagcggagcccgccagccctgcgcaagatgcgcaggagcctcccgccccgccgcccccgctccccccttatgcttcttgctccccgagggcttctttgcccgcgccccctttgccaggagttaatagcagcagtgaaactccacccccgctaccccctaaatcccccagcttccaggccccaccgcagaaggccggtgcgcaggccttgcccgccccgcctgcccctccgggctcccagccgttcctgcagaagaagaggcatggccgaccaggggccggtgggggaaagctaaatccacctccagcaccccctgcgagatcacctaccacagagctttcaagcaagagccagcaggccacagcctggaccccgacgcagcagcctggaggtcaactgcgaaatggaagcctgcacatcattgatgacttcgagtctaaattcacgttccattctgtggaagactttccccctccggatgaatataaaccatgccagaagatttaccccagcaagatccccagaagccgtacacctggtccctggctccaagcggaagcagtcgggcagagctctgatgacatcaaaggcagaaattctcaggtaacacaagcctcatgtctctga

SEQ ID NO: 8777 - DNA, 1675 bp, synthetic construct
  misc_feature 1..1675: note = Synthetic polypeptide
  source 1..1675: mol_type = other DNA
tactatagtttggatacttgtctccccaaacctcattgtgaaatgtgatccccagtgctggaggtggggcctaatggatggtggttgggtcatggggacagctccccatgagttcgttcttgctgtattagttccctccaaagctggttgttaaaaagaacctggtgcctccccctgtctctcttccttcctctcttaccatgtgatctggacacactggctccactttgccttctaccataagtggaatcagcctgaagcccccaccagaagcagatgcttgcgccatgcttcttgcacagcctgcaggactgtaagcacagacacctccagcttgcgaagggcagatccgaaaggccggagtgcgctgttggctgatatccagcaaggaactcgcctgcgcaaagtcacgcagatcaacgaccgcagtgccccgcagatcgagagttctaaaggaaccaacaaagaaggaggaggttctgcaaacacacgaggcgcgagcacacctcccaccctgggagatctgtttgctggtggctttcctgtattgcgaccagcaggccagcgggatgtagcaggtggcaagacagggcagggccctggctcccgcgcgccctctcccaggcttcccaacaaaaccatcagcggcccgcttatcccgcctgcctctcccaggctaggcaatacctccgaggcgcatggcgctgccaggacagccccgcctcgccccaacgtgcctgccccgccccctcccaccccaccccctccgcctccacccttacccccgccccttccctcttcctcccccatcaaaactccgcttgtgtccccacccggcccactgaccaaagggaacctcccggtggttgcaccccccgtcccctgtgcgccaccacctccacctccgccacctcccccaacgccacccccgctgcccccggcctcggttcttagtgacaaggcagtgaagcctcagctggctcccttgcacctcccgcccatcccgcccccgctccctctgctcccaccttgtgggtatccggggctcaaagcggagcccgccagccctgcgcaagatgcgcaggagcctcccgccccgccgcccccgctccccccttatgcttcttgctccccgagggcttctttgcccgcgccccctttgccaggagttaatagcagcagtgaaactccacccccgctaccccctaaatcccccagcttccaggccccaccgcagaaggccggtgcgcaggccttgcccgccccgcctgcccctccgggctcccagccgttcctgcagaagaagaggcatggccgaccaggggccggtgggggaaagctaaatccacctccagcaccccctgcgagatcacctaccacagagctttcaagcaagagccagcaggccacagcctggaccccgacgcagcagcctggaggtcaactgcgaaatggaagcctgcacatcattgatgacttcgagtctaaattcacgttccattctgtggaagactttccccctccggatgaatataaaccatgccagaagatttaccccagcaagatccccagaagccgtacacctggtccctggctccaagcggaagcagtcgggcagagctctgatgacatcaaaggcagaaattctcagttatctctaaagactcttcggtga

SEQ ID NO: 8778 - DNA, 1295 bp, synthetic construct
  misc_feature 1..1295: note = Synthetic polypeptide
  source 1..1295: mol_type = other DNA
gccgggcacgatggctcacacctgtaaactcagcactttgggaggccaagcagatttctgctcatggcagatcttcttccaatgtaaacggtggacctgagcttgaccgttgcataagtcctgaaggtgtgaatggaaacagatgctctgaatcatcaactcttcttgagaaatacaaaattggaaaggtcattggtgatggcaattttgcagtagtcaaagagtgtatagacaggtccactggaaaggagtttgccctaaagattatagacaaagccaaatgttgtggaaaggaacacctgattgagaatgaagtgtcaatactgcgccgagtgaaacatcccaatatcattatgctggtcgaggagatggaaacagcaactgagctctttctggtgatggaattggtcaaaggtggagatctctttgatgcaattacttcgtcgaccaagtacactgagagagatggcagtgccatggtgtacaacttagccaatgccctcaggtatctccatggcctcagcatcgtgcacagagacatcaaaccagagaatctcttggtgtgtgaatatcctgatggaaccaagtctttgaaactgggagactttgggcttgcgactgtggtagaaggccctttatacacagtctgtggcacacccacttatgtggctccagaaatcattgctgaaactggctatggcctgaaggtggacatttgggcagctggtgtgatcacatacatacttctctgtggattcccaccattccgaagtgagaacaatctccaggaagatctcttcgaccagatcttggctgggaagctggagtttccggccccctactgggataacatcacggactctgccaaggaattaatcagtcaaatgcttcaggtaaatgttgaagctcggtgtaccgcgggacaaatcctgagtcacccctgggtgtcagatgatgcctcccaggagaataacatgcaagctgaggtgacaggtaaactaaaacagcactttaataatgcgctccccaaacagaacagcactaccaccggggtctccgtcatcatgaacacggctctagataaggaggggcagattttctgcagcaagcactgtcaagacagcggcaggcctgggatggagcccatctctccagttcctccctcagtggaggagatccctgtgcctggggaagcagtcccggcccccacccctccggaatctcccaccccccaccctcctcccgctgccccgggtggtgagcgggcaggaacctggcgccgccaccgagactga

SEQ ID NO: 8779 - DNA, 337 bp, synthetic construct; identical to SEQ ID NO: 6393
  misc_feature 1..337: note = Synthetic polypeptide
  source 1..337: mol_type = other DNA

SEQ ID NO: 8780 - DNA, 116 bp, synthetic construct; identical to SEQ ID NO: 7598
  misc_feature 1..116: note = Synthetic polypeptide
  source 1..116: mol_type = other DNA

SEQ ID NO: 8781 - DNA, 456 bp, synthetic construct; identical to SEQ ID NO: 6649
  misc_feature 1..456: note = Synthetic polypeptide
  source 1..456: mol_type = other DNA

SEQ ID NO: 8782 - DNA, 480 bp, synthetic construct; identical to SEQ ID NO: 6650
  misc_feature 1..480: note = Synthetic polypeptide
  source 1..480: mol_type = other DNA

SEQ ID NO: 8783 - DNA, 186 bp, synthetic construct; identical to SEQ ID NO: 6651
  misc_feature 1..186: note = Synthetic polypeptide
  source 1..186: mol_type = other DNA

SEQ ID NO: 8784 - DNA, 1861 bp, synthetic construct; identical to SEQ ID NO: 6680
  misc_feature 1..1861: note = Synthetic polypeptide
  source 1..1861: mol_type = other DNA

SEQ ID NO: 8785 - DNA, 1123 bp, synthetic construct; identical to SEQ ID NO: 6681
  misc_feature 1..1123: note = Synthetic polypeptide
  source 1..1123: mol_type = other DNA

SEQ ID NO: 8786 - DNA, 566 bp, synthetic construct
  misc_feature 1..566: note = Synthetic polypeptide
  source 1..566: mol_type = other DNA
gggcttgggacaggcagggactcgggtcagtcagcccctcctgcagtgcactctggacaggtcactttgtctgtgtcctgagtgcctcatctgtaatgtgatgatggcatcagcttcacggggttgtgaggatgagatgaggaaacctatgtaaagccgtgagtccccacatgctcagaggccctatggacagcgatgacagccatggatctgtgctaagactcagccaagccctgggcaacgtgacggtggtccagaaaggagagcgcgacatcctctccaacggccagcaggtgcttgtgtgcagccaggaaggcagcagccgcaggtgtggagggcaaggggacctcctgtcgggctccctgggcgtcctggtacactgggcgctccttgctggaccacagaaaacaaatgggtccagccctctcctggtggccgcgtttggcgcctgctctctcaccaggcagtgcaaccaccaagccttccagaagcacggtcgctccaccaccacctccgacatgatcgccgaggtgggggccgccttcagcaagctctttgaaacctga

SEQ ID NO: 8787 - DNA, 695 bp, synthetic construct
  misc_feature 1..695: note = Synthetic polypeptide
  source 1..695: mol_type = other DNA
gggcttgggacaggcagggactcgggtcagtcagcccctcctgcagtgcactctggacaggtcactttgtctgtgtcctgagtgcctcatctgtaatgtgatgatggcatcagcttcacggggttgtgaggatgagatgaggaaacctatgtaaagccgtgagtccccacatgctcagaggccctatggacagcgatgacagccatggatctgtgctaagactcagccaagccctgggcaacgtgacggtggtccagaaaggagagcgcgacatcctctccaacggccagcaggtgcttgtgtgcagccaggaaggcagcagccgcaggtgtggagggcaaggggacctcctgtcgggctccctgggcgtcctggtacactgggcgctccttgctggaccacagaaaacaaatgggggcatatcagacttgaaattgacaatttggggtcctgagattgaaacaggagtcaaaaccagagcccagggtagctgcggcccccggaccacgacgcccacttccccacacctcctgctgtccccctctccgcaggtccagccctctcctggtggccgcgtttggcgcctgctctctcaccaggcagtgcaaccaccaagccttccagaagcacggtcgctccaccaccacctccgacatgatcgccgaggtgggggccgccttcagcaagctctttga

SEQ ID NO: 8788 - DNA, 2046 bp, synthetic construct
  misc_feature 1..2046: note = Synthetic polypeptide
  source 1..2046: mol_type = other DNA
tagtgaggatgtgtggacaccgccccccctgctggtaggaatgtagcgatgcagtcaccctggaaagcagttcggttgtttctcagaaagttcgtaaacgtggagttgtcacgtgacccggccattctacctctaggtatagacagacacaaaagaattgaaaacagaccttcaaccaaaaacgtgcacacaaatttcacagcagcaccactcataggaaccaaaaagtggaaacagctgaaatgtctattaatggatgaacggaatgtgatttatccatacgatcctcctatcaggaggagcgggcgctgccccttgctacgacgcggatgggccgcggggacgtcacgctcagtggagggagccagacggggaaggccgtgcagcttgcgatgcccttggcaggaaatgcccggggcggggaagtccgtggagccccgtacaccctggcggtggccagggcctgggggaccaggaaccaggagcgcctgctgaacgtcggggtcggcctggagattctacgccaccaacctctcgcgcacagacctgcactccacgtggcagtactacgagcgaacggtcaccgtgcccatgtacagttcgcaaactcaaacctacggggcctccagacttatccccccgctgaaccagctggagctgctgaggaacctcaagagtaaatctggactcgctttcaggaaggaccccccgccggagccgtctccaagccagaaggtcagtttgaaagatcgtgtcttctccagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcagtccagagtggaccagatcgtggggcggggcccagcgatcacggacaaggaccgcaccaagggcccggccgaggcggagctgcccgaggaccccagcatgatgggacggctcgggaaggtggagaagcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctggtgcgcatcccgccgccgcctgcccacgagcggtcgctgtccgcctacggcgggggcaaccgcgccagcatggagttcctgcggcaggaggacaccccgggctgcaggccccccgaggggaacctgcgggacagcgacacgtccatctccatcccgtccgtggaccacgaggagctggagcgttccttcagcggcttcagcatctcccagtccaaggagaacctggatgctctcaacagctgctacgcggccgtggcgccttgtgccaaagtcaggccctacattgcggagggagagtcagacaccgactccgacctctgtaccccgtgcgggcccccgccacgctcggccaccggcgagggtccctttggtgacgtgggctgggccgggcccaggaagtga

SEQ ID NO: 8789 - DNA, 2100 bp, synthetic construct
  misc_feature 1..2100: note = Synthetic polypeptide
  source 1..2100: mol_type = other DNA
tagtgaggatgtgtggacaccgccccccctgctggtaggaatgtagcgatgcagtcaccctggaaagcagttcggttgtttctcagaaagttcgtaaacgtggagttgtcacgtgacccggccattctacctctaggtatagacagacacaaaagaattgaaaacagaccttcaaccaaaaacgtgcacacaaatttcacagcagcaccactcataggaaccaaaaagtggaaacagctgaaatgtctattaatggatgaacggaatgtgatttatccatacgatcctcctatcaggaggagcgggcgctgccccttgctacgacgcggatgggccgcggggacgtcacgctcagtggagggagccagacggggaaggccgtgcagcttgcgatgcccttggcaggaaatgcccggggcggggaagtccgtggagccccgtacaccctggcggtggccagggcctgggggaccaggaaccaggagcgcctgctgaacgtcggggtcggcctggagattctacgccaccaacctctcgcgcacagacctgcactccacgtggcagtactacgagcgaacggtcaccgtgcccatgtacagttcgcaaactcaaacctacggggcctccagacttatccccccgctgaaccagctggagctgctgaggaacctcaagagtaaatctggactcgctttcaggaaggaccccccgccggagccgtctccaagtaaaggcagcccgtgcagagggcccctgtgtggatgctgccccggacgctctagccagaaggtcagtttgaaagatcgtgtcttctccagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcagtccagagtggaccagatcgtggggcggggcccagcgatcacggacaaggaccgcaccaagggcccggccgaggcggagctgcccgaggaccccagcatgatgggacggctcgggaaggtggagaagcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctggtgcgcatcccgccgccgcctgcccacgagcggtcgctgtccgcctacggcgggggcaaccgcgccagcatggagttcctgcggcaggaggacaccccgggctgcaggccccccgaggggaacctgcgggacagcgacacgtccatctccatcccgtccgtggaccacgaggagctggagcgttccttcagcggcttcagcatctcccagtccaaggagaacctggatgctctcaacagctgctacgcggccgtggcgccttgtgccaaagtcaggccctacattgcggagggagagtcagacaccgactccgacctctgtaccccgtgcgggcccccgccacgctcggccaccggcgagggtccctttggtgacgtgggctgggccgggcccaggaagtga

SEQ ID NO: 8790 - DNA, 2124 bp, synthetic construct
  misc_feature 1..2124: note = Synthetic polypeptide
  source 1..2124: mol_type = other DNA
tagtgaggatgtgtggacaccgccccccctgctggtaggaatgtagcgatgcagtcaccctggaaagcagttcggttgtttctcagaaagttcgtaaacgtggagttgtcacgtgacccggccattctacctctaggtatagacagacacaaaagaattgaaaacagaccttcaaccaaaaacgtgcacacaaatttcacagcagcaccactcataggaaccaaaaagtggaaacagctgaaatgtctattaatggatgaacggaatgtgatttatccatacgatcctcctatcaggaggagcgggcgctgccccttgctacgacgcggatgggccgcggggacgtcacgctcagtggagggagccagacggggaaggccgtgcagcttgcgatgcccttggcaggaaatgcccggggcggggaagtccgtggagccccgtacaccctggcggtggccagggcctgggggaccaggaaccaggagcgcctgctgaacgtcggggtcggcctggagattctacgccaccaacctctcgcgcacagacctgcactccacgtggcagtactacgagcgaacggtcaccgtgcccatgtacagacttatccccccgctgaaccagctggagctgctgaggaacctcaagagtaaatctggactcgctttcaggaaggaccccccgccggagccgtctccaagccagaaggtcagtttgaaagatcgtgtcttctccagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcaaacggggatagatatgattgtgggtcccccgcccccttcaactccccggcacaagaagtaccccaccaaaggacccacggcccctccgagagagtcaccccagtactcacctagagtggaccagatcgtggggcggggcccagcgatcacggacaaggaccgcaccaagggcccggccgaggcggagctgcccgaggaccccagcatgatgggacggctcgggaaggtggagaagcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctggtgcgcatcccgccgccgcctgcccacgagcggtcgctgtccgcctacggcgggggcaaccgcgccagcatggagttcctgcggcaggaggacaccccgggctgcaggccccccgaggggaacctgcgggacagcgacacgtccatctccatcccgtccgtggaccacgaggagctggagcgttccttcagcggcttcagcatctcccagtccaaggagaacctggatgctctcaacagctgctacgcggccgtggcgccttgtgccaaagtcaggccctacattgcggagggagagtcagacaccgactccgacctctgtaccccgtgcgggcccccgccacgctcggccaccggcgagggtccctttggtgacgtgggctgggccgggcccaggaagtga

SEQ ID NO: 8791 - DNA, 2100 bp, synthetic construct
  misc_feature 1..2100: note = Synthetic polypeptide
  source 1..2100: mol_type = other DNA
tagtgaggatgtgtggacaccgccccccctgctggtaggaatgtagcgatgcagtcaccctggaaagcagttcggttgtttctcagaaagttcgtaaacgtggagttgtcacgtgacccggccattctacctctaggtatagacagacacaaaagaattgaaaacagaccttcaaccaaaaacgtgcacacaaatttcacagcagcaccactcataggaaccaaaaagtggaaacagctgaaatgtctattaatggatgaacggaatgtgatttatccatacgatcctcctatcaggaggagcgggcgctgccccttgctacgacgcggatgggccgcggggacgtcacgctcagtggagggagccagacggggaaggccgtgcagcttgcgatgcccttggcaggaaatgcccggggcggggaagtccgtggagccccgtacaccctggcggtggccagggcctgggggaccaggaaccaggagcgcctgctgaacgtcggggtcggcctggagattctacgccaccaacctctcgcgcacagacctgcactccacgtggcagtactacgagcgaacggtcaccgtgcccatgtacagttcgcaaactcaaacctacggggcctccagacttatccccccgctgaaccagctggagctgctgaggaacctcaagagtaaatctggactcgctttcaggaaggaccccccgccggagccgtctccaagtaaaggcagcccgtgcagagggcccctgtgtggatgctgccccggacgctctagccagaaggtcagtttgaaagatcgtgtcttctccagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcaaagccaagtggaccagatcgtggggcggggcccagcgatcacggacaaggaccgcaccaagggcccggccgaggcggagctgcccgaggaccccagcatgatgggacggctcgggaaggtggagaagcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctggtgcgcatcccgccgccgcctgcccacgagcggtcgctgtccgcctacggcgggggcaaccgcgccagcatggagttcctgcggcaggaggacaccccgggctgcaggccccccgaggggaacctgcgggacagcgacacgtccatctccatcccgtccgtggaccacgaggagctggagcgttccttcagcggcttcagcatctcccagtccaaggagaacctggatgctctcaacagctgctacgcggccgtggcgccttgtgccaaagtcaggccctacattgcggagggagagtcagacaccgactccgacctctgtaccccgtgcgggcccccgccacgctcggccaccggcgagggtccctttggtgacgtgggctgggccgggcccaggaagtga

SEQ ID NO: 8792 - DNA, 2016 bp, synthetic construct
  misc_feature 1..2016: note = Synthetic polypeptide
  source 1..2016: mol_type = other DNA
tagtgaggatgtgtggacaccgccccccctgctggtaggaatgtagcgatgcagtcaccctggaaagcagttcggttgtttctcagaaagttcgtaaacgtggagttgtcacgtgacccggccattctacctctaggtatagacagacacaaaagaattgaaaacagaccttcaaccaaaaacgtgcacacaaatttcacagcagcaccactcataggaaccaaaaagtggaaacagctgaaatgtctattaatggatgaacggaatgtgatttatccatacgatcctcctatcaggaggagcgggcgctgccccttgctacgacgcggatgggccgcggggacgtcacgctcagtggagggagccagacggggaaggccgtgcagcttgcgatgcccttggcaggaaatgcccggggcggggaagtccgtggagccccgtacaccctggcggtggccagggcctgggggaccaggaaccaggagcgcctgctgaacgtcggggtcggcctggagattctacgccaccaacctctcgcgcacagacctgcactccacgtggcagtactacgagcgaacggtcaccgtgcccatgtacagacttatccccccgctgaaccagctggagctgctgaggaacctcaagagtaaatctggactcgctttcaggaaggaccccccgccggagccgtctccaagccagaaggtcagtttgaaagatcgtgtcttctccagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcagtccagagtggaccagatcgtggggcggggcccagcgatcacggacaaggaccgcaccaagggcccggccgaggcggagctgcccgaggaccccagcatgatgggacggctcgggaaggtggagaagcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctggtgcgcatcccgccgccgcctgcccacgagcggtcgctgtccgcctacggcgggggcaaccgcgccagcatggagttcctgcggcaggaggacaccccgggctgcaggccccccgaggggaacctgcgggacagcgacacgtccatctccatcccgtccgtggaccacgaggagctggagcgttccttcagcggcttcagcatctcccagtccaaggagaacctggatgctctcaacagctgctacgcggccgtggcgccttgtgccaaagtcaggccctacattgcggagggagagtcagacaccgactccgacctctgtaccccgtgcgggcccccgccacgctcggccaccggcgagggtccctttggtgacgtgggctgggccgggcccaggaagtga

SEQ ID NO: 8793 - DNA, 2124 bp, synthetic construct
  misc_feature 1..2124: note = Synthetic polypeptide
  source 1..2124: mol_type = other DNA
tagtgaggatgtgtggacaccgccccccctgctggtaggaatgtagcgatgcagtcaccctggaaagcagttcggttgtttctcagaaagttcgtaaacgtggagttgtcacgtgacccggccattctacctctaggtatagacagacacaaaagaattgaaaacagaccttcaaccaaaaacgtgcacacaaatttcacagcagcaccactcataggaaccaaaaagtggaaacagctgaaatgtctattaatggatgaacggaatgtgatttatccatacgatcctcctatcaggaggagcgggcgctgccccttgctacgacgcggatgggccgcggggacgtcacgctcagtggagggagccagacggggaaggccgtgcagcttgcgatgcccttggcaggaaatgcccggggcggggaagtccgtggagccccgtacaccctggcggtggccagggcctgggggaccaggaaccaggagcgcctgctgaacgtcggggtcggcctggagattctacgccaccaacctctcgcgcacagacctgcactccacgtggcagtactacgagcgaacggtcaccgtgcccatgtacagacttatccccccgctgaaccagctggagctgctgaggaacctcaagagtaaatctggactcgctttcaggaaggaccccccgccggagccgtctccaagccagaaggtcagtttgaaagatcgtgtcttctccagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcagtccaggatagatatgattgtgggtcccccgcccccttcaactccccggcacaagaagtaccccaccaaaggacccacggcccctccgagagagtcaccccagtactcacctagagtggaccagatcgtggggcggggcccagcgatcacggacaaggaccgcaccaagggcccggccgaggcggagctgcccgaggaccccagcatgatgggacggctcgggaaggtggagaagcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctggtgcgcatcccgccgccgcctgcccacgagcggtcgctgtccgcctacggcgggggcaaccgcgccagcatggagttcctgcggcaggaggacaccccgggctgcaggccccccgaggggaacctgcgggacagcgacacgtccatctccatcccgtccgtggaccacgaggagctggagcgttccttcagcggcttcagcatctcccagtccaaggagaacctggatgctctcaacagctgctacgcggccgtggcgccttgtgccaaagtcaggccctacattgcggagggagagtcagacaccgactccgacctctgtaccccgtgcgggcccccgccacgctcggccaccggcgagggtccctttggtgacgtgggctgggccgggcccaggaagtga

SEQ ID NO: 8794 - DNA, 2007 bp, synthetic construct
  misc_feature 1..2007: note = Synthetic polypeptide
  source 1..2007: mol_type = other DNA
tagtgaggatgtgtggacaccgccccccctgctggtaggaatgtagcgatgcagtcaccctggaaagcagttcggttgtttctcagaaagttcgtaaacgtggagttgtcacgtgacccggccattctacctctaggtatagacagacacaaaagaattgaaaacagaccttcaaccaaaaacgtgcacacaaatttcacagcagcaccactcataggaaccaaaaagtggaaacagctgaaatgtctattaatggatgaacggaatgtgatttatccatacgatcctcctatcaggaggagcgggcgctgccccttgctacgacgcggatgggccgcggggacgtcacgctcagtggagggagccagacggggaaggccgtgcagcttgcgatgcccttggcaggaaatgcccggggcggggaagtccgtggagccccgtacaccctggcggtggccagggcctgggggaccaggaaccaggagcgcctgctgaacgtcggggtcggcctggagattctacgccaccaacctctcgcgcacagacctgcactccacgtggcagtactacgagcgaacggtcaccgtgcccatgtacagttcgcaaactcaaacctacggggcctccagacttatccccccgctgaaccagctggagctgctgaggaacctcaagagtaaatctggactcgctttcaggaaggaccccccgccggagccgtctccaagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcagtccagagtggaccagatcgtggggcggggcccagcgatcacggacaaggaccgcaccaagggcccggccgaggcggagctgcccgaggaccccagcatgatgggacggctcgggaaggtggagaagcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctggtgcgcatcccgccgccgcctgcccacgagcggtcgctgtccgcctacggcgggggcaaccgcgccagcatggagttcctgcggcaggaggacaccccgggctgcaggccccccgaggggaacctgcgggacagcgacacgtccatctccatcccgtccgtggaccacgaggagctggagcgttccttcagcggcttcagcatctcccagtccaaggagaacctggatgctctcaacagctgctacgcggccgtggcgccttgtgccaaagtcaggccctacattgcggagggagagtcagacaccgactccgacctctgtaccccgtgcgggcccccgccacgctcggccaccggcgagggtccctttggtgacgtgggctgggccgggcccaggaagtga

SEQ ID NO: 8795 - DNA, 663 bp, synthetic construct
  misc_feature 1..663: note = Synthetic polypeptide
  source 1..663: mol_type = other DNA
tagtgaggatgtgtggacaccgccccccctgctggtaggaatgtagcgatgcagtcaccctggaaagcagttcggttgtttctcagaaagttcgtaaacgtggagttgtcacgtgacccggccattctacctctaggtatagacagacacaaaagaattgaaaacagaccttcaaccaaaaacgtgcacacaaatttcacagcagcaccactcataggaaccaaaaagtggaaacagctgaaatgtctattaatggatgaacggaatgtgatttatccatacgatcctcctatcaggaggagcgggcgctgccccttgctacgacgcggatgggccgcggggacgtcacgctcagtggagggagccagacggggaaggccgtgcagcttgcgatgcccttggcaggaaatgcccggggcggggaagtccgtggagccccgtacaccctggcggtggccagggcctgggggaccaggaaccaggagcgcctgctgaacgtcggggtcggcctggagattctacgccaccaacctctcgcgcacagacctgcactccacgtggcagtactacgagcgaacggtcaccgtgcccatgtacaggtaccgccgccgggcacctgccaccaagcaactgtttcattttttattttccatttgttcttaa

SEQ ID NO: 8796 - DNA, 724 bp, synthetic construct
  misc_feature 1..724: note = Synthetic polypeptide
  source 1..724: mol_type = other DNA
cttcctttccccgctgctcaccatcatcttcaagaacttccaggagtgtgtggaccagaaggtgtaccaggctgagatggacgagctcccggccgccttcgtggatggctctaagaacggtggggacaagcacggggccaacagcctgaagatcactgagaaggtgtcaggccagcacgtggagatccaggccaagtacatcggcaccaccatcgtggtgcgccaggtgggccgctacctgacctttgccgtccgcatgccagaggaagtggtcaatgctgtggaggactgggacagccagggtctctacctctgcctgcggggctgccccctcaaccagcagatcgacttccaggccttccacaccaatgctgagggcaccggtgcccgcaggctggcagccgccagccctgcacccacagcccccgagaccttcccatacgagacagccgtggccaagtgcaaggagaagctgccggtggaggacctgtactaccaggcctgcgtcttcgacctcctcaccacgggcgacgtgaacttcacactggccgcctactacgcgttggaggatgtcaagatgctccactccaacaaagacaaactgcacctgtatgataggactcgggacctgccaggcagggcggctgcggggctgcccctggccccccggcccctcctgggcgccctcgtcccgctcctggccctgctccctgtgttctgctag

SEQ ID NO: 8797 - DNA, 75 bp, synthetic construct
  misc_feature 1..75: note = Synthetic polypeptide
  source 1..75: mol_type = other DNA
cttcctttccccgctgctcaccatcatcttcaagaacttccaggagtgtgtggaccagaaggtgtaccaggctga

SEQ ID NO: 8798 - DNA, 1475 bp, synthetic construct
  misc_feature 1..1475: note = Synthetic polypeptide
  source 1..1475: mol_type = other DNA
ttatgttaaagaggcgatttttggaaagtcccagatagccactggatggggggctggttgccaggggaacaaacctggtgctctgagggttggaatttacaggcccacccctcacctctggggaagggagaggggatgaagattgagtagagcaccaattgccaatgatttaatcggtcatgcctgtgtaatgaagcctccataaaaatccaaaaggactgagtttgggggcttccaggaaggtgaacaagaacacatccacaggccaggagggtgcaaacccaacgccacagggcagcaactcctatgcgccggacccttctagagcttcccctcggtatctcttcatctggctgtttatttgtatcctttaaaatatcctttataacaaatggatgaacgtaagtaagtgtctccttgagttctgtgagctactctaacaaattaattgaacccaaggagcagtcctgagaacctcgatttatagctggttggtcagaggcacagataaaacaacctgaagcttgtgttggcattggaagtgggagagtcttgtgggactgagccttcactctgtgggatctgatgctatcttcaggtaccccaagaagctagtgcagacttattcagtgtttccctaccaggacgagatgagcgacgtagtggttcagccctacaattcactcctgacactcaagaggctgacgcagaacgcagattgtgtggtggtgctggacaacacagccctgaaccggattgccacagaccgcctgcacatccagaacccgtccttctcccagatcaaccagctggtgtccaccatcatgtcggccagcaccaccaccctgcgctaccccggctacatgaacaatgacctcatcggcctcatcgcctcgctcattcccaccccacggctccacttcctcatgaccggctacaccccgctcactacagaccagtcagtggccagcgtgaggaagaccacggtcctggatgtcatgaggcggctgctgcagcccaagaacgtgatggtgtccacaggccgagaccgccagaccaaccactgctacatcgccatcctcaacatcatccagggagaggtggaccccacccaggtccacaagagcctgcagaggatccgggaacggaagttggccaacttcatcccgtggggccccgccagcatccaggtggccctgtcgaggaagtctccctacctgccctcggcccaccgggtcagcgggctcatgatggccaaccacaccagcatctcctcgctctttgaaagttcctgccagcagtttgacaagctgcggaagcgggatgccttcctcgagcagttccgtaaggaggacatgttcaaggacaactttgatgagatggacaggtctagggaggttgttcaggagctcattgatgagtaccatgcggccacccagccagactacatttcctggggcacccaggagcagtga

SEQ ID NO: 8799 - DNA, 216 bp, synthetic construct
  misc_feature 1..216: note = Synthetic polypeptide
  source 1..216: mol_type = other DNA
ggagtctgtggactcctggttcaaatcctggctttgcactcaaggcaagctgtgattgtgggcggggtggtgggcgccctctttgctgccttcttggtcacactgctcatctatcgtatgaagaaaaaggatgagggcagctacacgctggaggaacccaagcaggcgagcgtcacataccagaagcctgacaagcaggaggagttctatgcctag

SEQ ID NO: 8800 - DNA, 1185 bp, synthetic construct
  misc_feature 1..1185: note = Synthetic polypeptide
  source 1..1185: mol_type = other DNA
gcggtggcagcggcggcggcggcgcggggaccgaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacgacccagccccctgagcagggcttggatcccacccgcagctccctgccccgctccagcccggagaacctggtggaccagatcctggagtccgtggactcggattctgaagggattttcattgactttggccggggccggggctctggcatgtccgacttggagggctctgggggccggcagagtgtcgtgtga

SEQ ID NO: 8801 - DNA, 550 bp, synthetic construct
  misc_feature 1..550: note = Synthetic polypeptide
  source 1..550: mol_type = other DNA
gcggtggcagcggcggcggcggcgcggggaccgaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggcatctgcccgcgccagtcaggcccagtggtgatggcccccatgcccacaggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtga

SEQ ID NO: 8802 - DNA, 387 bp, synthetic construct
  misc_feature 1..387: note = Synthetic polypeptide
  source 1..387: mol_type = other DNA
gcggtggcagcggcggcggcggcgcggggaccgaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgaggaagctgctggactcactggcagagacctgggacttcttcttcagtga

SEQ ID NO: 8803 - DNA, 1713 bp, synthetic construct
  misc_feature 1..1713: note = Synthetic polypeptide
  source 1..1713: mol_type = other DNA
gcggtggcagcggcggcggcggcgcggggaccgaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgaggagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggggatgaccgctttggaagacgtgttgtcacgttcagctgctgccggatgccaccctcccacgagctggaccaccagcggctgctggagtatttgaagtacacactggaccaatacgttgagaacgattataccatcgtctatttccactacgggctgaacagccggaacaagccttccctgggctggctccagagcgcatacaaggagttcgataggaagtacaagaagaacttgaaggccctctacgtggtgcaccccaccagcttcatcaaggtcctgtggaacatcttgaagcccctcatcagtcacaagtttgggaagaaagtcatctatttcaactacctgagtgagctccacgaacaccttaaatacgaccagctggtcatccctcccgaagttttgcggtacgatgagaagctccagagcctgcacgagggccggacgccgcctcccaccaagacaccaccgccgcggcccccgctgcccacacagcagtttggcgtcagtctgcaatacctcaaagacaaaaatcaaggcgaactcatcccccctgtgctgaggttcacagtgacgtacctgagagagaaaggcctgcgcaccgagggcctgttccggagatccgccagcgtgcagaccgtccgcgagatccagaggctctacaaccaagggaagcccgtgaactttgacgactacggggacattcacatccctgccgtgatcctgaagaccttcctgcgagagctgccccagccgcttctgaccttccaggcctacgagcagattctcgggatcacctgtgtggagagcagcctgcgtgtcactggctgccgccagatcttacggagcctcccagagcacaactacgtcgtcctccgctacctcatgggcttcctgcatgcggtgtcccgggagagcatcttcaacaaaatgaacagctctaacctggcctgtgtcttcgggctgaatttgatctggccatcccagggggtctcctccctgagtgcccttgtgcccctgaacatgttcactgaactgctgatcgagtactatgaaaagatcttcagcaccccggaggcacctggggagcacggcctggcaccatgggaacaggggagcagggcagcccctttgcaggaggctgtgccacggacacaagccacgggcctcaccaagcctaccctacctccgagtcccctgatggcagccagaagacgtctctag

SEQ ID NO: 8804 - DNA, 1950 bp, synthetic construct
  misc_feature 1..1950: note = Synthetic polypeptide
  source 1..1950: mol_type = other DNA
gcggtggcagcggcggcggcggcgcggggaccgaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggggatgaccgctttggaagacgtgttgtcacgttcagctgctgccggatgccaccctcccacgagctggaccaccagcggctgctggagtacaagaagaacttgaaggccctctacgtggtgcaccccaccagcttcatcaaggtcctgtggaacatcttgaagcccctcatcagtcacaagtttgggaagaaagtcatctatttcaactacctgagtgagctccacgaacaccttaaatacgaccagctggtcatccctcccgaagttttgcggtacgatgagaagctccagagcctgcacgagggccggacgccgcctcccaccaagacaccaccgccgcggcccccgctgcccacacagcagtttggcgtcagtctgcaatacctcaaagacaaaaatcaaggcgaactcatcccccctgtgctgaggttcacagtgacgtacctgagagagaaaggcctgcgcaccgagggcctgttccggagatccgccagcgtgcagaccgtccgcgagatccagaggctctacaaccaagggaagcccgtgaactttgacgactacggggacattcacatccctgccgtgatcctgaagaccttcctgcgagagctgccccagccgcttctgaccttccaggcctacgagcagattctcgggatcacctgtgtggagagcagcctgcgtgtcactggctgccgccagatcttacggagcctcccagagcacaactacgtcgtcctccgctacctcatgggcttcctgcatgcggtgtcccgggagagcatcttcaacaaaatgaacagctctaacctggcctgtgtcttcgggctgaatttgatctggccatcccagggggtctcctccctgagtgcccttgtgcccctgaacatgttcactgaactgctgatcgagtactatgaaaagatcttcagcaccccggaggcacctggggagcacggcctggcaccatgggaacaggggagcagggcagcccctttgcaggaggctgtgccacggacacaagccacgggcctcaccaagcctaccctacctccgagtcccctgatggcagccagaagacgtctctag

SEQ ID NO: 8805 - DNA, 921 bp, synthetic construct
  misc_feature 1..921: note = Synthetic polypeptide
  source 1..921: mol_type = other DNA
ggccggcgggcgggcgcccggcgcgggaactgtcccatcgaccagcaccaccgcaaccagtgccaatactgccgcctcaagaagtgcctcaaagtgggcatgaggcgggaagcggttcagcgaggaagaatgcctccaacccagcccaatccaggccagtacgcactcaccaacggggaccccctcaacggccactgctacctgtccggctacatctcgctgctgctgcgcgccgagccctaccccacgtcgcgctacggcagccagtgcatgcagcccaacaacattatgggcatcgagaacatctgcgagctggccgcgcgcctgctcttcagcgccgtcgagtgggcccgcaacatccccttcttcccggatctgcagatcaccgaccaggtgtccctgctacgcctcacctggagcgagctgttcgtgctcaacgcggcccagtgctctatgccgctgcacgtggcgccgttgctggccgccgccggcctgcatgcctcgcccatgtctgccgaccgcgtcgtggccttcatggaccacatccgcatcttccaggagcaggtggagaagctcaaggcgctacacgtcgactcagccgagtacagctgcctcaaagccatcgtgctgttcacgtcagacgcctgtggcctgtcggatgcggcccacatcgagagcctgcaggagaagtcgcagtgcgcactggaggagtacgtgaggagccagtaccccaaccagcccagccgttttggcaaactgctgctgcgactgccctcgctgcgcaccgtgtcctcctccgtcatcgagcagctcttcttcgtccgtttggtaggtaaaacccccatcgaaactctcatccgcgatatgttactgtctgggagcagcttcaactggccttacatgtccatccagtgctcctag

SEQ ID NO: 8806 - DNA, 1083 bp, synthetic construct; identical to SEQ ID NO: 7080
  misc_feature 1..1083: note = Synthetic polypeptide
  source 1..1083: mol_type = other DNA

SEQ ID NO: 8807 - DNA, 243 bp, synthetic construct
  misc_feature 1..243: note = Synthetic polypeptide
  source 1..243: mol_type = other DNA
ttctgtctccttctgccaggtgaacacacattgttcatcccctcaggaggacacagcttttgagataccatcttggaagcagagaccagccctcactagacacaaacttcctggcaccttgattttggacttcatagcctctagaactgtgctgggaagacaacacttctgaactatattttgacagagcaacatagtaaaagagtagcggtcattttaaatgaatctggggaaggtaagtaa

SEQ ID NO: 8808 - DNA, 1182 bp, synthetic construct
  misc_feature 1..1182: note = Synthetic polypeptide
  source 1..1182: mol_type = other DNA
ttctgtctccttctgccaggtgaacacacattgttcatcccctcaggaggacacagcttttgagataccatcttggaagcagagaccagccctcactagacacaaacttcctggcaccttgattttggacttcatagcctctagaactgtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgttttgggttgatgccgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggtcccagaagaagatgtaaagaaattaagaacgacacttagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctgtgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataa

SEQ ID NO: 8809 - DNA, 1122 bp, synthetic construct
  misc_feature 1..1122: note = Synthetic polypeptide
  source 1..1122: mol_type = other DNA
ttctgtctccttctgccaggtgaacacacattgttcatcccctcaggaggacacagcttttgagataccatcttggaagcagagaccagccctcactagacacaaacttcctggcaccttgattttggacttcatagcctctagaactgtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtatcataactattgtggattcaaaatatggattaaaacatttaacagaagagaaacctgatggccttatcaatgaagctactaggcaagttgctttggcagatatcattctcattaataaaacagacttggtcccagaagaagatgtaaagaaattaagaacgacacttagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctgtgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataa

SEQ ID NO: 8810 - DNA, 336 bp, synthetic construct
  misc_feature 1..336: note = Synthetic polypeptide
  source 1..336: mol_type = other DNA
ttctgtctccttctgccaggtgaacacacattgttcatcccctcaggaggacacagcttttgagataccatcttggaagcagagaccagccctcactagacacaaacttcctggcaccttgattttggacttcatagcctctagaactgtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaagtga

SEQ ID NO: 8811 - DNA, 921 bp, synthetic construct
  misc_feature 1..921: note = Synthetic polypeptide
  source 1..921: mol_type = other DNA
aacttccaagttttgagtaaaaatgatttctaacgttgcattctgcccagaaagttaccaattaaatgtggagtagagcaaagactgtttaaaacatcctgtcccccaaatttaatttccctgtacttcatctcaggaagctactggagtgtggtgtctaccacaacaagggagtactctaagaaggaggatcagatccagggaagaggggctcccatacaagacaggggagcagaatccccaggaagttgacaggtgcaagtcccaggacagcagtgtcacagaagacctggaaagcagccaattatggagagtcgcctccagggaaagcaaagtcatagtagatttgaccatgtggaaaatcttatcgagagactttttacagagctgttgccggcagcaaaagtggaccaagaaaccttgacagaaatggtgaaacccagtattgattatgtgcgccacaaaaaattccgatctgggaattacccatcatcattaagcaatgaaacagaccggctggtgcactggtgccacggcgccccgggggtcatccacatgctcatgcaggcgtacaaggtctttaaggaggagaagtacttgaaagaggccatggagtgtagcgatgtgatttggcagcgaggtttgctgcggaagggctacgggatatgccatgggactgctggcaacggctattccttcctgtccctttaccgtctcacgcaggataagaagtacctctaccgagcttgcaagtttgcagagtggtgtctagattacggagcacacgggtgccgcattcctgacagaccctattcgctctttgaaggcatggctggcgctattcactttctctctgatgtcctgggaccagagacatcacggtttccagcatttgaacttgactcttcgaagagggattaa

SEQ ID NO: 8812 - DNA, 1164 bp, synthetic construct; identical to SEQ ID NO: 7133
  misc_feature 1..1164: note = Synthetic polypeptide
  source 1..1164: mol_type = other DNA

SEQ ID NO: 8813 - DNA, 376 bp, synthetic construct; identical to SEQ ID NO: 7134
  misc_feature 1..376: note = Synthetic polypeptide
  source 1..376: mol_type = other DNA

SEQ ID NO: 8814 - DNA, 2578 bp, synthetic construct; identical to SEQ ID NO: 7194
  misc_feature 1..2578: note = Synthetic polypeptide
  source 1..2578: mol_type = other DNA

SEQ ID NO: 8815 - DNA, 2305 bp, synthetic construct; identical to SEQ ID NO: 7195
  misc_feature 1..2305: note = Synthetic polypeptide
  source 1..2305: mol_type = other DNA

SEQ ID NO: 8816 - DNA, 1759 bp, synthetic construct; identical to SEQ ID NO: 7196
  misc_feature 1..1759: note = Synthetic polypeptide
  source 1..1759: mol_type = other DNA

SEQ ID NO: 8817 - DNA, 1320 bp, synthetic construct
  misc_feature 1..1320: note = Synthetic polypeptide
  source 1..1320: mol_type = other DNA
ggccgggtgcagtggctcacgcctgtaatcccagcactttggatggcctagggtgggtggatcacttcaggccaggagttcgagaccatcctggccaacatggcgaaactccgtctctactaaaaatacaaaaattagctggatgtggtggtgcacacctgtattcccagctactcaggaggctgaggcaggagaattgctcaaacctgggagacagaggttgtaatgagccaagatcgcaccattgcactccagcctcggtgacagagcaggactccatctcaaaaaaaaaaaaaaggggtctccgtccacgtgtgcaatgagcaccgttatgggtacatgaatgtgccggtgaaatcccaccaggggctggaagacgagagggtcaacttcatccacctgatcttagaagcactagtggacggcccccgcatgcaggcctcagctcatgtgactcggccctctaagaggcccagcaagatagggtttgacgaggtctttgtcatcagcctggctcgcaggcctgaccgtcgggaacgcatgctcgcctcgctctgggagatggagatctctgggagggtggtggacgctgtggatggctggatgctcaacagcagtgccatcaggaacctcggcgtagacctgctcccgggctaccaggacccttactcgggccgcactctgaccaagggcgaggtgggctgcttcctcagccattactccatctgggaagaggtggttgccaggggcctggcccgggtcctggtgtttgaggatgacgtgcgctttgagagcaacttcagggggcggctggagcggctgatggaggatgtggaggcagagaaactgtcttgggacctgatctacctcggacggaagcaggtgaaccctgagaaggagacggccgtggaggggctgccgggcctggtggtggctgggtactcctactggacgctggcctatgccctgcgtctggcgggtgcccgcaagctgctggcctcacagcctctgcgccgcatgctgcccgtggacgagttcctgcccatcatgttcgaccagcaccccaacgagcagtacaaggcacacttctggccacgggacctggtggccttctccgcccagcccctgctcgctgcccctacccactatgccggggacgccgagtggctcagtgacacggagacatcctctccatgggatgatgacagcggccgcctcatcagctggagcggctcccaaaagaccctgcgcagcccccgcctggacctgactggcagcagcgggcacagcctccaaccccagccccgagatgagctctag

SEQ ID NO: 8818 - DNA, 420 bp, synthetic construct
  misc_feature 1..420: note = Synthetic polypeptide
  source 1..420: mol_type = other DNA
ggccgggtgcagtggctcacgcctgtaatcccagcactttggatggcctagggtgggtggatcacttcaggccaggagttcgagaccatcctggccaacatggcgaaactccgtctctactaaaaatacaaaaattagctggatgtggtggtgcacacctgtattcccagctactcaggaggctgaggcaggagaattgctcaaacctgggagacagaggttgtaatgagccaagatcgcaccattgcactccagcctcggtgacagagcaggactccatctcaaaaaaaaaaaaaaggggtctccgtccacgtgtgcaatgagcaccgttatgggtacatgaatgtgccggtgaaatcccaccaggggctggaagacgagagggtcaacttcatccacctgatcttagaagcactaggt

SEQ ID NO: 8819 - DNA, 998 bp, synthetic construct
  misc_feature 1..998: note = Synthetic polypeptide
  source 1..998: mol_type = other DNA
gggacatgactgctgccttgaaacagaagaggggaaatcgtgggacagagaggacatgctgctttggggaaaccactgaaggcagagccatcgactttctggagaagatcctgacctttaaccccatggatcgcctaacagctgagatggggctgcaacacccctacatgagcccatactcgtgccctgaggacgagcccacctcacaacaccccttccgcattgaggatgagatcgacgacatcgtgctgatggccgctaaccagagccagctgtccaactgggacacgtgcagttccaggtaccctgtgagcctgtcgtcggacctggagtggcggcctgaccggtgccaggacgccagcgaggtacagcgcgacccgcgcgcgggttcggcgccactggctgaggacgtgcaggtggacccgcgcaaggactcgcacagcagctccgagcgcttcctagagcagtcgcactcgtccatggagcgcgccttcgaggccgactacgggcgctcctgcgactacaaggtggggtcgccgtcctacctggacaagctgctgtggcgcgacaacaagccgcaccactactcggagcccaagctcatcctggacctgtcgcactggaagcaggcggccggcgcgccccccacggccacggggctggcggacacgggggcgcgcgaggacgagccggccagcctcttcctggagatcgcgcagtgggtcaagagcacgcagggcggcccagagcacgccagcccgcccgccgacgaccccgagcgccgcttgtctgcctcgccccccggccgcccggccccggtggacggcggcgccagcccccagttcgacctggacgtgttcatctcccgcgccctgaagctctgcaccaagcccgaggacctgccggacaataaactgggcgacctcaatggtgcgtgcatccccgagcaccctggcgacctcgtgcagaccgaggccttctccaaagaaaggtggtga

SEQ ID NO: 8820 - DNA, 1130 bp, synthetic construct
  misc_feature 1..1130: note = Synthetic polypeptide
  source 1..1130: mol_type = other DNA
acatggagagtggaactaggaatttctccatttccactgaagactgaacaaagggagatactgcaggggtcggggagaggttagagctctggaggacttccgtgcacaggatgaacaggccgatccaggtcaagccagccgacagcgagagccgaggagaagaccggaagctctttgtggggatgctagggaagcagcagacagatgaggacgtccggaagatgtttgagcccttcgggaccatcgacgagtgcactgtgctccgggggccagatggcaccagcaaaggctgcgccttcgtgaagttccagacccacgctgaggcccaggcggccatcaacacccttcacagcagccggaccctgccaggtgcctcgtccagcctggtggtgaagtttgctgacactgagaaggagcgaggtctccgccgcatgcagcaggtggccacccagttgggcatgttcagccccatcgccctccagtttggagcctacagcgcctacacccaggccctgatgcagcagcaggcggccctggtagcggctcacagtgcctacctcagccccatggccaccatggctgccgtgcagatgcagcacatggctgccatcaatgccaatggcctcatcgccacccccatcaccccatcctcagcccagagccccgcggcccccgtggaccccctgcagcaggcctacgcggggatgcagcactacacagcagcctacccagcagcctacagcctggttgcacctgcgttcccgcagcctccagccctggtcgcccagcagcccccaccaccacctcaacagcagcagcagcagcagcagcagcaacagcagcagcagcaaagagaaggccctgatggctgcaacatcttcatctaccacctgccccaggagttcactgactcagagatcctccagatgtttgtcccctttggccacgtcatctcagccaaagtctttgttgaccgagccaccaatcaaagcaaatgttttggctttgtgagtttcgacaatccggccagtgcccaggctgccatccaggccatgaatggcttccagatcggcatgaagcgcctcaaagtccagctaaagcggcctaaggatgccaaccggccctactga

SEQ ID NO: 8821 - DNA, 1280 bp, synthetic construct
  misc_feature 1..1280: note = Synthetic polypeptide
  source 1..1280: mol_type = other DNA
acatggagagtggaactaggaatttctccatttccactgaagactgaacaaagggagatactgcaggggtcggggagaggttagagctctggaggacttccgtgcacaggatgaacaggccgatccaggtcaagccagccgacagcgagagccgaggagaagaccggaagctctttgtggggatgctagggaagcagcagacagatgaggacgtccggaagatgtttgagcccttcgggaccatcgacgagtgcactgtgctccgggggccagatggcaccagcaaaggctgcgccttcgtgaagttccagacccacgctgaggcccaggcggccatcaacacccttcacagcagccggaccctgccaggtgcctcgtccagcctggtggtgaagtttgctgacactgagaaggagcgaggtctccgccgcatgcagcaggtggccacccagttgggcatgttcagccccatcgccctccagtttggagcctacagcgcctacacccaggccctgatgcagcagcaggcggccctggtagcggctcacagtgcctacctcagccccatggccaccatggctgccgtgcagatgcagcacatggctgccatcaatgccaatggcctcatcgccacccccatcaccccatcctcaggaaccagcacccctcctgccatcgctgccacgcctgtctctgccattccggctgccctgggcgtcaacggctacagcccggtgcccacccagcccactgggcagcctgcccctgatgctctgtatcccaacggggttcacccctacccagcccagagccccgcggcccccgtggaccccctgcagcaggcctacgcggggatgcagcactacacagcagcctacccagcagcctacagcctggttgcacctgcgttcccgcagcctccagccctggtcgcccagcagcccccaccaccacctcaacagcagcagcagcagcagcagcagcaacagcagcagcagcaaagagaaggccctgatggctgcaacatcttcatctaccacctgccccaggagttcactgactcagagatcctccagatgtttgtcccctttggccacgtcatctcagccaaagtctttgttgaccgagccaccaatcaaagcaaatgttttggctttgtgagtttcgacaatccggccagtgcccaggctgccatccaggccatgaatggcttccagatcggcatgaagcgcctcaaagtccagctaaagcggcctaaggatgccaaccggccctactga

SEQ ID NO: 8822 - DNA, 1277 bp, synthetic construct
  misc_feature 1..1277: note = Synthetic polypeptide
  source 1..1277: mol_type = other DNA
acatggagagtggaactaggaatttctccatttccactgaagactgaacaaagggagatactgcaggggtcggggagaggttagagctctggaggacttccgtgcacaggatgaacaggccgatccaggtcaagccagccgacagcgagagccgaggagaccggaagctctttgtggggatgctagggaagcagcagacagatgaggacgtccggaagatgtttgagcccttcgggaccatcgacgagtgcactgtgctccgggggccagatggcaccagcaaaggctgcgccttcgtgaagttccagacccacgctgaggcccaggcggccatcaacacccttcacagcagccggaccctgccaggtgcctcgtccagcctggtggtgaagtttgctgacactgagaaggagcgaggtctccgccgcatgcagcaggtggccacccagttgggcatgttcagccccatcgccctccagtttggagcctacagcgcctacacccaggccctgatgcagcagcaggcggccctggtagcggctcacagtgcctacctcagccccatggccaccatggctgccgtgcagatgcagcacatggctgccatcaatgccaatggcctcatcgccacccccatcaccccatcctcaggaaccagcacccctcctgccatcgctgccacgcctgtctctgccattccggctgccctgggcgtcaacggctacagcccggtgcccacccagcccactgggcagcctgcccctgatgctctgtatcccaacggggttcacccctacccagcccagagccccgcggcccccgtggaccccctgcagcaggcctacgcggggatgcagcactacacagcagcctacccagcagcctacagcctggttgcacctgcgttcccgcagcctccagccctggtcgcccagcagcccccaccaccacctcaacagcagcagcagcagcagcagcagcaacagcagcagcagcaaagagaaggccctgatggctgcaacatcttcatctaccacctgccccaggagttcactgactcagagatcctccagatgtttgtcccctttggccacgtcatctcagccaaagtctttgttgaccgagccaccaatcaaagcaaatgttttggctttgtgagtttcgacaatccggccagtgcccaggctgccatccaggccatgaatggcttccagatcggcatgaagcgcctcaaagtccagctaaagcggcctaaggatgccaaccggccctactga

SEQ ID NO: 8823 - DNA, 805 bp, synthetic construct
  misc_feature 1..805: note = Synthetic polypeptide
  source 1..805: mol_type = other DNA
cggaaaggtctgggttcctaagcagaagccactggatcctgtgctggaaagtgtgacgctggaaccggagctggaggaagccttggcaaatgcttcagatgcagaactctgtgacattgcagcgatcctgggcatgcacacgctcatgagtaaccagcagtactaccaggccctgagcagcagctccatcatgaacaaggaggggctcaacagcgtgattaaacccacacaatacaagcctgtgcccgacgaagaaccaaattcaacagacgtagaggaaacgctggaacggataaagaacaacgacccaaaacttgaagaagttaacctcaataatatccggaatatccccatccccaccctcaaggcatatgcagaagccctgaaagaaaactcatatgtgaagaagttcagcatcgtggggacacggagtaatgaccccgtggcgtatgcccttgctgagatgctcaaggagaacaaggtgttgaagacactgaatgtggaatccaacttcatttctggagctgggattctgcgcctggtagaagccctcccatacaacacttctctggtggaaatgaaaattgacaaccagagccagcccctgggcaacaaagtggaaatggagattgtgagcatgttggaaaaaaacgcaacacttctcaaattcggctaccactttacccagcaaggaccccggcttcgggcatccaacgcaatgatgaacaacaatgaccttgtgaggaagaggaggcttgcggacctgactgggcccatcattcccaagtgccggagtggtgtctag

SEQ ID NO: 8824 - DNA, 3042 bp, synthetic construct
  misc_feature 1..3042: note = Synthetic polypeptide
  source 1..3042: mol_type = other DNA
tgatatggtttggatttgtgtccctgcccaaatcacatgtcgaattgtaatccccactgttggaggaggggcctaatgggaggtgattggatcaaggagggattccacccttactgttctcataataatgagttctcatgagtcctggttgtttgaacatgtgtcgcatctcccctttctctctcttcctcctgctccagctgtgtgggacgtgcctgctttgccttcgccttccaccatgatctctttgaccttctcccatcttccagtcagaggctaaacccaggcgctctgctgccagtcctgacagaccccgccctgaatgatctctatgtgatttccaccttcaagctgcagactaaaagttcagccaccatcttcggtctttactcttcaactgacaacagtaaatattttgaatttactgtgatgggacgcttaaacaaagccatcctccgttacctgaagaacgatgggaaggtgcatttggtggttttcaacaacctgcagctggcagacggaaggcggcacaggatcctcctgaggctgagcaatttgcagcgaggggccggctccctagagctctacctggactgcatccaggtggattccgttcacaatctccccagggcctttgctggcccctcccagaaacctgagaccattgaattgaggactttccagaggaagccacaggacttcttggaagagctgaagctggtggtgagaggctcactgttccaggtggccagcctgcaagactgcttcctgcagcagagtgagccactggctgccacaggcacaggggactttaaccggcagttcttgggtcaaatgacacaattaaaccaactcctgggagaggtgaaggaccttctgagacagcaggttaaggaaacatcatttttgcgaaacaccatagctgaatgccaggcttgcggtcctctcaagtttcagtctccgaccccaagcacggtggtgcccccggctccccctgcaccgccaacacgcccacctcgtcggtgtgactccaacccatgtttccgaggtgtccaatgtaccgacagtagagatggcttccagtgtgggccctgccccgagggctacacaggaaacgggatcacctgtattgatgttgatgagtgcaaataccatccctgctacccgggcgtgcactgcataaatttgtctcctggcttcagatgtgacgcctgcccagtgggcttcacagggcccatggtgcagggtgttgggatcagttttgccaagtcaaacaagcaggtctgcactgacattgatgagtgtcgaaatggagcgtgcgttcccaactcgatctgcgttaatactttgggatcttaccgctgtgggccttgtaagccggggtatactggtgatcagataaggggatgcaaagcggaaagaaactgcagaaacccagagctgaacccttgcagtgtgaatgcccagtgcattgaagagaggcagggggatgtgacatgtgtgtgtggagtcggttgggctggagatggctatatctgtggaaaggatgtggacatcgacagttaccccgacgaagaactgccatgctctgccaggaactgtaaaaaggacaactgcaaatatgtgccaaattctggccaagaagatgcagacagagatggcattggcgacgcttgtgacgaggatgctgacggagatgggatcctgaatgagcaggataactgtgtcctgattcataatgtggaccaaaggaacagcgataaagatatctttggggatgcctgtgataactgcctgagtgtcttaaataacgaccagaaagacaccgatggggatggaagaggagatgcctgtgatgatgacatggatggagatggaataaaaaacattctggacaactgcccaaaatttcccaatcgtgaccaacgggacaaggatggtgatggtgtgggggatgcctgtgacagttgtcctgatgtcagcaaccctaaccagtctgatgtggataatgatctggttggggactcctgtgacaccaatcaggacagtgatggagatgggcaccaggacagcacagacaactgccccaccgtcattaacagtgcccagctggacaccgataaggatggaattggtgacgagtgtgatgatgatgatgacaatgatggtatcccagacctggtgccccctggaccagacaactgccggctggtccccaacccagcccaggaggatagcaacagcgacggagtgggagacatctgtgagtctgactttgaccaggaccaggtcatcgatcggatcgacgtctgcccagagaacgcagaggtcaccctgaccgacttcagggcttaccagaccgtggtcctggatcctgaaggggatgcccagatcgatcccaactgggtggtcctgaaccagggcatggagattgtacagaccatgaacagtgatcctggcctggcagtggggtacacagcttttaatggagttgacttcgaagggaccttccatgtgaatacccagacagatgatgactatgcaggctttatctttggctaccaagatagctccagcttctacgtggtcatgtggaagcagacggagcagacatattggcaagccaccccattccgagcagttgcagaacctggcattcagctcaaggctgtgaagtctaagacaggtccaggggagcatctccggaactccctgtggcacacgggggacaccagtgaccaggtcaggctgctgtggaaggactccaggaatgtgggctggaaggacaaggtgtcctaccgctggttcctacagcacaggccccaggtgggctacatcagggtacgattttatgaaggctctgagttggtggctgactctggcgtcaccatagacaccacaatgcgtggaggccgacttggcgttttctgcttctctcaagaaaacatcatctggtccaacctcaagtatcgctgcaatgacaccatccctgaggacttccaagagtttcaaacccagaatttcgaccgcttcgataattaa

SEQ ID NO: 8825 - DNA, 746 bp, synthetic construct
  misc_feature 1..746: note = Synthetic polypeptide
  source 1..746: mol_type = other DNA
gggctcggtggcccacacctgtaatcccagcactttgtgaggctgaggcaggtggatcatctgagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgggaaagtcgctggcgggcaagcgcctcacgggcctgatgcagtcctcctga

SEQ ID NO: 8826 - DNA, 692 bp, synthetic construct
  misc_feature 1..692: note = Synthetic polypeptide
  source 1..692: mol_type = other DNA
gggctcggtggcccacacctgtaatcccagcactttgtgaggctgaggcaggtggatcatctgagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagggaaagtcgctggcgggcaagcgcctcacgggcctgatgcagtcctcctga

SEQ ID NO: 8827 - DNA, 671 bp, synthetic construct
  misc_feature 1..671: note = Synthetic polypeptide
  source 1..671: mol_type = other DNA
gggctcggtggcccacacctgtaatcccagcactttgtgaggctgaggcaggtggatcatctgagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagaaagtgagcaaggtcgtagaacttccctag

SEQ ID NO: 8828 - DNA, 656 bp, synthetic construct
  misc_feature 1..656: note = Synthetic polypeptide
  source 1..656: mol_type = other DNA
gggctcggtggcccacacctgtaatcccagcactttgtgaggctgaggcaggtggatcatctgagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaaggtgtggctactgtga

SEQ ID NO: 8829 - DNA, 716 bp, synthetic construct
  misc_feature 1..716: note = Synthetic polypeptide
  source 1..716: mol_type = other DNA
gggctcggtggcccacacctgtaatcccagcactttgtgaggctgaggcaggtggatcatctgagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgtgtctgcagcttctcttctag

SEQ ID NO: 8830 - DNA, 701 bp, synthetic construct
  misc_feature 1..701: note = Synthetic polypeptide
  source 1..701: mol_type = other DNA
gggctcggtggcccacacctgtaatcccagcactttgtgaggctgaggcaggtggatcatctgagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgggatga

SEQ ID NO: 8831 - DNA, 707 bp, synthetic construct
  misc_feature 1..707: note = Synthetic polypeptide
  source 1..707: mol_type = other DNA
gggctcggtggcccacacctgtaatcccagcactttgtgaggctgaggcaggtggatcatctgagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgcttctcttctag

SEQ ID NO: 8832 - DNA, 635 bp, synthetic construct
  misc_feature 1..635: note = Synthetic polypeptide
  source 1..635: mol_type = other DNA
gggctcggtggcccacacctgtaatcccagcactttgtgaggctgaggcaggtggatcatctgagataacatttttgaacgcacagatcgacagacattgtttgaaaatgtccaaagtggctgaaagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgggaaagtcgctggcgggcaagcgcctcacgggcctgatgcagtcctcctga

SEQ ID NO: 8833 - DNA, 1100 bp, synthetic construct
  misc_feature 1..1100: note = Synthetic polypeptide
  source 1..1100: mol_type = other DNA
gggctcggtggcccacacctgtaatcccagcactttgtgaggctgaggcaggtggatcatctgagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgaatgtgcagaacacaaggcctgcgggtgcctggtctatcttcatggctgctttgccaatggccgtgtggctccgcacaccaagaagctgccacgggctgtcagagtcaaggcttctgggacttccttcactccatgatggcctgagagaaggacagagcctgcctcagtcctgtccggggagcagcagcaccgcagcagagggggccagagaaagagcatccaatggcaggagtctggcaaggcgacagcactgccaatgtcacggtcaaggagaggagacccaactctgcctgtggtccagactggaaagttcaaagagaagtcagagagcttcaagtctgaggacttcaaaggctaagaagaaaagacagactgtcaagcaaggaccgaaagcctggccttaa

SEQ ID NO: 8834 - DNA, 731 bp, synthetic construct
  misc_feature 1..731: note = Synthetic polypeptide
  source 1..731: mol_type = other DNA
gggctcggtggcccacacctgtaatcccagcactttgtgaggctgaggcaggtggatcatctgagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgttgtattccaacactccactcgctaagaggccctga

SEQ ID NO: 8835 - DNA, 29 bp, synthetic construct
  misc_feature 1..29: note = Synthetic polypeptide
  source 1..29: mol_type = other DNA
agaccctgagcctaggaaccacagaataa

SEQ ID NO: 8836 - DNA, 546 bp, synthetic construct
  misc_feature 1..546: note = Synthetic polypeptide
  source 1..546: mol_type = other DNA
agaccctgagcctaggaaccacagaataagagaactccagatttgcctgaagaagagtatgtgaaggaagaaatccaggagaatgaagaagcagtcaaaaagatgcttgtggaagccacccgggagtttgaggaggttgtggtggatgagagccctcctgattttgaaatacatataactatgtgtgatgatgatccacccacacctgaggaagactcagaaacacagcctgatgaggaggaagaagaagaagaagaaaaagtttctcaaccagaggtgggagctgccattaagatcattcggcagttaatggagaagtttaacttggatctatcaacagttacacaggccttcctaaaaaatagtggtgagctggaggctacttccgccttcttagcgtctggtcagagagctgatggatatcccatttggtcccgacaagatgacatagatttgcaaaaagatgatgaggataccagagaggcattggtcaaaaaatttggtgctcagaatgtagctcggaggattgaatttcgaaagaaataa

SEQ ID NO: 8837 - DNA, 807 bp, synthetic construct
  misc_feature 1..807: note = Synthetic polypeptide
  source 1..807: mol_type = other DNA
ggaggctcatgcctgtaatctcagctttgggagaccgagatccatgagaaagaagaggaagagttcaatgagaagagtgaaaatgattccggtatcaacgaggagcctctgctcacagcagatcaggtaattgaggagattgaggaaatgatgcagaactccccagaccctgaggaagaagaggaggttctggaagaagaggatggaggagaaacttcctcccaggcagactcggtcctcctgcaggagatgcaggcattgacacagaccttcaacaacaactggtcctatgaagggctgaggcacatgtctgggtctgagctgaccgagctgctggaccaggtggagggtgccatccgtgacttctcggaggagctggtgcagcagctggcccgccgggacgagctggagtttgagaaggaagtgaagaactcctttatcacggtgcttattgaggttcagaacaagcagaaggagcagcgagaactgatgaaaaagaggcggaaagagaaagggctgagcctgcagagcagccggatagagaagggaaaccagatgcctctcaagcgcttcagcatggaaggcatctccaacattctgcagagtggcatccgccagacctttggctcctcaggaactgacaaacagtatctgaacacagtcattccttacgagaagaaagcctctcctccctcagtggaagacctgcagatgctgacaaacattctctttgccatgaaggaggataatgagaaggtgcctactttgctaacggactacattttaaaagtgctctgccctacctaa

SEQ ID NO: 8838 - DNA, 450 bp, synthetic construct
  misc_feature 1..450: note = Synthetic polypeptide
  source 1..450: mol_type = other DNA
ggaggctcatgcctgtaatctcagctttgggagaccgagatccatgagaaagaagaggaagagttcaatgagaagagtgaaaatgattccggtatcaacgaggagcctctgctcacagcagatcaggtaattgaggagattgaggaaatgatgcagaactccccagaccctgaggaagaagaggaggttctggaagaagaggatggaggagaaacttcctcccaggcagactcggtcctcctgcaggagatgcaggcattgacacagaccttcaacaacaactggtcctatgaagggctgaggcacatgtctgggtctgagctgaccgagctgctggaccaggtggagggtgccatccgtgacttctcggaggagctggtgcagcagctggcccgccgggacgagctggagtttgagaaggaagtgaagaactcctttatcacggtgctt

SEQ ID NO: 8839 - DNA, 1335 bp, synthetic construct
  misc_feature 1..1335: note = Synthetic polypeptide
  source 1..1335: mol_type = other DNA
ggccgggcgcggtggctcacgccagtaatcccagcactttgggaggccgaagcgggctgattgcttgagcccagcagttcgagaccagcctggccaacatggcaaaacaccgtctctacaaaagaaaaatacaaaaattagccgagcgtggtggtggacgcctgttcagctactcaggaggccgagatcattcataatttcataagacggatccagaccaaaattaaagatcttctgcagcaaatggaagaagggctgaagacagctgatccccatgactgctctgcttatactggctggacaggcatagcccttttgtacctgcagttgtaccgggtcacatgtgaccaaacctacctgctccgatccctggattacgtaaaaagaacacttcggaatctgaatggccgcagggtcaccttcctctgtggggatgctggccccctggctgttggagctgtgatttatcacaaactcagaagtgactgtgagtcccaggaatgtgtcacaaaacttttgcagctccagagatcggttgtctgccaagaatcagaccttcctgatgagctgctttatggacgggcaggttatctgtatgccttactgtacctgaacacagagataggtccaggcaccgtgtgtgagtcagctattaaagaggtagtcaatgctattattgaatcgggtaagactttgtcaagggaagaaagaaaaacggagcgctgcccgctgttgtaccagtggcaccggaagcagtacgttggagcagcccatggcatggctggaatttactatatgttaatgcagccggcagcaaaagtggaccaagaaaccttgacagaaatggtgaaacccagtattgattatgtgcgccacaaaaaattccgatctgggaattacccatcatcattaagcaatgaaacagaccggctggtgcactggtgccacggcgccccgggggtcatccacatgctcatgcaggcgtacaaggtctttaaggaggagaagtacttgaaagaggccatggagtgtagcgatgtgatttggcagcgaggtttgctgcggaagggctacgggatatgccatgggactgctggcaacggctattccttcctgtccctttaccgtctcacgcaggataagaagtacctctaccgagcttgcaagtttgcagagtggtgtctagattacggagcacacgggtgccgcattcctgacagaccctattcgctctttgaaggcatggctggcgctattcactttctctctgatgtcctgggaccagagacatcacggtttccagcatttgaacttgactcttcgaagagggattaa

SEQ ID NO: 8840 - DNA, 22 bp, synthetic construct
  misc_feature 1..22: note = Synthetic polypeptide
  source 1..22: mol_type = other DNA
ccagactgagcaagtggagtag

SEQ ID NO: 8841 - DNA, 3311 bp, synthetic construct
  misc_feature 1..3311: note = Synthetic polypeptide
  source 1..3311: mol_type = other DNA
catggtaaatttggaggttaagtgctacatgggcactccaggtgacattactaccacagaatcacagactgatcaaatttgctgtcctcatgggtcttacagatgcttaataaaacactggggtaattaacaaagaataatgagaaaggcaaaagggagtcagaggactcaccccagagggtgattaaaatatttggacgttttataagaaatgaaataaataaaatgaaaattgatggggttgaaacaaaggtctttacaacactatcaagggttgagtggaccaaagggaacccctactgatcctccaacattaaagggccccatatcagttttctgcatttgccccagattggggaaattgaagaaacagcaaaaggcaaaggttataatgagggagctgaaattgcctggggcaaatctgaggcaaattaagatgaagattgaaaaaagagcccaagtcccttggctcaatcccttgctgggaactcaaatcatttttcaccagaaaaagtaaaatggtctgggggtagaaaagaaaagttcctcaaaccagaacataaaaatgtacaggttgataggattatgaaatttgagatgtctaaacagcctttatgtaaggtaattttaacttcttcacctaaatatcttgtgaaaattggtattgtatctgattgggggatgtttctcctatcaagtactatgaaactgaagtcatgtaaatgtgccctttgaggaatgttaattggacacactaaatggaaactagtaagattgcctgagcctacacaatgtagggtagaagctgaagggctagtagggacaaattctccacttcatatccatttgtggagcatttattagggcttatggtaaaagactgggagcacttcccaatgacaaatactagactagagaatttccagttgagggacatttactgccttgttatggaatgttaactgaagctacccctttgctaaaggaaataatggtaccccaaagagttccataataaagtaaaaattgtttgcataggatcttgctacctgaggatgcagaggagatacttatgagcagagagcattctttttcccctagggctgactctgactctgtaaggagctgctagattctacagtgcctggtaaacagctctcatataacaagaactgcttagcatgtgaatggcaattcaaggtgaacaaaggacatgttgtttggaaggctgatgctctggttaaagagtcaagagaatctttttcttttaaattatttattctttagagcaattgggtgaagtatgtttttatgagcaaatttacctttctctccaagttctcccaaatttggaaaccatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatgattggcattggatgtgtggttatgggcttaggctgtttcttaaaatcactacctcatttcctcatgaaccaatatgaatatgaatctacagtttcagtttcaggcaacttgtcctcaaacagtttcttgtgtatggaaaatggaacccagattttaagaccaacgcaggatccatcagagtgtacaaaggaagttaaatcattaatgtgggtgtacgtcctagtaggcaatattgtacgtggaatgggtgaaactcccatcctgcctttgggtatttcctatatagaagattttgccaaatttgaaaattctcctttatatattgggcttgtagaaacaggagctattattggtcctttgattggacttttgttggcatcattctgtgcaaatgtttatgttgacactggatttgtgaacacagatgatctgatcataactcccactgacactcgttgggtcggtgcatggtggtttggctttctgatttgtgcaggagttaacgtgctcactgccattccttttttctttttgcccaacacacttccaaaggaaggactagagactaatgctgacatcattaaaaatgaaaatgaagacaaacaaaaagaagaggtcaagaaggaaaaatatggaatcactaaagattttctacctttcatgaaaagtctttcctgcaatccaatttatatgcttttcatacttgtaagtgtgatacagttcaatgcattcgttaacatgatctccttcatgcctaaatacctagaacagcaatatggaatatcatcttcagatgcaatctttctaatgggtatttataacttacctccaatatgtattggatatataattggtggtttaattatgaagaagttcaagattactgtcaaacaagctgcccacataggatgttggttatccttacttgagtatcttctctattttttatcttttctcatgacttgtgaaaattcttcagttgttggaataaatacctcttatgaaggaattccacaagatttatatgtggaaaatgacatctttgctgattgcaatgtggattgcaactgtccatctaaaatatgggatcctgtgtgtggaaacaatggcttgtcatatctgtcagcttgtcttgctggttgtgagacatccattggaacgggaataaacatggtgttccaaaattgcagctgtattcaaacatcaggaaattcatctgcagttcttgggctgtgcgacaaaggacctgactgttccttgatgctccagtacttcctaatcttgtcagcgatgagcagtttcatttattctttggctgccatacctggatatatggttctcttgaggtgtatgaaatctgaagagaagtcccttggtgtgggattacatacattttgcacaagagtatttgctggcattcctgcacctatatattttggcgctttaatggattccacatgtttacactggggaactttgaaatgtggtgagtcaggggcatgcaggatatatgattccaccaccttcagatacatctacctcggattgccggcagcactaagaggatcaagctttgttccagccttaatcatcttaattcttttgaggaagtgtcatctacctggtgaaaatgcctcttcaggaacagagcttatagagacaaaagtcaaagggaaggaaaatgagtgcaaagatatataccaaaagtccacggttttgaaagatgatgaattgaaaactaaattgtaa

SEQ ID NO: 8842 - DNA, 1586 bp, synthetic construct
  misc_feature 1..1586: note = Synthetic polypeptide
  source 1..1586: mol_type = other DNA
catggtaaatttggaggttaagtgctacatgggcactccaggtgacattactaccacagaatcacagactgatcaaatttgctgtcctcatgggtcttacagatgcttaataaaacactggggtaattaacaaagaataatgagaaaggcaaaagggagtcagaggactcaccccagagggtgattaaaatatttggacgttttataagaaatgaaataaataaaatgaaaattgatggggttgaaacaaaggtctttacaacactatcaagggttgagtggaccaaagggaacccctactgatcctccaacattaaagggccccatatcagttttctgcatttgccccagattggggaaattgaagaaacagcaaaaggcaaaggttataatgagggagctgaaattgcctggggcaaatctgaggcaaattaagatgaagattgaaaaaagagcccaagtcccttggctcaatcccttgctgggaactcaaatcatttttcaccagaaaaagtaaaatggtctgggggtagaaaagaaaagttcctcaaaccagaacataaaaatgtacaggttgataggattatgaaatttgagatgtctaaacagcctttatgtaaggtaattttaacttcttcacctaaatatcttgtgaaaattggtattgtatctgattgggggatgtttctcctatcaagtactatgaaactgaagtcatgtaaatgtgccctttgaggaatgttaattggacacactaaatggaaactagtaagattgcctgagcctacacaatgtagggtagaagctgaagggctagtagggacaaattctccacttcatatccatttgtggagcatttattagggcttatggtaaaagactgggagcacttcccaatgacaaatactagactagagaatttccagttgagggacatttactgccttgttatggaatgttaactgaagctacccctttgctaaaggaaataatggtaccccaaagagttccataataaagtaaaaattgtttgcataggatcttgctacctgaggatgcagaggagatacttatgagcagagagcattctttttcccctagggctgactctgactctgtaaggagctgctagattctacagtgcctggtaaacagctctcatataacaagaactgcttagcatgtgaatggcaattcaaggtgaacaaaggacatgttgtttggaaggctgatgctctggttaaagagtcaagagaatctttttcttttaaattatttattctttagagcaattgggtgaagtatgtttttatgagcaaatttacctttctctccaagttctcccaaatttggaaaccatgtttctgttggcaataacatgtgcatttgtatccaaaacactgtctggatcttatatgaattccatgctcacacaaatagagagacaattcaacatcccaacatctctagttggattcattaatggaagctttgagattgatatgaatatgaatctacagtttcagtttcaggcaacttgtcctcaaacagtttcttgtgtatggaaaatggaacccagattttaa

SEQ ID NO: 8843 - DNA, 3044 bp, synthetic construct
  misc_feature 1..3044: note = Synthetic polypeptide
  source 1..3044: mol_type = other DNA
catggtaaatttggaggttaagtgctacatgggcactccaggtgacattactaccacagaatcacagactgatcaaatttgctgtcctcatgggtcttacagatgcttaataaaacactggggtaattaacaaagaataatgagaaaggcaaaagggagtcagaggactcaccccagagggtgattaaaatatttggacgttttataagaaatgaaataaataaaatgaaaattgatggggttgaaacaaaggtctttacaacactatcaagggttgagtggaccaaagggaacccctactgatcctccaacattaaagggccccatatcagttttctgcatttgccccagattggggaaattgaagaaacagcaaaaggcaaaggttataatgagggagctgaaattgcctggggcaaatctgaggcaaattaagatgaagattgaaaaaagagcccaagtcccttggctcaatcccttgctgggaactcaaatcatttttcaccagaaaaagtaaaatggtctgggggtagaaaagaaaagttcctcaaaccagaacataaaaatgtacaggttgataggattatgaaatttgagatgtctaaacagcctttatgtaaggtaattttaacttcttcacctaaatatcttgtgaaaattggtattgtatctgattgggggatgtttctcctatcaagtactatgaaactgaagtcatgtaaatgtgccctttgaggaatgttaattggacacactaaatggaaactagtaagattgcctgagcctacacaatgtagggtagaagctgaagggctagtagggacaaattctccacttcatatccatttgtggagcatttattagggcttatggtaaaagactgggagcacttcccaatgacaaatactagactagagaatttccagttgagggacatttactgccttgttatggaatgttaactgaagctacccctttgctaaaggaaataatggtaccccaaagagttccataataaagtaaaaattgtttgcataggatcttgctacctgaggatgcagaggagatacttatgagcagagagcattctttttcccctagggctgactctgactctgtaaggagctgctagattctacagtgcctggtaaacagctctcatataacaagaactgcttagcatgtgaatggcaattcaaggtgaacaaaggacatgttgtttggaaggctgatgctctggttaaagagtcaagagaatctttttcttttaaattatttattctttagagcaattgggtgaagtatgtttttatgagcaaatttacctttctctccaagttctcccaaatttggaaaccatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatgattggcattggatgtgtggttatgggcttaggctgtttcttaaaatcactacctcatttcctcatgaaccaatatgaatatgaatctacagtttcagtttcaggcaacttgtcctcaaacagtttcttgtgtatggaaaatggaacccagattttaagaccaacgcaggatccatcagagtgtacaaaggaagttaaatcattaatgtgggtgtacgtcctagtaggcaatattgtacgtggaatgggtgaaactcccatcctgcctttgggtatttcctatatagaagattttgccaaatttgaaaattctcctttatatattgggcttgtagaaacaggagctattattggtcctttgattggacttttgttggcatcattctgtgcaaatgtttatgttgacactggatttgtgaacacagatgatctgatcataactcccactgacactcgttgggtcggtgcatggtggtttggctttctgatttgtgcaggagttaacgtgctcactgccattccttttttctttttgcccaacacacttccaaaggaaggactagagactaatgctgacatcattaaaaatgaaaatgaagacaaacaaaaagaagaggtcaagaaggaaaaatatggaatcactaaagattttctacctttcatgaaaagtctttcctgcaatccaatttatatgcttttcatacttgtaagtgtgatacagttcaatgcattcgttaacatgatctccttcatgcctaaatacctagaacagcaatatggaatatcatcttcagatgcaatctttctaatgggtatttataacttacctccaatatgtattggatatataattggtggtttaattatgaagaagttcaagattactgtcaaacaagctgcccacataggatgttggttatccttacttgagtatcttctctattttttatcttttctcatgacttgtgaaaattcttcagttgttggaataaatacctcttatgaaggaattccacaagatttatatgtggaaaatgacatctttgctgattgcaatgtggattgcaactgtccatctaaaatatgggatcctgtgtgtggaaacaatggcttgtcatatctgtcagcttgtcttgctggttgtgagacatccattggaacgggaataaacatggtgttccaaaattgcagctgtattcaaacatcaggaaattcatctgcagttcttgggctgtgcgacaaaggacctgactgttccttgatgctccagtacttcctaatcttgtcagcgatgagcagtttcatttattctttggctgccatacctggatatatggttctcttgaggtgtatgaaatctgaagagaagtcccttggtgtgggattacatacattttgcacaagagtatttggtaaaaatagttattttttcccacatcctatcagaacaatattattattattattttttattacactttaa

SEQ ID NO: 8844 - DNA, 1740 bp, synthetic construct
  misc_feature 1..1740: note = Synthetic polypeptide
  source 1..1740: mol_type = other DNA
catggtaaatttggaggttaagtgctacatgggcactccaggtgacattactaccacagaatcacagactgatcaaatttgctgtcctcatgggtcttacagatgcttaataaaacactggggtaattaacaaagaataatgagaaaggcaaaagggagtcagaggactcaccccagagggtgattaaaatatttggacgttttataagaaatgaaataaataaaatgaaaattgatggggttgaaacaaaggtctttacaacactatcaagggttgagtggaccaaagggaacccctactgatcctccaacattaaagggccccatatcagttttctgcatttgccccagattggggaaattgaagaaacagcaaaaggcaaaggttataatgagggagctgaaattgcctggggcaaatctgaggcaaattaagatgaagattgaaaaaagagcccaagtcccttggctcaatcccttgctgggaactcaaatcatttttcaccagaaaaagtaaaatggtctgggggtagaaaagaaaagttcctcaaaccagaacataaaaatgtacaggttgataggattatgaaatttgagatgtctaaacagcctttatgtaaggtaattttaacttcttcacctaaatatcttgtgaaaattggtattgtatctgattgggggatgtttctcctatcaagtactatgaaactgaagtcatgtaaatgtgccctttgaggaatgttaattggacacactaaatggaaactagtaagattgcctgagcctacacaatgtagggtagaagctgaagggctagtagggacaaattctccacttcatatccatttgtggagcatttattagggcttatggtaaaagactgggagcacttcccaatgacaaatactagactagagaatttccagttgagggacatttactgccttgttatggaatgttaactgaagctacccctttgctaaaggaaataatggtaccccaaagagttccataataaagtaaaaattgtttgcataggatcttgctacctgaggatgcagaggagatacttatgagcagagagcattctttttcccctagggctgactctgactctgtaaggagctgctagattctacagtgcctggtaaacagctctcatataacaagaactgcttagcatgtgaatggcaattcaaggtgaacaaaggacatgttgtttggaaggctgatgctctggttaaagagtcaagagaatctttttcttttaaattatttattctttagagcaattgggtgaagtatgtttttatgagcaaatttacctttctctccaagttctcccaaatttggaaaccatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatgattggcattggatgtgtggttatgggcttaggctgtttcttaaaatcactacctcatttcctcatgaaccaatatgaatatgaatctacagtttcagtttcaggcaacttgtcctcaaacagtttcttgtgtatggaaaatggaacccagattttaagaccaacgcaggatccatcag

SEQ ID NO: 8845 - DNA, 1708 bp, synthetic construct
  misc_feature 1..1708: note = Synthetic polypeptide
  source 1..1708: mol_type = other DNA
catggtaaatttggaggttaagtgctacatgggcactccaggtgacattactaccacagaatcacagactgatcaaatttgctgtcctcatgggtcttacagatgcttaataaaacactggggtaattaacaaagaataatgagaaaggcaaaagggagtcagaggactcaccccagagggtgattaaaatatttggacgttttataagaaatgaaataaataaaatgaaaattgatggggttgaaacaaaggtctttacaacactatcaagggttgagtggaccaaagggaacccctactgatcctccaacattaaagggccccatatcagttttctgcatttgccccagattggggaaattgaagaaacagcaaaaggcaaaggttataatgagggagctgaaattgcctggggcaaatctgaggcaaattaagatgaagattgaaaaaagagcccaagtcccttggctcaatcccttgctgggaactcaaatcatttttcaccagaaaaagtaaaatggtctgggggtagaaaagaaaagttcctcaaaccagaacataaaaatgtacaggttgataggattatgaaatttgagatgtctaaacagcctttatgtaaggtaattttaacttcttcacctaaatatcttgtgaaaattggtattgtatctgattgggggatgtttctcctatcaagtactatgaaactgaagtcatgtaaatgtgccctttgaggaatgttaattggacacactaaatggaaactagtaagattgcctgagcctacacaatgtagggtagaagctgaagggctagtagggacaaattctccacttcatatccatttgtggagcatttattagggcttatggtaaaagactgggagcacttcccaatgacaaatactagactagagaatttccagttgagggacatttactgccttgttatggaatgttaactgaagctacccctttgctaaaggaaataatggtaccccaaagagttccataataaagtaaaaattgtttgcataggatcttgctacctgaggatgcagaggagatacttatgagcagagagcattctttttcccctagggctgactctgactctgtaaggagctgctagattctacagtgcctggtaaacagctctcatataacaagaactgcttagcatgtgaatggcaattcaaggtgaacaaaggacatgttgtttggaaggctgatgctctggttaaagagtcaagagaatctttttcttttaaattatttattctttagagcaattgggtgaagtatgtttttatgagcaaatttacctttctctccaagttctcccaaatttggaaaccatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatgattggcattggatgtgtggttatgggcttaggctgtttcttaaaatcactacctcatttcctcatgaaccaatatgaatatgaatctacagtttcagtttcaggcaacttgtcctcaaacagtttcttgtgtatggaaaatggaac

SEQ ID NO: 8846 - DNA, 1597 bp, synthetic construct
  misc_feature 1..1597: note = Synthetic polypeptide
  source 1..1597: mol_type = other DNA
catggtaaatttggaggttaagtgctacatgggcactccaggtgacattactaccacagaatcacagactgatcaaatttgctgtcctcatgggtcttacagatgcttaataaaacactggggtaattaacaaagaataatgagaaaggcaaaagggagtcagaggactcaccccagagggtgattaaaatatttggacgttttataagaaatgaaataaataaaatgaaaattgatggggttgaaacaaaggtctttacaacactatcaagggttgagtggaccaaagggaacccctactgatcctccaacattaaagggccccatatcagttttctgcatttgccccagattggggaaattgaagaaacagcaaaaggcaaaggttataatgagggagctgaaattgcctggggcaaatctgaggcaaattaagatgaagattgaaaaaagagcccaagtcccttggctcaatcccttgctgggaactcaaatcatttttcaccagaaaaagtaaaatggtctgggggtagaaaagaaaagttcctcaaaccagaacataaaaatgtacaggttgataggattatgaaatttgagatgtctaaacagcctttatgtaaggtaattttaacttcttcacctaaatatcttgtgaaaattggtattgtatctgattgggggatgtttctcctatcaagtactatgaaactgaagtcatgtaaatgtgccctttgaggaatgttaattggacacactaaatggaaactagtaagattgcctgagcctacacaatgtagggtagaagctgaagggctagtagggacaaattctccacttcatatccatttgtggagcatttattagggcttatggtaaaagactgggagcacttcccaatgacaaatactagactagagaatttccagttgagggacatttactgccttgttatggaatgttaactgaagctacccctttgctaaaggaaataatggtaccccaaagagttccataataaagtaaaaattgtttgcataggatcttgctacctgaggatgcagaggagatacttatgagcagagagcattctttttcccctagggctgactctgactctgtaaggagctgctagattctacagtgcctggtaaacagctctcatataacaagaactgcttagcatgtgaatggcaattcaaggtgaacaaaggacatgttgtttggaaggctgatgctctggttaaagagtcaagagaatctttttcttttaaattatttattctttagagcaattgggtgaagtatgtttttatgagcaaatttacctttctctccaagttctcccaaatttggaaaccatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatgattggcattggatgtgtggttatgggcttaggctg

SEQ ID NO: 8847 - DNA, 1571 bp, synthetic construct
  misc_feature 1..1571: note = Synthetic polypeptide
  source 1..1571: mol_type = other DNA
catggtaaatttggaggttaagtgctacatgggcactccaggtgacattactaccacagaatcacagactgatcaaatttgctgtcctcatgggtcttacagatgcttaataaaacactggggtaattaacaaagaataatgagaaaggcaaaagggagtcagaggactcaccccagagggtgattaaaatatttggacgttttataagaaatgaaataaataaaatgaaaattgatggggttgaaacaaaggtctttacaacactatcaagggttgagtggaccaaagggaacccctactgatcctccaacattaaagggccccatatcagttttctgcatttgccccagattggggaaattgaagaaacagcaaaaggcaaaggttataatgagggagctgaaattgcctggggcaaatctgaggcaaattaagatgaagattgaaaaaagagcccaagtcccttggctcaatcccttgctgggaactcaaatcatttttcaccagaaaaagtaaaatggtctgggggtagaaaagaaaagttcctcaaaccagaacataaaaatgtacaggttgataggattatgaaatttgagatgtctaaacagcctttatgtaaggtaattttaacttcttcacctaaatatcttgtgaaaattggtattgtatctgattgggggatgtttctcctatcaagtactatgaaactgaagtcatgtaaatgtgccctttgaggaatgttaattggacacactaaatggaaactagtaagattgcctgagcctacacaatgtagggtagaagctgaagggctagtagggacaaattctccacttcatatccatttgtggagcatttattagggcttatggtaaaagactgggagcacttcccaatgacaaatactagactagagaatttccagttgagggacatttactgccttgttatggaatgttaactgaagctacccctttgctaaaggaaataatggtaccccaaagagttccataataaagtaaaaattgtttgcataggatcttgctacctgaggatgcagaggagatacttatgagcagagagcattctttttcccctagggctgactctgactctgtaaggagctgctagattctacagtgcctggtaaacagctctcatataacaagaactgcttagcatgtgaatggcaattcaaggtgaacaaaggacatgttgtttggaaggctgatgctctggttaaagagtcaagagaatctttttcttttaaattatttattctttagagcaattgggtgaagtatgtttttatgagcaaatttacctttctctccaagttctcccaaatttggaaaccatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatgattggcatt

SEQ ID NO: 8848 - DNA, 1562 bp, synthetic construct
  misc_feature 1..1562: note = Synthetic polypeptide
  source 1..1562: mol_type = other DNA
catggtaaatttggaggttaagtgctacatgggcactccaggtgacattactaccacagaatcacagactgatcaaatttgctgtcctcatgggtcttacagatgcttaataaaacactggggtaattaacaaagaataatgagaaaggcaaaagggagtcagaggactcaccccagagggtgattaaaatatttggacgttttataagaaatgaaataaataaaatgaaaattgatggggttgaaacaaaggtctttacaacactatcaagggttgagtggaccaaagggaacccctactgatcctccaacattaaagggccccatatcagttttctgcatttgccccagattggggaaattgaagaaacagcaaaaggcaaaggttataatgagggagctgaaattgcctggggcaaatctgaggcaaattaagatgaagattgaaaaaagagcccaagtcccttggctcaatcccttgctgggaactcaaatcatttttcaccagaaaaagtaaaatggtctgggggtagaaaagaaaagttcctcaaaccagaacataaaaatgtacaggttgataggattatgaaatttgagatgtctaaacagcctttatgtaaggtaattttaacttcttcacctaaatatcttgtgaaaattggtattgtatctgattgggggatgtttctcctatcaagtactatgaaactgaagtcatgtaaatgtgccctttgaggaatgttaattggacacactaaatggaaactagtaagattgcctgagcctacacaatgtagggtagaagctgaagggctagtagggacaaattctccacttcatatccatttgtggagcatttattagggcttatggtaaaagactgggagcacttcccaatgacaaatactagactagagaatttccagttgagggacatttactgccttgttatggaatgttaactgaagctacccctttgctaaaggaaataatggtaccccaaagagttccataataaagtaaaaattgtttgcataggatcttgctacctgaggatgcagaggagatacttatgagcagagagcattctttttcccctagggctgactctgactctgtaaggagctgctagattctacagtgcctggtaaacagctctcatataacaagaactgcttagcatgtgaatggcaattcaaggtgaacaaaggacatgttgtttggaaggctgatgctctggttaaagagtcaagagaatctttttcttttaaattatttattctttagagcaattgggtgaagtatgtttttatgagcaaatttacctttctctccaagttctcccaaatttggaaaccatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatg

SEQ ID NO: 8849 - DNA, 1518 bp, synthetic construct
  misc_feature 1..1518: note = Synthetic polypeptide
  source 1..1518: mol_type = other DNA
catggtaaatttggaggttaagtgctacatgggcactccaggtgacattactaccacagaatcacagactgatcaaatttgctgtcctcatgggtcttacagatgcttaataaaacactggggtaattaacaaagaataatgagaaaggcaaaagggagtcagaggactcaccccagagggtgattaaaatatttggacgttttataagaaatgaaataaataaaatgaaaattgatggggttgaaacaaaggtctttacaacactatcaagggttgagtggaccaaagggaacccctactgatcctccaacattaaagggccccatatcagttttctgcatttgccccagattggggaaattgaagaaacagcaaaaggcaaaggttataatgagggagctgaaattgcctggggcaaatctgaggcaaattaagatgaagattgaaaaaagagcccaagtcccttggctcaatcccttgctgggaactcaaatcatttttcaccagaaaaagtaaaatggtctgggggtagaaaagaaaagttcctcaaaccagaacataaaaatgtacaggttgataggattatgaaatttgagatgtctaaacagcctttatgtaaggtaattttaacttcttcacctaaatatcttgtgaaaattggtattgtatctgattgggggatgtttctcctatcaagtactatgaaactgaagtcatgtaaatgtgccctttgaggaatgttaattggacacactaaatggaaactagtaagattgcctgagcctacacaatgtagggtagaagctgaagggctagtagggacaaattctccacttcatatccatttgtggagcatttattagggcttatggtaaaagactgggagcacttcccaatgacaaatactagactagagaatttccagttgagggacatttactgccttgttatggaatgttaactgaagctacccctttgctaaaggaaataatggtaccccaaagagttccataataaagtaaaaattgtttgcataggatcttgctacctgaggatgcagaggagatacttatgagcagagagcattctttttcccctagggctgactctgactctgtaaggagctgctagattctacagtgcctggtaaacagctctcatataacaagaactgcttagcatgtgaatggcaattcaaggtgaacaaaggacatgttgtttggaaggctgatgctctggttaaagagtcaagagaatctttttcttttaaattatttattctttagagcaattgggtgaagtatgtttttatgagcaaatttacctttctctccaagttctcccaaatttggaaaccatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgatta

SEQ ID NO: 8850 - DNA, 1451 bp, synthetic construct
  misc_feature 1..1451: note = Synthetic polypeptide
  source 1..1451: mol_type = other DNA
catggtaaatttggaggttaagtgctacatgggcactccaggtgacattactaccacagaatcacagactgatcaaatttgctgtcctcatgggtcttacagatgcttaataaaacactggggtaattaacaaagaataatgagaaaggcaaaagggagtcagaggactcaccccagagggtgattaaaatatttggacgttttataagaaatgaaataaataaaatgaaaattgatggggttgaaacaaaggtctttacaacactatcaagggttgagtggaccaaagggaacccctactgatcctccaacattaaagggccccatatcagttttctgcatttgccccagattggggaaattgaagaaacagcaaaaggcaaaggttataatgagggagctgaaattgcctggggcaaatctgaggcaaattaagatgaagattgaaaaaagagcccaagtcccttggctcaatcccttgctgggaactcaaatcatttttcaccagaaaaagtaaaatggtctgggggtagaaaagaaaagttcctcaaaccagaacataaaaatgtacaggttgataggattatgaaatttgagatgtctaaacagcctttatgtaaggtaattttaacttcttcacctaaatatcttgtgaaaattggtattgtatctgattgggggatgtttctcctatcaagtactatgaaactgaagtcatgtaaatgtgccctttgaggaatgttaattggacacactaaatggaaactagtaagattgcctgagcctacacaatgtagggtagaagctgaagggctagtagggacaaattctccacttcatatccatttgtggagcatttattagggcttatggtaaaagactgggagcacttcccaatgacaaatactagactagagaatttccagttgagggacatttactgccttgttatggaatgttaactgaagctacccctttgctaaaggaaataatggtaccccaaagagttccataataaagtaaaaattgtttgcataggatcttgctacctgaggatgcagaggagatacttatgagcagagagcattctttttcccctagggctgactctgactctgtaaggagctgctagattctacagtgcctggtaaacagctctcatataacaagaactgcttagcatgtgaatggcaattcaaggtgaacaaaggacatgttgtttggaaggctgatgctctggttaaagagtcaagagaatctttttcttttaaattatttattctttagagcaattgggtgaagtatgtttttatgagcaaatttacctttctctccaagttctcccaaatttggaaaccatgtttctgttggcaataacatgtgcatttgtatccaaaacactgtctggatcttatatgaattccatgctcacacaaatagagagacaattc

SEQ ID NO: 8851 - DNA, 497 bp, synthetic construct; identical to SEQ ID NO: 6379
  misc_feature 1..497: note = Synthetic polypeptide
  source 1..497: mol_type = other DNA

SEQ ID NO: 8852 - DNA, 550 bp, synthetic construct
  misc_feature 1..550: note = Synthetic polypeptide
  source 1..550: mol_type = other DNA
ctccactccttgctagctgtgtgacctagagccaatatcaagtctcagtttcttcatgggtaaaatggagataatgtcgactcctgccttaaaaggctgctgtgaggatgacctgcggtaacgcatttaaaacacctaccagtgcgtgacactttgtagagtgatcatcaccatgctggtcgccaccgccgtctgctgttacctcttgtgcccagctctcggaatgactgtggctccactgtccctgacaaccccttcgtccggaccctcccccacacaactatgtctggtcaccagctccctcctgctggcacccagagacccggacccgcagggcctgcctggttcctggaagtcttcccagtcttcccagccagcccgggccctggggagccctgggcacagcagcggccgaggggatgtcctgctccaatacccgcactgctctggagtttgccctctttcccaaggagatgctgctggggagctggtatgggtggggtctttccctttacagacggggcagatgccaggactcagcccatcctga

SEQ ID NO: 8853 - DNA, 301 bp, synthetic construct
  misc_feature 1..301: note = Synthetic polypeptide
  source 1..301: mol_type = other DNA
ctccactccttgctagctgtgtgacctagagccaatatcaagtctcagtttcttcatgggtaaaatggagataatgtcgactcctgccttaaaaggctgctgtgaggatgacctgcggtaacgcatttaaaacacctaccagtgcgtgacactttgtagagtgatcatcaccatgctggtcgccaccgccgtctgctgttacctcttctggctcatcgccatcctggcgcagctgaaccccctgttcgggccccagctgaagaatgagaccatctggtacgtgcgcttcctgtgggagtga

SEQ ID NO: 8854 - DNA, 295 bp, synthetic construct
  misc_feature 1..295: note = Synthetic polypeptide
  source 1..295: mol_type = other DNA
ctccactccttgctagctgtgtgacctagagccaatatcaagtctcagtttcttcatgggtaaaatggagataatgtcgactcctgccttaaaaggctgctgtgaggatgacctgcggtaacgcatttaaaacacctaccagtgcgtgacactttgtagagtgatcatcaccatgctggtcgccaccgccgtctgctgttacctcttttttcaggctgcaccctacacccatgaaattacaactctcgagatctgcacttgggaattcctgttgttcatgaatgcccccaggtga

SEQ ID NO: 8855 - DNA, 619 bp, synthetic construct
  misc_feature 1..619: note = Synthetic polypeptide
  source 1..619: mol_type = other DNA
ctccactccttgctagctgtgtgacctagagccaatatcaagtctcagtttcttcatgggtaaaatggagataatgtcgactcctgccttaaaaggctgctgtgaggatgacctgcggtaacgcatttaaaacacctaccagtgcgtgacactttgtagagtgatcatcaccatgctggtcgccaccgccgtctgctgttacctcttctggctcatcgccatcctggcgcagctgaaccccctgttcgggccccagctgaagaatgagaccatctggtgcccagctctcggaatgactgtggctccactgtccctgacaaccccttcgtccggaccctcccccacacaactatgtctggtcaccagctccctcctgctggcacccagagacccggacccgcagggcctgcctggttcctggaagtcttcccagtcttcccagccagcccgggccctggggagccctgggcacagcagcggccgaggggatgtcctgctccaatacccgcactgctctggagtttgccctctttcccaaggagatgctgctggggagctggtatgggtggggtctttccctttacagacggggcagatgccaggactcagcccatcctga

SEQ ID NO: 8856 - DNA, 479 bp, synthetic construct
  misc_feature 1..479: note = Synthetic polypeptide
  source 1..479: mol_type = other DNA
tgataagcactgagagatcctcagtgaaggtaacccggcctgcagcagttcgcctattgatcctcggtattggcttggcaccttattgcccaaactggtaggatgattgctgaaatctgggaccttgttcctccagggatccctgatcttccaacgtttttcggtggggggtctgaggtttatttgctgttaaaaaactccttttttgggagttcccactcgcttcatcaaggaaggcaagcctgcctgcttctgcatcgacagatagccgtcttcagcttgagccccatcactaggaacccttaacattcagggatgtggccatagaattctctccagaagagtggaaatgcctggaccctgcccagcagaatttgtatagagatgtgatgttggagaactacagaaacctggtctccctagaggaaggaacagagccacagagaaaaatgacttgctcacaacagaagagccagtag

SEQ ID NO: 8857 - DNA, 692 bp, synthetic construct
  misc_feature 1..692: note = Synthetic polypeptide
  source 1..692: mol_type = other DNA
tgataagcactgagagatcctcagtgaaggtaacccggcctgcagcagttcgcctattgatcctcggtattggcttggcaccttattgcccaaactggtaggatgattgctgaaatctgggaccttgttcctccagggatccctgatcttccaacgtttttcggtggggggtctgaggtttatttgctgttaaaaaactccttttttgggagttcccactcgcttcatcaaggaaggcaagcctgcctgcttctgcatcgacagatagccgtcttcagcttgagccccatcactaggaacccttaacattcagggatgtggccatagaattctctccagaagagtggaaatgcctggaccctgcccagcagaatttgtatagagatgtgatgttggagaactacagaaacctggtctccctagctatgtgttctcatttcacccaagactttttgccagtgcaggggatagaagattcattccacaaacttatactgagaagatatgagaaattttcctcgctgatctcttcatgccgtgtaatttcacatggactttcaagaggaaggaacagagccacagagaaaaatgacttgctcacaacagaagagccagtagtaaaacacaggtttgacttgcagtatccagaggaaatgtggagaaacacagttgtacagaagggaagaaaatag

SEQ ID NO: 8858 - DNA, 773 bp, synthetic construct
  misc_feature 1..773: note = Synthetic polypeptide
  source 1..773: mol_type = other DNA
tgataagcactgagagatcctcagtgaaggtaacccggcctgcagcagttcgcctattgatcctcggtattggcttggcaccttattgcccaaactggtaggatgattgctgaaatctgggaccttgttcctccagggatccctgatcttccaacgtttttcggtggggggtctgaggtttatttgctgttaaaaaactccttttttgggagttcccactcgcttcatcaaggaaggcaagcctgcctgcttctgcatcgacagatagccgtcttcagcttgagccccatcactaggaacccttaacattcagggatgtggccatagaattctctccagaagagtggaaatgcctggaccctgcccagcagaatttgtatagagatgtgatgttggagaactacagaaacctggtctccctagctatgtgttctcatttcacccaagactttttgccagtgcaggggatagaagattcattccacaaacttatactgagaagatatgagaaatgtgggcatgataatttacaattaaggaaaggctgtaaaagtatgaacgtgtgtaaagtgcagaagggagtttataatggaattaataaatgcttgtcaaatactcagagcaaaatatttcaatgtaatgcacgtgtcaaagtttttagtaaatttgcaaattcaaacaaagataagacaagacatactggagagaaacactttaaatgtaacgaatgtggcaagtcatttcagaagttctcagacctaactcaacataaa

SEQ ID NO: 8859 - DNA, 77 bp, synthetic construct
  misc_feature 1..77: note = Synthetic polypeptide
  source 1..77: mol_type = other DNA
ggctgagcacggtggctgatgcctgtaatcccagcattttgggaggccgaggttcactctttgaatttcctggataa

SEQ ID NO: 8860 - DNA, 3046 bp, synthetic construct; identical to SEQ ID NO: 7871
  misc_feature 1..3046: note = Synthetic polypeptide
  source 1..3046: mol_type = other DNA

SEQ ID NO: 8861 - DNA, 741 bp, synthetic construct; identical to SEQ ID NO: 7872
  misc_feature 1..741: note = Synthetic polypeptide
  source 1..741: mol_type = other DNA

SEQ ID NO: 8862 - DNA, 1463 bp, synthetic construct
  misc_feature 1..1463: note = Synthetic polypeptide
  source 1..1463: mol_type = other DNA
aatccggatctgatgaaggcttcgagctaccttcttacaggactcttcagctccctgcgccttttaacacatgcacatccagcaaaagcagaggagaacctggctgtgattcaaagcgtgagtgcatctccatccacgttggccaggctggtgtccagattggcaatgcctgctgggagctctactgcctggaacacggcatccagcccgatggccagatgccaagtgacaagaccattgggggaggagatgattccttcaacaccttcttcagtgaaacgggtgctggcaagcatgtgccccgggcagtgtttgtagacttggaacccacagtcattgatgaagttcgcactggcacttaccgccagctcttccaccctgagcaactcatcacaggcaaggaagatgctgccaataactatgcccgagggcactacaccattggcaaggagatcattgacctcgtgttggaccgaattcgcaagctggctgaccagtgcaccggtcttcagggcttcttggttttccacagctttggtgggggaactggttctgggttcacctcgctgctcatggaacgtctctcagttgattatggcaagaagtccaagctggagttctccatttacccggcgccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctacccccgcatccacttccctctggccacatatgcccctgtcatctctgctgagaaagcctaccacgaacagcttactgtagcagagatcaccaatgcttgctttgagccagccaaccagatggtgaaatgtgaccctcgccatggtaaatacatggcttgctgcctgttataccgtggtgacgtggttcccaaagatgtcaatgctgccattgccaccatcaaaaccaagcgtaccatccagtttgtggattggtgccccactggcttcaaggttggcattaattaccagcctcccactgtggtgcctggcggagacctggccaaggtacagagagctgtgtgcatgctgagcaataccacagctgttgccgaggcctgggctcgcctggaccacaagtttgacctgatgtatgccaagcgtgcctttgttcactggtacgtgggtgaggggatggaggaaggcgagttttcagaggcccgtgaggacatggctgcccttgagaaggattatgaggaggttggagcagatagtgctgacggagaggatgagggtgaagagtattaa

SEQ ID NO: 8863 - DNA, 170 bp, synthetic construct
  misc_feature 1..170: note = Synthetic polypeptide
  source 1..170: mol_type = other DNA
aatccggatctgatgaaggcttcgagctaccttcttacaggactcttcagctccctgcgccttttaacacatgcacatccagcaaaagcagaggagaacctggctgtgattcaaagtgtgtgaacccagctctgtcccttgggttccgtacatataaatggagcagctga

SEQ ID NO: 8864 - DNA, 239 bp, synthetic construct
  misc_feature 1..239: note = Synthetic polypeptide
  source 1..239: mol_type = other DNA
aatccggatctgatgaaggcttcgagctaccttcttacaggactcttcagctccctgcgccttttaacacatgcacatccagcaaaagcagaggagaacctggctgtgattcaaagagtctcactctactgcccaggctggagtgcagtggtacaatcttggctcactgcagcctccgccttccgggttccagtgatcctcctgcctcagcctcccaagtagctgagattacagcgtga

SEQ ID NO: 8865 - DNA, 1219 bp, synthetic construct
  misc_feature 1..1219: note = Synthetic polypeptide
  source 1..1219: mol_type = other DNA
ggggcggttccaagatggccgaataagaacagctccagtccacagctcccagcatgagcgacgcagaagacggatgatttctgcatttccaactgagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagcaaccttgggaggcaattctgcatcctacacctttgtctcattgcttttctctgcagtgactcttcttttgctctgttag

SEQ ID NO: 8866 - DNA, 1585 bp, synthetic construct
  misc_feature 1..1585: note = Synthetic polypeptide
  source 1..1585: mol_type = other DNA
ggggcggttccaagatggccgaataagaacagctccagtccacagctcccagcatgagcgacgcagaagacggatgatttctgcatttccaactgagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagaagggccccgtagaagcaaagccagagtgccaggagacagaaacgaagccagcgccagccgaagtcaagacggtccccaatgacgccacacagacaaaggagaacgagagcaaagcatga

SEQ ID NO: 8867 - DNA, 1324 bp, synthetic construct
  misc_feature 1..1324: note = Synthetic polypeptide
  source 1..1324: mol_type = other DNA
ggggcggttccaagatggccgaataagaacagctccagtccacagctcccagcatgagcgacgcagaagacggatgatttctgcatttccaactgagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccatagccctcctccaccggcatctgctagctcgtctacccctgttccattgtctccaccagatacaacttggcctcttcctgcccttgcaaccacagaaccagctaaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagcaaccttgggaggcaattctgcatcctacacctttgtctcattgcttttctctgcagtgactcttcttttgctctgttag

SEQ ID NO: 8868 - DNA, 1006 bp, synthetic construct
  misc_feature 1..1006: note = Synthetic polypeptide
  source 1..1006: mol_type = other DNA
ggggcggttccaagatggccgaataagaacagctccagtccacagctcccagcatgagcgacgcagaagacggatgatttctgcatttccaactgagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccaggccccacctcctacggcatctgctagctcgtctacccctgttccattgtctccaccagatacaacttggcctcttcctgcccttgcaaccacagaaccagctaaaaacattgcacagaatcactgctgtaacatgttccaagctggtcttcataatgctctaatgaagtaa

SEQ ID NO: 8869 - DNA, 1585 bp, synthetic construct
  misc_feature 1..1585: note = Synthetic polypeptide
  source 1..1585: mol_type = other DNA
ggggcggttccaagatggccgaataagaacagctccagtccacagctcccagcatgagcgacgcagaagacggatgatttctgcatttccaactgagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtcccaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagaagggccccgtagaagcaaagccagagtgccaggagacagaaacgaagccagcgccagccgaagtcaagacggtccccaatgacgccacacagacaaaggagaacgagagcaaagcatga

SEQ ID NO: 8870 - DNA, 414 bp, synthetic construct; identical to SEQ ID NO: 6481
  misc_feature 1..414: note = Synthetic polypeptide
  source 1..414: mol_type = other DNA

SEQ ID NO: 8871 - DNA, 375 bp, synthetic construct
  misc_feature 1..375: note = Synthetic polypeptide
  source 1..375: mol_type = other DNA
agcctggactctgcagtcgctgacaggattcaagtcctgactgccacaagattctcccagatgcttcaggacaagcccctgcgcacatcgtggcagcggaagatgaaggaacgacaggagaggaagctggccaaggactttgcccgtcacctggaggaggagaaggagaggcgccgccaggagaagaaacagcgccgggctgagaacctgaaacgccgcctggagaatgagcggaaggcagaggtcgtccaagtgatccgaaaccccgccaagctcaagcgggcaaagaagaagcagctgcgctccattgagaagcgggacaccctggccctgctgcagaagcagccgccccagcagccggcagccaagatctga

SEQ ID NO: 8872 - DNA, 603 bp, synthetic construct
  misc_feature 1..603: note = Synthetic polypeptide
  source 1..603: mol_type = other DNA
tgtgatggttaataatgtgtcaacttgattggattgaaggatacagagtattgttcctgggtgtgtctgtgagggtgttgccaaaggagattaacatttcagtcagtggactgggagacgcagactcatcctcaatgtgggtgggcaccatccaatcacctgccagcgtgggcagaataaagcaggcagaagaaggtggaatgagcagacctgctgagttttctggccttcatctttctcccatgctggatgcttcctgccctcaaacatcaggccccaaattcttcagcttttggactcttggacatacatcagtggatcgccagggattctccggccttcggccacaggctgaaggctgcgctgtcggcttccctacttttgaggttttgggactcagactggcttccttgctcttcagcttgcagatggcctgctgtgggacttcacctggtgaccgtatatgaagcatcaacaaacgaattgattaatgaagagttgggaatagcttatccaatcattgatgggatccctaatatgataccacaggcagctaggatgacacgtcaaagtaagaagcaagaagaagtggagcagcgctag

SEQ ID NO: 8873 - DNA, 932 bp, synthetic construct
  misc_feature 1..932: note = Synthetic polypeptide
  source 1..932: mol_type = other DNA
ccctgctccatgttcttagcatcctaggttcgtttccttcttggcactcaccgtggcttgaaatcacatggatttatgtgattatttgagtatgcctttccccactaaactgtcagcttcatgaaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgatccacttcctcatgatactgtcttctaactgggcttacttaaaggatgcgagcaaaatgcaggcttaccaggatatcaaagcaaaggaagaacaggaactgcaagatatccagtctcggtcaaaagaacaactcaattcttacacataa

SEQ ID NO: 8874 - DNA, 863 bp, synthetic construct
  misc_feature 1..863: note = Synthetic polypeptide
  source 1..863: mol_type = other DNA
ccctgctccatgttcttagcatcctaggttcgtttccttcttggcactcaccgtggcttgaaatcacatggatttatgtgattatttgagtatgcctttccccactaaactgtcagcttcatgaaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgctgatctacatgatggctactacatataactatgcggttttgaagtttaagagtcgggaagattgctgcactaaattctaa

SEQ ID NO: 8875 - DNA, 386 bp, synthetic construct
  misc_feature 1..386: note = Synthetic polypeptide
  source 1..386: mol_type = other DNA
ccctgctccatgttcttagcatcctaggttcgtttccttcttggcactcaccgtggcttgaaatcacatggatttatgtgattatttgagtatgcctttccccactaaactgtcagcttcatgaaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggca

SEQ ID NO: 8876 - DNA, 2075 bp, synthetic construct
  misc_feature 1..2075: note = Synthetic polypeptide
  source 1..2075: mol_type = other DNA
cagtgttgcctatattggcatcatcggtggttagcctctatttcctcgaactcacagatgtcttcaaacctgtgcactctggatttagctgctatgaccggagtcttagcatgccgtacattgaaccaacccaggaggcaattccattcctcatgttgcttagcttggcttttgctggacctgcaattacgattatggtaggagaaggaattctctactgttgcctctccaaaagaagaaatggggtcggactagagcccaacattaatgctggaggctgcaacttcaattccttcctcagacgagctgtcagattcgttggtgttcatgtatttggattatgctctacagctctcattacagatatcatacagctgtccacaggatatcaagcaccttactttctgactgtgtgcaaaccaaactatacctctctgaatgtatcttgcaaagaaaattcctacattgtggaagatatttgctcaggatctgacctcacagttatcaacagtggcagaaagtccttcccttctcaacatgcaacccttgctgcctttgcagctgtgtatgtttcgatgtacttcaattccacattaacggattcctctaagcttctgaaacctctcttggtcttcacatttatcatctgtggaataatctgcgggctaacacggataactcagtataagaaccacccagttgatgtctattgtggctttttaataggaggaggaattgcactgtacttgggcttgtatgctgtggggaatttcctgcccagtgatgagagtatgtttcagcacagagacgccctcaggtctctgacagacctcaatcaagatcccaaccgacttttatctgctaaaaatggtagcagcagtgatggaattgctcatacagaaggcatcctcaaccgaaaccacagagatgctagctctctgacaaatctcaaaagagcaaatgctgatgtggaaatcattactccacggagccccatggggaaggagaacatggttaccttcagcaataccttgccgcgagccaataccccatctgtagaagaccctgtcagaagaaatgcgagcattcatgcctctatggattccgctcgatcaaagcagctcctcacccagtggaagaataagaatgaaagtcgaaagttgtccttgcaagttatagagcctgagcctgggcagtcaccacccagatccatagaaatgaggtcaagctcagagccatcgagggtaggggtgaatggagaccaccatggtcctggcaatcagtacctcaaaatccagcctggcgctgtccccggatgtaacaacagcatgcctggagggccaagagtgtccattcagtcccgtcctgggtcctcacagttggtgcacatccctgaggagactcaggaaaacataagcacctcccccaaaagcagctctgctcgggccaagtggttaaaagctgctgaaaagactgtggcctgtaacagaagcaacagccagccccgaatcatgcaagtcatagccatgtccaagcagcagggtgtcctccaaagcagccccaagaacactgaaggcagcacggtctcctgcactggctccatccgctataaaaccttgacagaccatgagcccagtgggatagtgagggttgaggctcacccagagaacaacaggcccatcatacagatcccgtccactgaaggtgaaggcagtggctcctggaagtggaaagcccctgaaaagggcagccttcgccaaacttacgagctcaacgatctcaacagggactcagaaagctgtgagtctctgaaagacagctttggttctggagatcgcaagagaagcaacattgatagcaatgagcatcaccaccacggaattaccaccatccgcgtcaccccagtagagggcagcgaaattggctcagagacgctgtccatttcttcttcccgcgactccaccctgcggagaaagggcaatatcattctaatccctgaaagaagcaacagccccgaaaacactagaaatatcttctacaaaggaacctcccccacacgggcttataaggattga

SEQ ID NO: 8877 - DNA, 1901 bp, synthetic construct
  misc_feature 1..1901: note = Synthetic polypeptide
  source 1..1901: mol_type = other DNA
cagtgttgcctatattggcatcatcggtggttagcctctatttcctcgaactcacagatgtcttcaaacctgtgcactctggatttagctgctatgaccggagtcttagcatgccgtacattgaaccaacccaggaggcaattccattcctcatgttgcttagcttggcttttgctggacctgcaattacgattatggtaggagaaggaattctctactgttgcctctccaaaagaagaaatggggtcggactagagcccaacattaatgctggaggctgcaacttcaattccttcctcagacgagctgtcagattcgttggtgttcatgtatttggattatgctctacagctctcattacagatatcatacagctgtccacaggatatcaagcaccttactttctgactgtgtgcaaaccaaactatacctctctgaatgtatcttgcaaagaaaattcctacattgtggaagatatttgctcaggatctgacctcacagttatcaacagtggcagaaagtccttcccttctcaacatgcaacccttgctgcctttgcagctgtgtatgtttcgggcttgtatgctgtggggaatttcctgcccagtgatgagagtatgtttcagcacagagacgccctcaggtctctgacagacctcaatcaagatcccaaccgacttttatctgctaaaaatggtagcagcagtgatggaattgctcatacagaaggcatcctcaaccgaaaccacagagatgctagctctctgacaaatctcaaaagagcaaatgctgatgtggaaatcattactccacggagccccatggggaaggagaacatggttaccttcagcaataccttgccgcgagccaataccccatctgtagaagaccctgtcagaagaaatgcgagcattcatgcctctatggattccgctcgatcaaagcagctcctcacccagtggaagaataagaatgaaagtcgaaagttgtccttgcaagttatagagcctgagcctgggcagtcaccacccagatccatagaaatgaggtcaagctcagagccatcgagggtaggggtgaatggagaccaccatggtcctggcaatcagtacctcaaaatccagcctggcgctgtccccggatgtaacaacagcatgcctggagggccaagagtgtccattcagtcccgtcctgggtcctcacagttggtgcacatccctgaggagactcaggaaaacataagcacctcccccaaaagcagctctgctcgggccaagtggttaaaagctgctgaaaagactgtggcctgtaacagaagcaacagccagccccgaatcatgcaagtcatagccatgtccaagcagcagggtgtcctccaaagcagccccaagaacactgaaggcagcacggtctcctgcactggctccatccgctataaaaccttgacagaccatgagcccagtgggatagtgagggttgaggctcacccagagaacaacaggcccatcatacagatcccgtccactgaaggtgaaggcagtggctcctggaagtggaaagcccctgaaaagggcagccttcgccaaacttacgagctcaacgatctcaacagggactcagaaagctgtgagtctctgaaagacagctttggttctggagatcgcaagagaagcaacattgatagcaatgagcatcaccaccacggaattaccaccatccgcgtcaccccagtagagggcagcgaaattggctcagagacgctgtccatttcttcttcccgcgactccaccctgcggagaaagggcaatatcattctaatccctgaaagaagcaacagccccgaaaacactagaaatatcttctacaaaggaacctcccccacacgggcttataaggattga

SEQ ID NO: 8878 - DNA, 977 bp, synthetic construct; identical to SEQ ID NO: 7082
  misc_feature 1..977: note = Synthetic polypeptide
  source 1..977: mol_type = other DNA

SEQ ID NO: 8879 - DNA, 1592 bp, synthetic construct; identical to SEQ ID NO: 7083
  misc_feature 1..1592: note = Synthetic polypeptide
  source 1..1592: mol_type = other DNA

SEQ ID NO: 8880 - DNA, 185 bp, synthetic construct
  misc_feature 1..185: note = Synthetic polypeptide
  source 1..185: mol_type = other DNA
cagtggttcttagcccttgctgcacaacagatttacttggggagtaaataccaatatggaggcctccaaacagataattcaatgtaaatctcttgggggaggaggaaccatcactatatttaaatattccccaggaatgtaaaatgaagggcgtggtgtgcaccagaatctatgagaaggtctga

SEQ ID NO: 8881 - DNA, 142 bp, synthetic construct
  misc_feature 1..142: note = Synthetic polypeptide
  source 1..142: mol_type = other DNA
cagtggttcttagcccttgctgcacaacagatttacttggggagtaaataccaatatggaggcctccaaacagataattcaatgtaaatctcttgggggaggaggaaccatcactatatttaaatattccccaggaatgtaa

SEQ ID NO: 8882 - DNA, 373 bp, synthetic construct
  misc_feature 1..373: note = Synthetic polypeptide
  source 1..373: mol_type = other DNA
ccagctgctctgctgtaccctctgtccccagccacaccagaccttttccctctgccagccttcgcacatgctgttccctctgctgacaagacctcagtttcctcattcacctgacaaactgatgctcatcctgtaaggcccacctcaaaggctgcctgccacctactcagtggggacttcctagaccactaggcatcgtcattccctccctcagcctagcggcaccaaggcttagtgctttcttcattctgcctggtttcagagctggtttattcctgtctgtgtagtcttccatgaggcctagaacttcctccaaggcaagaatgaggcctgattgcgctgcctctatggaacttggcacaaggctaggtgc

SEQ ID NO: 8883 - DNA, 383 bp, synthetic construct
  misc_feature 1..383: note = Synthetic polypeptide
  source 1..383: mol_type = other DNA
ccagctgctctgctgtaccctctgtccccagccacaccagaccttttccctctgccagccttcgcacatgctgttccctctgctgacaagacctcagtttcctcattcacctgacaaactgatgctcatcctgtaaggcccacctcaaaggctgcctgccacctactcagtggggacttcctagaccactaggcatcgtcattccctccctcagcctagcggcaccaaggcttagtgctttcttcattctgcctggtttcagagctggtttattcctgtctgtgtagtcttccatgaggcctagaacttcctccaaggcaagaatgaggcctgattgcgctgcctctatggaacttggcacaaggctaggtgcgcgtctacag

SEQ ID NO: 8884 - DNA, 387 bp, synthetic construct
  misc_feature 1..387: note = Synthetic polypeptide
  source 1..387: mol_type = other DNA
ccagctgctctgctgtaccctctgtccccagccacaccagaccttttccctctgccagccttcgcacatgctgttccctctgctgacaagacctcagtttcctcattcacctgacaaactgatgctcatcctgtaaggcccacctcaaaggctgcctgccacctactcagtggggacttcctagaccactaggcatcgtcattccctccctcagcctagcggcaccaaggcttagtgctttcttcattctgcctggtttcagagctggtttattcctgtctgtgtagtcttccatgaggcctagaacttcctccaaggcaagaatgaggcctgattgcgctgcctctatggaacttggcacaaggctaggtgcgcgtctacagcccg

SEQ ID NO: 8885 - DNA, 412 bp, synthetic construct
  misc_feature 1..412: note = Synthetic polypeptide
  source 1..412: mol_type = other DNA
ccagctgctctgctgtaccctctgtccccagccacaccagaccttttccctctgccagccttcgcacatgctgttccctctgctgacaagacctcagtttcctcattcacctgacaaactgatgctcatcctgtaaggcccacctcaaaggctgcctgccacctactcagtggggacttcctagaccactaggcatcgtcattccctccctcagcctagcggcaccaaggcttagtgctttcttcattctgcctggtttcagagctggtttattcctgtctgtgtagtcttccatgaggcctagaacttcctccaaggcaagaatgaggcctgattgcgctgcctctatggaacttggcacaaggctaggtgcgcgtctacagcccgtaccaagactactacgaggtggtgc

SEQ ID NO: 8886 - DNA, 606 bp, synthetic construct
  misc_feature 1..606: note = Synthetic polypeptide
  source 1..606: mol_type = other DNA
ccagctgctctgctgtaccctctgtccccagccacaccagaccttttccctctgccagccttcgcacatgctgttccctctgctgacaagacctcagtttcctcattcacctgacaaactgatgctcatcctgtaaggcccacctcaaaggctgcctgccacctactcagtggggacttcctagaccactaggcatcgtcattccctccctcagcctagcggcaccaaggcttagtgctttcttcattctgcctggtttcagagctggtttattcctgtctgtgtagtcttccatgaggcctagaacttcctccaaggcaagaatgaggcctgattgcgctgcctctatggaacttggcacaaggctaggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctga

SEQ ID NO: 8887 - DNA, 500 bp, synthetic construct
  misc_feature 1..500: note = Synthetic polypeptide
  source 1..500: mol_type = other DNA
ccagctgctctgctgtaccctctgtccccagccacaccagaccttttccctctgccagccttcgcacatgctgttccctctgctgacaagacctcagtttcctcattcacctgacaaactgatgctcatcctgtaaggcccacctcaaaggctgcctgccacctactcagtggggacttcctagaccactaggcatcgtcattccctccctcagcctagcggcaccaaggcttagtgctttcttcattctgcctggtttcagagctggtttattcctgtctgtgtagtcttccatgaggcctagaacttcctccaaggcaagaatgaggcctgattgcgctgcctctatggaacttggcacaaggctaggtgcgcgtctacagcccgtaccaagactactacgaggtggtgccccccaatgcacacgaggccacgtatgtccgcagctactacggaccgccctacgcaggccctggcgtgacgcacgtgatagtgcggga

SEQ ID NO: 8888 - DNA, 526 bp, synthetic construct
  misc_feature 1..526: note = Synthetic polypeptide
  source 1..526: mol_type = other DNA
ccagctgctctgctgtaccctctgtccccagccacaccagaccttttccctctgccagccttcgcacatgctgttccctctgctgacaagacctcagtttcctcattcacctgacaaactgatgctcatcctgtaaggcccacctcaaaggctgcctgccacctactcagtggggacttcctagaccactaggcatcgtcattccctccctcagcctagcggcaccaaggcttagtgctttcttcattctgcctggtttcagagctggtttattcctgtctgtgtagtcttccatgaggcctagaacttcctccaaggcaagaatgaggcctgattgcgctgcctctatggaacttggcacaaggctaggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgccc

SEQ ID NO: 8889 - DNA, 555 bp, synthetic construct
  misc_feature 1..555: note = Synthetic polypeptide
  source 1..555: mol_type = other DNA
ccagctgctctgctgtaccctctgtccccagccacaccagaccttttccctctgccagccttcgcacatgctgttccctctgctgacaagacctcagtttcctcattcacctgacaaactgatgctcatcctgtaaggcccacctcaaaggctgcctgccacctactcagtggggacttcctagaccactaggcatcgtcattccctccctcagcctagcggcaccaaggcttagtgctttcttcattctgcctggtttcagagctggtttattcctgtctgtgtagtcttccatgaggcctagaacttcctccaaggcaagaatgaggcctgattgcgctgcctctatggaacttggcacaaggctaggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagcc

SEQ ID NO: 8890 - DNA, 490 bp, synthetic construct
  misc_feature 1..490: note = Synthetic polypeptide
  source 1..490: mol_type = other DNA
ccagctgctctgctgtaccctctgtccccagccacaccagaccttttccctctgccagccttcgcacatgctgttccctctgctgacaagacctcagtttcctcattcacctgacaaactgatgctcatcctgtaaggcccacctcaaaggctgcctgccacctactcagtggggacttcctagaccactaggcatcgtcattccctccctcagcctagcggcaccaaggcttagtgctttcttcattctgcctggtttcagagctggtttattcctgtctgtgtagtcttccatgaggcctagaacttcctccaaggcaagaatgaggcctgattgcgctgcctctatggaacttggcacaaggctaggtgcgcgtctacagcccgtaccaagactactacgaggtggtgccccccaatgcacacgaggccacgtatgtccgcagctactacggaccgccctacgcaggtaagtctccagcgtgccccg

SEQ ID NO: 8891 - DNA, 3034 bp, synthetic construct
  misc_feature 1..3034: note = Synthetic polypeptide
  source 1..3034: mol_type = other DNA
cccaccattctttaattttgttcataattctatggttggggaatctggatattaaattttctaggctctgtttccagctggtttcttaagttatatccataggagacactgggagaagacaggaaggcaggaagagaggagatgctattgtagtgtgacatctttctttctctttctggtagcacctctggatttagatgcactccttcaaggaccatgggttctgcaacagtaccccctctccattgttccagctctgactcagatgggccctccttgatggcactcccagcagcacagccttagcactgggagcatgacttcggcaacttcacctatcattctgaaatgggaccccaaaagtttggaaatccggacgctaacagtggaaaggctgttggagccacttgttacacaggtgactacacttgtcaacacaagcaacaaaggcccatctggtaaaaagaaagggaggtcaaagaaagcccatgtactagctgcctctgtagagcaagccactcagaatttcctggaaaagggtgaacagatcgctaaggagagtcaagatctcaaagaagagttggtggctgctgtagaggatgtgcgcaaacaaggtgagacgatgcggatcgcctcctccgagtttgcagatgacccttgctcgtcggtaaagcgcggcaccatggtacgggcggcaagggctttgctctccgcggtgacacgcttactcatcctggcggacatggcagatgtcatgagacttttatcccatctgaaaattgtggaagaggccctggaagctgtcaaaaatgctacaaatgagcaagaccttgcaaaccgttttaaagagtttgggaaagagatggtgaaacttaactatgtagcagcaagaagacaacaggagctgaaggatcctcactgtcgggatgagatggcagccgcccgaggggctctgaagaagaatgccacaatgctgtacacggcctctcaagcatttctccgccacccagatgtcgccgctacgagagccaaccgagattatgtgttcaaacaagtccaggaggccatcgccggcatctccaatgctgctcaagctacctcgcccactgacgaagccaagggccacacgggcatcggcgagctggctgcggctcttaatgagtttgacaataagattatcctggaccccatgacgttcagcgaggccaggttccggccgtccctggaggagaggctggagagcatcatcagcggcgcagcgctgatggccgactcctcctgcacgcgagacgaccggcgcgagaggatcgtggcggagtgcaacgccgtgcggcaggcgctccaggacctgctcagcgagtacatgaataatactggaaggaaagaaaaaggagatcctctcaacattgcgattgataagatgactaagaaaacaagagatctaaggagacagcttcggaaagcagtgatggatcacatatctgactctttcctggaaaccaatgttcctttgctagttctcattgaggctgcaaagagcggaaatgaaaaggaagtgaaagaatatgcccaagttttccgtgagcatgccaacaaactggtagaggttgccaatttggcctgttccatctccaacaatgaagaaggggtgaaattagttcggatggcagccacccagattgacagcctgtgtccccaggtcatcaatgccgctctgacactggctgcccggccacagagcaaagttgctcaggataacatggacgtcttcaaagaccagtgggagaagcaggtccgagtgttgacagaggccgtggatgacatcacctcagtggatgacttcctctctgtctcagaaaatcacatcttggaggatgtgaacaagtgtgtgatagccctccaagagggcgatgtggacactctggaccggactgcaggggccatcaggggccgggcagctcgagtcatacacatcatcaatgctgagatggagaactatgaagctggggtttatactgagaaggtgttggaagctacaaaattgctttctgaaacagtgatgccacgcttcgctgaacaagtagaggttgccattgaagccctgagtgccaacgttcctcaaccgtttgaggagaatgagttcatcgatgcctctcgcctggtgtatgatggcgttcgggacatcagaaaggctgtgctgatgatcaggaccccagaagaactagaggatgattctgactttgagcaggaagattatgatgtgcgtagcaggacaagtgttcagactgaggatgaccagctcattgcagggcagagcgcacgggccatcatggcgcaactaccgcaggaggagaaggcaaaaatagctgagcaggtggagatattccatcaagagaaaagcaagctggatgcagaagtggccaaatgggacgacagcggcaatgatatcattgtactggccaagcagatgtgtatgatcatgatggaaatgacagacttcacaagaggcaaaggcccattgaaaaatacatctgatgtcattaatgctgccaagaaaattgccgaagcaggttctcgaatggacaaattagctcgtgctgtggctgatcagtgtcctgattcagcatgtaagcaggatttattagcctaccttcaacgaattgccttgtattgccatcagcttaatatctgcagcaaggtgaaggcagaagtgcagaatctgggaggagagctcattgtgtcagggctggacagtgccacatcgcttatccaggcagctaaaaacctgatgaatgctgttgtcctcacggtgaaagcatcctatgtggcctcaaccaaataccagaaggtctatgggacagcagctgtcaactcacctgttgtgtcttggaagatgaaggctccagagaagaagccccttgtgaagagagaaaagcctgaagaattccagacacgagttcgacgaggttctcagaagaaacacatttcgcctgtacaggctttaagtgaattcaaagcaatggattccttctag

SEQ ID NO: 8892 - DNA, 1314 bp, synthetic construct
  misc_feature 1..1314: note = Synthetic polypeptide
  source 1..1314: mol_type = other DNA
agagggggagagagggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcattcgcaacgacaggcgcctcctctgccaaccggtttgtcagcatcggaccccgggacggcaactttctga

SEQ ID NO: 8893 - DNA, 1374 bp, synthetic construct
  misc_feature 1..1374: note = Synthetic polypeptide
  source 1..1374: mol_type = other DNA
agagggggagagagggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcccaacggtagcggccagggcaaagtcccggggtcatttttgctaccgccgccgcctccagtggccagacctgtgccccttcctatgcctgattccaaatccaccagcactgccccagacggcgccgccttgactcctccatcaccttcattcgcaacgacaggcgcctcctctgccaaccggtttgtcagcatcggaccccgggacggcaactttctgaacatcccacagcagtctcagtcctggttcctctga

SEQ ID NO: 8894 - DNA, 157 bp, synthetic construct
  misc_feature 1..157: note = Synthetic polypeptide
  source 1..157: mol_type = other DNA
agagggggagagagggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtga

SEQ ID NO: 8895 - DNA, 490 bp, synthetic construct
  misc_feature 1..490: note = Synthetic polypeptide
  source 1..490: mol_type = other DNA
agagggggagagagggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcaca

SEQ ID NO: 8896 - DNA, 1497 bp, synthetic construct
  misc_feature 1..1497: note = Synthetic polypeptide
  source 1..1497: mol_type = other DNA
agagggggagagagggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcccaacggtagcggccagggcaaagtcccggggtcatttttgctaccgccgccgcctccagtggccagacctgtgccccttcctatgcctgattccaaatccaccagcactgccccagacggcgccgccttgactcctccatcaccttcattcgcaacgacaggcgcctcctctgccaaccggtttgtcagcatcggaccccgggacggcaactttctgaacatcccacagcagtctcagtcctggttcctctga

SEQ ID NO: 8897 - DNA, 1191 bp, synthetic construct
  misc_feature 1..1191: note = Synthetic polypeptide
  source 1..1191: mol_type = other DNA
agagggggagagagggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcattcgcaacgacaggcgcctcctctgccaaccggtttgtcagcatcggaccccgggacggcaactttctga

SEQ ID NO: 8898 - DNA, 1045 bp, synthetic construct
  misc_feature 1..1045: note = Synthetic polypeptide
  source 1..1045: mol_type = other DNA
ggcctccacatacagttgctcagggacagtgatccccccacaggcctcgctggtctttcacgtcctcctgattgacgtgcacaacccgaaggacgctgtccagctagagacgctggagctcccccccggctgtgtccgcagagccggggccggggacttcatgcgctaccactacaatggctccttgatggacggcaccctcttcgattccagctactcccgcaaccacacctacaatacctatatcgggcagggttacatcatccccgggatggaccaggggctgcagggtgcctgcatgggggaacgccggagaattaccatccccccgcacctcgcctatggggagaatggaactggagacaagatccctggctctgccgtgctaatcttcaacgtccatgtcattgacttccacaaccctgcggatgtggtggaaatcaggacactgtcccggccatctgagacctgcaatgagaccaccaagcttggggactttgttcgataccattacaactgttctttgctggacggcacccagctgttcacctcgcatgactacggggccccccaggaggcgactctcggggccaacaaggtgatcgaaggcctggacacgggcctgcagggcatgtgtgtgggagagaggcggcagctcatcgtgcccccgcacctggcccacggggagagtggagcccggggagtcccaggcagtgctgtgctgctgtttgaggtggagctggtgtcccgggaggatgggctgcccacaggctacctgtttgtgtggcacaaggaccctcctgccaacctgtttgaagacatggacctcaacaaggatggcgaggtccctccggaggagttctccaccttcatcaaggctcaagtgagtgagggcaaaggacgcctcatgcctgggcaggaccctgagaaaaccataggagacatgttccagaaccaggaccgcaaccaggacggcaagatcacagtcgacgagctcaagctgaagtcagatgaggacgaggagcgggtccacgaggagctctga

SEQ ID NO: 8899 - DNA, 962 bp, synthetic construct
  misc_feature 1..962: note = Synthetic polypeptide
  source 1..962: mol_type = other DNA
tagtatagtgctgaaaagtgtgggccctggagaatgtgtgttctgatcctgtctgttagttcttaccagctgggtgactttcagttttaaactcccttaaaccacagctctttatctgtaaatagggatggtaactgtacttagcctcttaggagtttcaaggattcagtggaacaatccaggcaaagtgcttggccaggacctggcacaagcccatcctgagcccttctatcctagaccatctcatcaataatgaccgcaaactgcctccagagtacaaccttccccacacttacgttgaaatgcagtcactccagattgctgccttccttttcacggtctgccatgtggtgattgttgtccaggactggttcacagacctcagtctctacaggttcctgcagacagcagagatggtgaagccctccaccccatcccccagccacgagtccagcagctcatcgggctccgatgaaggcaccgagtactacccccacctagtcttcttgcagaacaaagctcgccgagaggacttctgtcctcggaagctgcggcagatgcacctgatgattgaccagctcatggcccactcccacctgcgttacaagggaactctgtccatgttacaatgcaatgtcttcccggggcttccacctgacttcctggactctgaggtcaacttattcctggtacccttcatggacagtgaagcagagagtgaaaacccaccaagagcaggacctggttccagcccactcttctccctgctgcctgggtatcgtggccaccccagtttccagtccttggtgagcaagctccggagccaagtgatgtccatggcccggccacagctgtcacacacgatcctcaccgagaagaactggttccactacgctgcccggatctgggatggggtgagaaagtcctctgctctggcagagtacagccgcctgctggcctga

SEQ ID NO: 8900 - DNA, 887 bp, synthetic construct
  misc_feature 1..887: note = Synthetic polypeptide
  source 1..887: mol_type = other DNA
tagtatagtgctgaaaagtgtgggccctggagaatgtgtgttctgatcctgtctgttagttcttaccagctgggtgactttcagttttaaactcccttaaaccacagctctttatctgtaaatagggatggtaactgtacttagcctcttaggagtttcaaggattcagtggaacaatccaggcaaagtgcttggccaggacctggcacaagcccatcctgagcccttctatcctagaccatctcatcaataatgaccgcaaactgcctccagagtacaaccttccccacacttacgttgaaatgcagtcactccagattgctgccttccttttcacggtctgccatgtggtgattgttgtccaggactggttcacagacctcagtctctacaggttcctgcagacagcagagatggtgaagccctccaccccatcccccagccacgagtccagcagctcatcgggctccgatgaaggcaccgagtactacccccacctagtcttcttgcagaacaaagctcgccgagaggacttctgtcctcggaagctgcggcagatgcacctgatgattgaccagctcatggcccactcccacctgcgttacaagggaactctgtccatgttacaatgcaatgtcttcccggggcttccacctgacttcctggactctgaggtcaacttattcctggtacccttcatggacagtgaagcagagagtgaaaacccaccaagagcaggacctggttccagcccactcttctccctgctgcctgggtatcgtggccaccccagtttccagtccttggtgagcaagctccggagccaagtgatgtccatggcccggccacagctgtcacacacgatcctcaccgagaagaactggtaa

SEQ ID NO: 8901 - DNA, 559 bp, synthetic construct
  misc_feature 1..559: note = Synthetic polypeptide
  source 1..559: mol_type = other DNA
tgtggtaggctgaataaggcccccaccaaagatgtccttttcctaatccccagaacctgtgaatagcttacattacacggcaacagggactttgcagatgtggttaaggtaacagatttttagatgaggggattatcctggattatcgggtaggctcaaaataattacatgatcctttaaaagcagagaacatttcccgacgaaagtcagagagatgaggcctcgtgagaaggattccacacactcacactctcgctggctctgagatgtaggtgcccttgtgcaagaatcagagagaggctgcaaggagccagtggcagttcccgccgacagcccgcagggaagcagggacctcagtccatcaggcaaattgaactgaattccgccaacaaggcgcagaggcctggaaacagatgcttcattagagcctctaggagggagtacagcctggccaacaccttgatttcagccctgtgaggcttgaagcccacacaccagccgcgcccactggacttctaacctacagaactgtgagcttcaactcctggctaatgagtga

SEQ ID NO: 8902 - DNA, 949 bp, synthetic construct
  misc_feature 1..949: note = Synthetic polypeptide
  source 1..949: mol_type = other DNA
gtctgggcgcaaagcacaggtgactgcctgccaccagcttgtgacccccatcaagttactttgacttgcacagctgtgaagcggtggtcataataaaattcatttcaaaaggctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgagaaaccagcctggacaccaagtctgtgtcagaaggccacctcaagaggaacatcgtggtgaagaccgtggagatgcgggatggagaggtcattaaggagtccaagcaggagcacaaggatgtgatgtga

SEQ ID NO: 8903 - DNA, 946 bp, synthetic construct
  misc_feature 1..946: note = Synthetic polypeptide
  source 1..946: mol_type = other DNA
gtctgggcgcaaagcacaggtgactgcctgccaccagcttgtgacccccatcaagttactttgacttgcacagctgtgaagcggtggtcataataaaattcatttcaaaaggctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgagggggcaaaagcaccaaagacggggaaaatcacaaggtcacaagatatctcaaaagcctcacaatacgagttataccaatacaggctcaccagattgtaaatggaacgccgccggctcgcggttag

SEQ ID NO: 8904 - DNA, 967 bp, synthetic construct
  misc_feature 1..967: note = Synthetic polypeptide
  source 1..967: mol_type = other DNA
gtctgggcgcaaagcacaggtgactgcctgccaccagcttgtgacccccatcaagttactttgacttgcacagctgtgaagcggtggtcataataaaattcatttcaaaaggctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgaggtcagtacagcagggcctcgtgggaagggcactggagtcctgccccctcctccagggcctgtaggttgctccagactgggactgaggatcagggcaaagggatccagctctccctgggggccttcgtgacactgcagcgctcctag

SEQ ID NO: 8905 - DNA, 394 bp, synthetic construct
  misc_feature 1..394: note = Synthetic polypeptide
  source 1..394: mol_type = other DNA
gtctgggcgcaaagcacaggtgactgcctgccaccagcttgtgacccccatcaagttactttgacttgcacagctgtgaagcggtggtcataataaaattcatttcaaaaggctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggagtaccaggacctgctcaatgtcaagctggccctggacatcgagatcgccacctacaggaagctgctagagggcgaggagaaccggatcaccattcccgtgcagaccttctccaacctgcagatt

SEQ ID NO: 8906 - DNA, 435 bp, synthetic construct
  misc_feature 1..435: note = Synthetic polypeptide
  source 1..435: mol_type = other DNA
gtctgggcgcaaagcacaggtgactgcctgccaccagcttgtgacccccatcaagttactttgacttgcacagctgtgaagcggtggtcataataaaattcatttcaaaaggctccaggatgaaaccaacctgaggctggaagccgagaacaacctggctgcctatagacaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctg

SEQ ID NO: 8907 - DNA, 197 bp, synthetic construct
  misc_feature 1..197: note = Synthetic polypeptide
  source 1..197: mol_type = other DNA
gtctgggcgcaaagcacaggtgactgcctgccaccagcttgtgacccccatcaagttactttgacttgcacagctgtgaagcggtggtcataataaaattcatttcaaaaggctccaggatgaaaccaacctgaggctggaagccgagaacaacctggctgcctatagacaggaagcagatgaagccaccctggccc

SEQ ID NO: 8908 - DNA, 1391 bp, synthetic construct
  misc_feature 1..1391: note = Synthetic polypeptide
  source 1..1391: mol_type = other DNA
caaaagacgagattccagtccgagccctgtcctcaacttgctgtatgaccttgggaattgctagccctcgacgtttcggcatctgcaggatctggattagaaactcggagttttgggaggtcatcagtgatgagcatgggattgaccccactggcagttaccatggagacagtgatttgcagctggagagaatcaatgtttactacaatgaagccactggtaacaaatatgttcctcgggccatcctcgtggatctggagccaggcacgatggattcggttaggtctggaccattcggccagatcttcagaccagacaatttcgtgtttggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccaccagctggtggaaaacacagatgaaacctactgcattgacaacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcgtag

SEQ ID NO: 8909 - DNA, 581 bp, synthetic construct
  misc_feature 1..581: note = Synthetic polypeptide
  source 1..581: mol_type = other DNA
ctgccttgaacgctgaagttgtatctggagttgtagccgccactttgaggccatgaggaggaatgggagagtgcaaagatacagagtctgggccttgatggcatcaagtggtcagaccaactccagtagctgtcttcctcagatttctgttagtgagaaaagtgctactcgtgagcagtagtcgccatccagacagatggattgtccctggaggaggcatggagcccgaggaggagccaagtgtggcagcagttcgtgaagtctgtgaggaggctggagtaaaagggacattgggaagattagttggaatttttgagaaccaggagaggaagcacaggacgtatgtctatgtgctcattgtcactgaagtgctggaagactgggaagattcagttaacattggaaggaagagggaatggtttaaaatagaagacgccataaaagtgctgcagtatcacaaacccgtgcaggcatcatattttgaaacattgaggcaaggctactcagccaacaatggcaccccagtcgtggccaccacatactcggtttctgctcagagctcgatgtcaggcatcagatga

SEQ ID NO: 8910 - DNA, 564 bp, synthetic construct
  misc_feature 1..564: note = Synthetic polypeptide
  source 1..564: mol_type = other DNA
ctgccttgaacgctgaagttgtatctggagttgtagccgccactttgaggccatgaggaggaatgggagagtgcaaagatacagagtctgggccttgatggcatcaagtggtcagaccaactccagtagctgtcttcctcagatttctgttagtgagaaaagtgctactcgtgagcagtagtcgccatccagacagatggattgtccctggaggaggcatggagcccgaggaggagccaagtgtggcagcagttcgtgaagtctgtgaggaggctggagtaaaagggacattgggaagattagttggaatttttgagaaccaggagaggaagcacaggacgtatgtctatgtgctcattgtcactgaagtgctggaagactgggaagattcagttaacattggaaggaagagggaatggtttaaaatagaagacgccataaaagtgctgcagtatcacaaacccgtgcaggcatcatattttgaaacattgaggcaaggctactcagccaacaatggcaccccagtcgtggccaccacatactcggtttctgctcagagctcga

SEQ ID NO: 8911 - DNA, 1011 bp, synthetic construct
  misc_feature 1..1011: note = Synthetic polypeptide
  source 1..1011: mol_type = other DNA
tgcctagaatatcctgcagtggtagagtttgctccattccagaagatagccaaaaagaagctgagaaaaaaagatgccaagactggaagcatcgaagatgatccagaatataagaagtttttagaaacctactgtgtggaggaagagaagaccagtgccaaccctgagactctgctgggggagatggaggcgaagacaagagagctcattgctagaagaaccacacctcttttggaatatattaaaaatagaaaattagaaaagcagagaattcgagaagagaagcgagaagaacggaggaggagagagttagaaaagaaacgtttgcgggaagaggaaaaaagaagaagaagagaagaagaaagatgcaaaaaaaaagagacagataaacagaagaaaattgcagagaaagaagtaaggattaagcttcttaagaaaccagaaaagggagaggaaccaaccacagagaaaccaaaagaaagaggagaggagattgatactggaggtggcaagcaggaatcctgtgcccccggtgcagtcgtaaaagccaggcccatggaaggctcgctggaggagccccaggagacgtcacacagcggcagtgataaagagcacagggatgtggagagatctcaagaacaagaatctgaagcacaaagataccatgtggatgacggcaggaggcacagagctcaccacgagcctgaacggctttccagaaggagtgaggatgagcagagatgggggaaaggacctggccaagacagagggaagaaggggagccaggacagcggggctccgggggaggccatggagagactgggaagagcgcagaggtgtgacgacagtccagcacccagaaaagagcgactggcaaacaaggaccggccagccttgcagctgtatgatccaggagctcgcttccgagcgcgagagtgtggcggaaacaggaggatctgcaaggcagaaggttcggggactggtcctgagaagagggaagaggcagagtga

SEQ ID NO: 8912 - DNA, 173 bp, synthetic construct
  misc_feature 1..173: note = Synthetic polypeptide
  source 1..173: mol_type = other DNA
cttttctcttttcttctcctaccccaattcgtccctggacttggtgaagttccacctccttcctgaagtcctcaatgattctccaaaccatgcttgctcctgagaccaaggctgtcattcattggattatggatattccttttgtgctttctgccaatctccatggaggagac

SEQ ID NO: 8913 - DNA, 198 bp, synthetic construct
  misc_feature 1..198: note = Synthetic polypeptide
  source 1..198: mol_type = other DNA
cttttctcttttcttctcctaccccaattcgtccctggacttggtgaagttccacctccttcctgaagtcctcaatgattctccaaaccatgcttgctcctgagaccaaggctgtcattcattggattatggatattccttttgtgctttctgccaatctccatggaggagaccttgtggccaattatccatatgatg

SEQ ID NO: 8914 - DNA, 851 bp, synthetic construct
  misc_feature 1..851: note = Synthetic polypeptide
  source 1..851: mol_type = other DNA
cttttctcttttcttctcctaccccaattcgtccctggacttggtgaagttccacctccttcctgaagtcctcaatgattctccaaaccatgcttgctcctgagaccaaggctgtcattcattggattatggatattccttttgtgctttctgccaatctccatggaggagaccttgtggccaattatccatatgatgagacgcggagtggtagtgctcacgaatacagctcctccccagatgacgccattttccaaagcttggcccgggcatactcttctttcaacccggccatgtctgaccccaatcggccaccatgtcgcaagaatgatgatgacagcagctttgtagatggaaccaccaacggtggtgcttggtacagcgtacctggagggatgcaagacttcaattaccttagcagcaactgttttgagatcaccgtggagcttagctgtgagaagttcccacctgaagagactctgaagacctactgggaggataacaaaaactccctcattagctaccttgagcagatacaccgaggagttaaaggatttgtccgagaccttcaaggtaacccaattgcgaatgccaccatctccgtggaaggaatagaccacgatgttacatccgcaaaggatggtgattactggagattgcttatacctggaaactataaacttacagcctcagctccaggctatctggcaataacaaagaaagtggcagttccttacagccctgctgctggggttgattttgaactggagtcattttctgaaaggaaagaagaggagaaggaagaattgatggaatggtggaaaatgatgtcagaaactttaaatttttaa

SEQ ID NO: 8915 - DNA, 227 bp, synthetic construct
  misc_feature 1..227: note = Synthetic polypeptide
  source 1..227: mol_type = other DNA
cttttctcttttcttctcctaccccaattcgtccctggacttggtgaagttccacctccttcctgaagtcctcaatgattctccaaaccatgcttgctcctgagaccaaggctgtcattcattggattatggatattccttttgtgctttctgccaatctccatggaggagaccttgtggccaattatccatatgatgagacgcggagtggtagtgctcacgaatac

SEQ ID NO: 8916 - DNA, 345 bp, synthetic construct
  misc_feature 1..345: note = Synthetic polypeptide
  source 1..345: mol_type = other DNA
gttttctcttgtctccaggcctttgcacaggctttttcttcaacttggagtatttccctgcttctatccgtcccaactcccctgccaaactgttctctttcggttattgatttaaatgtcacttcttccgggaagccttcccacgcttcctctggctagattgtttgctttttcttaggttgttgggtttttcgtttatgtcactctctcattctgtgtttaaattgccagcttttttgttctgaactcccactgcgttgtggattcctgaggatgggatgactgtatcttgattacccggaggaaatgaaacacgatttccaaaatgaacttaatctttcatga

SEQ ID NO: 8917 - DNA, 330 bp, synthetic construct; identical to SEQ ID NO: 7604
  misc_feature 1..330: note = Synthetic polypeptide
  source 1..330: mol_type = other DNA

SEQ ID NO: 8918 - DNA, 678 bp, synthetic construct
  misc_feature 1..678: note = Synthetic polypeptide
  source 1..678: mol_type = other DNA
cacattgatctgttagcaaatcctctcagctctgccttcaattatgttaatagtctgtctagtttcttaccacctccactgctactatgcttaccacatccagcctgtattattgcaattgcctcctaattgctctccctgcttctaccttatcccctactcccacagcttattttctgtaacatagatgccaaagcaatcctgttaaaatgtgagtcagattatggcactgctcttaaaaccttccaatgtcttctcatttctctcagtaaaagccaaactccttacaatgcctgtaggccttacacgatctgtcctcccataacctctgacttactcacgtgcttttctcccaccaatccactccaaccacattgggtttttttctgttcctggaacacactgaacacacactaatagcactgttctttcctctgtctgaaacactttcctcagttatcccaagccttctttcacgtccttcaggaccgggcaggcagcattgtcttgaaggtgctcatctcttttaaagctaatgatatagaaaaggcagttcaatctctggacaagaatggtgtggatctcctaatgaagtatatttataaaggatttgagagcccgtctgacaatagcagtgctatgttactgcaatggcatgaaaaggtgcctcttgtatga

SEQ ID NO: 8919 - DNA, 726 bp, synthetic construct
  misc_feature 1..726: note = Synthetic polypeptide
  source 1..726: mol_type = other DNA
cacattgatctgttagcaaatcctctcagctctgccttcaattatgttaatagtctgtctagtttcttaccacctccactgctactatgcttaccacatccagcctgtattattgcaattgcctcctaattgctctccctgcttctaccttatcccctactcccacagcttattttctgtaacatagatgccaaagcaatcctgttaaaatgtgagtcagattatggcactgctcttaaaaccttccaatgtcttctcatttctctcagtaaaagccaaactccttacaatgcctgtaggccttacacgatctgtcctcccataacctctgacttactcacgtgcttttctcccaccaatccactccaaccacattgggtttttttctgttcctggaacacactgaacacacactaatagcactgttctttcctctgtctgaaacactttcctcagttatcccaagccttctttcacgtccttcaggaccgggcaggcagcattgtcttgaaggtgctcatctcttttaaagctaatgatatagaaaaggcagttcaatctctggacaagaatggtgtggatctcctaatgaagtatatttataaaggatttgagagcccgtctgacaatagcagtgctatgttactgcaatggcatgaaaaggcacttgctgctggaggagtagggtccattgttcgtgtcttgactgcaagaaaaactgtgtag

SEQ ID NO: 8920 - DNA, 1004 bp, synthetic construct
  misc_feature 1..1004: note = Synthetic polypeptide
  source 1..1004: mol_type = other DNA
ctgttttccttaggggactgtggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcaccccagtctttgggccgtatactcggccctctgagagtgagctgtgggacatgtgggcagggatccgcaacaatgacgggaacttagtcattgacagtctcttacagtacatcaatcagaggaagaagttcagaaggcgctgggtgggagctcttgcctctgtaactatccccattcattttatctatgggccattggatcctgtaaatccctatccagagtttttggagctgtacaggaaaacgctgccgcggtccacagtgtcgattctggatgaccacattagccactatccacagctagaggatcccatgggcttcttgaatgcatatatgggcttcatcaactccttctga

SEQ ID NO: 8921 - DNA, 887 bp, synthetic construct
  misc_feature 1..887: note = Synthetic polypeptide
  source 1..887: mol_type = other DNA
ctgttttccttaggggactgtggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcaccccagtctttgggccgtatactcggccctctgagagtgagctgtgggacatgtgggcagggatccgcaacaatgacgggaacttagtcattgacagtctcttacagtacatcaatcagaggaagaagttcagaaggcgctgggtgggagctcttgcctctgtaactatccccagaaaacgctgccgcggtccacagtgtcgattctggatgaccacattagccactatccacagctag

SEQ ID NO: 8922 - DNA, 355 bp, synthetic construct; identical to SEQ ID NO: 8039
  misc_feature 1..355: note = Synthetic polypeptide
  source 1..355: mol_type = other DNA

SEQ ID NO: 8923 - DNA, 80 bp, synthetic construct; identical to SEQ ID NO: 6364
  misc_feature 1..80: note = Synthetic polypeptide
  source 1..80: mol_type = other DNA

SEQ ID NO: 8924 - DNA, 217 bp, synthetic construct; identical to SEQ ID NO: 6365
  misc_feature 1..217: note = Synthetic polypeptide
  source 1..217: mol_type = other DNA

SEQ ID NO: 8925 - DNA, 523 bp, synthetic construct
  misc_feature 1..523: note = Synthetic polypeptide
  source 1..523: mol_type = other DNA
agtcccacagatcaaagggctgattgttgtgacattggccgtatgctggatgcccaaccagattcggaggatcatggctgcggccaaacccaagcacgactggacgaggtcctacttccgggcgtacatgatcctcctccccttctcggagacgtttttctacctcagctcggtcatcaacccgctcctgtacacggtgtcctcgcagcagtttcggcgggtgttcgtgcaggtgctgtgctgccgcctgtcgctgcagcacgccaaccacgagaagcgcctgcgcgtacatgcgcactccaccaccgacagcgcccgctttgtgcagcgcccgttgctcttcgcgtcccggcgccagtcctctgcaaggagaactgagaagattttcttaagcacttttcagagcgaggccgagccccagtctaagtcccagtcattgagtctcgagtcactagagcccaactcaggcgcgaaaccagccaattctgctgcagagaatggttttcaggagcatgaagtttga

SEQ ID NO: 8926 - DNA, 900 bp, synthetic construct
  misc_feature 1..900: note = Synthetic polypeptide
  source 1..900: mol_type = other DNA
gctctgccattcactacccttccagattctgagcaaattaagttacattcccttttggagcctcagggtcctcaccgcagaatgtgagatcacggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgatccacttcctcatgatactgtcttctaactgggcttacttaaaggatgcgagcaaaatgcaggcttaccaggatatcaaagcaaaggaagaacaggaactgcaagatatccagtctcggtcaaaagaacaactcaattcttacacataa

SEQ ID NO: 8927 - DNA, 831 bp, synthetic construct
  misc_feature 1..831: note = Synthetic polypeptide
  source 1..831: mol_type = other DNA
gctctgccattcactacccttccagattctgagcaaattaagttacattcccttttggagcctcagggtcctcaccgcagaatgtgagatcacggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgctgatctacatgatggctactacatataactatgcggttttgaagtttaagagtcgggaagattgctgcactaaattctaa

SEQ ID NO: 8928 - DNA, 354 bp, synthetic construct
  misc_feature 1..354: note = Synthetic polypeptide
  source 1..354: mol_type = other DNA
gctctgccattcactacccttccagattctgagcaaattaagttacattcccttttggagcctcagggtcctcaccgcagaatgtgagatcacggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggca

SEQ ID NO: 8929 - DNA, 1082 bp, synthetic construct
  misc_feature 1..1082: note = Synthetic polypeptide
  source 1..1082: mol_type = other DNA
ggccaggcatggtggctcatgcctgtgatccgagtgttttggatgctgaggtacttcaggtcatgccttctgacagcttctttttttccattgtccgagacccagcggctctggctcgctctgccttctcctactataaatccacctcatcagccttccgcaagtcaccatctttggctgccttcctggccaatcctcgaggcttctacaggcctggggcccgtggggaccactacgctcgcaacttactatggtttgactttggcctgccctttcccccagagaagagggccaagagagggaatattcatccccccagagaccccaaccccccacagctgcaggtcttgccttctggtgctggccctcgagcccaaaccctcaatcccaatgccctcatccatcctgtttccactgttactgatcatcgcagccagatatcaagccctgcctctttcgatttggggtcttcatccttcatccagtggggtctggcatggctggactctgtctttgacctggtcatggtggctgagtacttcgatgagtcattggttctgctggcagatgccctgtgctggggtctagatgacgtggtgggcttcatgcacaatgcccaggctggacataagcagggcctcagcactgtcagcaacagtggactgactgcggaggaccggcagctgactgcacgggcccgagcctggaacaacctggactgggctctctatgtccacttcaaccgcagtctctgggcacggatagagaaatacggccagggccggctgcagacagctgtggccgagctccgggctcgccgagaggccctagcgaaacattgtctggtagggggtgaggcttctgaccccaaatacatcactgatcgccggttccgccccttccagtttgggtcagctaaggttttgggctatatacttcggagtggattgagcccccaagaccaagaggaatgtgagcgcctagctacccctgagctccagtacaaggacaagctggatgccaagcagttcccccctaccgtctcactgcccctcaagacttcaaggccactctccccataa

SEQ ID NO: 8930 - DNA, 588 bp, synthetic construct
  misc_feature 1..588: note = Synthetic polypeptide
  source 1..588: mol_type = other DNA
ggccaggcatggtggctcatgcctgtgatccgagtgttttggatgctgaggtacttcaggtcatgccttctgacagcttctttttttccattgtccgagacccagcggctctggctcgctctgccttctcctactataaatccacctcatcagccttccgcaagtcaccatctttggctgccttcctggccaatcctcgaggcttctacaggcctggggcccgtggggaccactacgctcgcaacttactatggtttgactttggcctgccctttcccccagagaagagggccaagagagggaatattcatccccccagagaccccaaccccccacagctgcaggtcttgccttctggtgctggccctcgagcccaaaccctcaatcccaatgccctcatccatcctgtttccactgttactgatcatcgcagccagatatcaagccctgcctctttcgatttggggtcttcatccttcatccagtggggtctggcatggctggactctgtctttgacctggtcatggtggctgagtacttcgatgagtcattggttctgctggcagatgccctgtgctggggtctag

SEQ ID NO: 8931 - DNA, 763 bp, synthetic construct; identical to SEQ ID NO: 606
  misc_feature 1..763: note = Synthetic polypeptide
  source 1..763: mol_type = other DNA

SEQ ID NO: 8932 - DNA, 1084 bp, synthetic construct; identical to SEQ ID NO: 580
  misc_feature 1..1084: note = Synthetic polypeptide
  source 1..1084: mol_type = other DNA

SEQ ID NO: 8933 - DNA, 1367 bp, synthetic construct
  misc_feature 1..1367: note = Synthetic polypeptide
  source 1..1367: mol_type = other DNA
tggtggttaagttggagcctgacctgggaccgcagatgttcatggactgcagcccacaggccctgcccatcgcatcagaggacaccacggggcagcatgaccaccacttcttagaccccaactgccacatctgcaaggactgggagccctcgaatgagctgctaggctccttcgaagccgccaagagctgcggggacaatatcttccagaaagccctaagccaaactcctatgcctgctccagagatgcccaaaaccagggagttgtctcccacggaaccacaggacagggtccctccatctgggctccatgtgcctgctgcacccacaaaggccctgccctgcctgccaccctgggaaggtgttctggacatgttctccatcaagcggttccgggccagggcccagctggtctcgggacacagctgtcggcttgtccaggctctgcccaccgtgatccgctcggcaggctgcatcccctccaacattgtctgggaccttctggccagcatctgcccagccaaggccaaggacgtctgcgtggtcagactgtgcccacatggggcccgggacacccagaactgccgcctgctctactcatacctcaatgataggcagcgccacgggctggcctctgtggagcacatggggatggtcctgctgcccctgcctgccttccagcccctgcccaccaggctgcgccctttggggggcccaggtctggaggtcactcactcaagtctgttgctggctgtgctgctccccaaggaagggcttccagacacagcagggtccagcccctggttggggaaggttcaaaagatggtctccttcaacagtaaggtggagaagagatactatcagccagatgacaggaggccgaatgtgcccctgaagggcacccctcccccaggaggtgcctggcagcagagccagggcaggggcagtatagctccaaggggaatctctgcttggcagaggccccccagaggcagggggaggctctggccagagcctgaaaactggcagcatcctgggcgagggcagtggcccccagagccaggcttgcgccagtcccagcatccctattcagtagcaccagctggtcatggctttggccgtggccagcacttccacagggactcctgtccccaccaagccctgctccggcacctcgaatccctggcgaccatgagtcaccagctccaagccttactgtgcccccagaccaagagctccatcccccgccctctgcagcgtttgtctagcgcccttgcagctccagagccccctggcccagcccgtgactcctctttggggcctacagatgaagctggctctgagtgtcccttccctagaaaggcctga

SEQ ID NO: 8934 - DNA, 1406 bp, synthetic construct
  misc_feature 1..1406: note = Synthetic polypeptide
  source 1..1406: mol_type = other DNA
tggtggttaagttggagcctgacctgggaccgcagatgttcatggactgcagcccacaggccctgcccatcgcatcagaggacaccacggggcagcatgaccaccacttcttagaccccaactgccacatctgcaaggactgggagccctcgaatgagctgctaggctccttcgaagccgccaagagctgcggggacaatatcttccagaaagccctaagccaaactcctatgcctgctccagagatgcccaaaaccagggagttgtctcccacggaaccacaggacagggtccctccatctgggctccatgtgcctgctgcacccacaaaggccctgccctgcctgccaccctgggaaggtgttctggacatgttctccatcaagcggttccgggccagggcccagctggtctcgggacacagctgtcggcttgtccaggctctgcccaccgtgatccgctcggcaggctgcatcccctccaacattgtctgggaccttctggccagcatctgcccagccaaggccaaggacgtctgcgtggtcagactgtgcccacatggggcccgggacacccagaactgccgcctgctctactcatacctcaatgataggcagcgccacgggctggcctctgtggagcacatggggatggtcctgctgcccctgcctgccttccagcccctgcccaccaggctgcgccctttggggggcccaggcctttgggctcttcctgtctcccctctcctttccccaggtctggaggtcactcactcaagtctgttgctggctgtgctgctccccaaggaagggcttccagacacagcagggtccagcccctggttggggaaggttcaaaagatggtctccttcaacagtaaggtggagaagagatactatcagccagatgacaggaggccgaatgtgcccctgaagggcacccctcccccaggaggtgcctggcagcagagccagggcaggggcagtatagctccaaggggaatctctgcttggcagaggccccccagaggcagggggaggctctggccagagcctgaaaactggcagcatcctgggcgagggcagtggcccccagagccaggcttgcgccagtcccagcatccctattcagtagcaccagctggtcatggctttggccgtggccagcacttccacagggactcctgtccccaccaagccctgctccggcacctcgaatccctggcgaccatgagtcaccagctccaagccttactgtgcccccagaccaagagctccatcccccgccctctgcagcgtttgtctagcgcccttgcagctccagagccccctggcccagcccgtgactcctctttggggcctacagatgaagctggctctgagtgtcccttccctagaaaggcctga

SEQ ID NO: 8935 - DNA, 399 bp, synthetic construct
  misc_feature 1..399: note = Synthetic polypeptide
  source 1..399: mol_type = other DNA
tggtggttaagttggagcctgacctgggaccgcagatgttcatggactgcagcccacaggccctgcccatcgcatcagaggacaccacggggcagcatgaccaccacttcttagaccccaactgccacatctgcaaggactgggagccctcgaatgagctgctaggctccttcgaagccgccaagagctgcggggacaatatcttccagaaagccctaagccaaactcctatgcctgctccagagatgcccaaaaccagggagttgtctcccacggaaccacaggacagggtccctccatctgggctccatgtgcctgctgcacccacaaaggccctgccctgcctgccaccctgggaaggtgttctggacatgttctccatcaagcggttccgggcca

SEQ ID NO: 8936 - DNA, 1595 bp, synthetic construct; identical to SEQ ID NO: 851
  misc_feature 1..1595: note = Synthetic polypeptide
  source 1..1595: mol_type = other DNA

SEQ ID NO: 8937 - DNA, 1433 bp, synthetic construct; identical to SEQ ID NO: 852
  misc_feature 1..1433: note = Synthetic polypeptide
  source 1..1433: mol_type = other DNA

SEQ ID NO: 8938 - DNA, 414 bp, synthetic construct
  misc_feature 1..414: note = Synthetic polypeptide
  source 1..414: mol_type = other DNA
gggatcccagaacagaaaaatgacattgagggacaatgaggaaacctggataattaggttttagtgccaaagaaccctgcgttcatggggaagatggttgaagtggacatctatgaatcaggcaaacattttatgaaagggcagccagtatctgatgccaaagtgtacacgccctccatcagcaaaccgctagcaaagggagaagtctcgggtttgacaaaggacttcagaaatgggcttgggaaccagctgagttcaggatcccacacctctgctgcatctcagtgtgactcagcgagttccagaatggtgctgcccatgccaaggctacatcaagactgtgcgctgaggatgtccgtgggcttggctctgctgggtcttctttttgctttttttgtcaaggtctataattag

SEQ ID NO: 8939 - DNA, 139 bp, synthetic construct
  misc_feature 1..139: note = Synthetic polypeptide
  source 1..139: mol_type = other DNA
tggcagagtagagccagcctgggtgctggagtcagactgcagacttggttccctgctcgtcccagttctgctgcctgcggacaagttatttcagctctcttagctccacatgatttttttcatctgtcaggtactctga

SEQ ID NO: 8940 - DNA, 368 bp, synthetic construct
  misc_feature 1..368: note = Synthetic polypeptide
  source 1..368: mol_type = other DNA
tggcagagtagagccagcctgggtgctggagtcagactgcagacttggttccctgctcgtcccagttctgctgcctgcggacaagttatttcagctctcttagctccacatgatttttttcatctgtcaggtactctgatggctaccgcagctcctccctcctccgggccgtggcccacctgcggtcccagctctgggcccacctccctcgagcccccctagctcccagatggagcccctctgcctggtgctgggttgggggagccctgctaggccccatggtactgagtaagcatccccacctctgccttgtggccctgtgtgaggcagaagaggcccctcctgccagctccacaccccatgtcgtg

SEQ ID NO: 8941 - DNA, 2192 bp, synthetic construct
  misc_feature 1..2192: note = Synthetic polypeptide
  source 1..2192: mol_type = other DNA
tggcagagtagagccagcctgggtgctggagtcagactgcagacttggttccctgctcgtcccagttctgctgcctgcggacaagttatttcagctctcttagctccacatgatttttttcatctgtcaggtactctgatggctaccgcagctcctccctcctccgggccgtggcccacctgcggtcccagctctgggcccacctccctcgagcccccctagctcccagatggagcccctctgcctggtgctgggttgggggagccctgctaggccccatggtactgagtaagcatccccacctctgccttgtggccctgtgtgaggcagaagaggcccctcctgccagctccacaccccatgtcgtggggtctcgctttaactggaagctcttctggcagtttctgcacccccacctgctggtcctgggggtagccgtcgtgctggccttgggtgcggcactcgtgaatgtacagatccccctgctcctgggccagctggtagaggtcgtggccaagtacacaagggaccacgtagggagtttcatgactgagtcccagaatctcagcacccacctgcttatcctctatggtgtccagggactgctgaccttcgggtacctggtgctgctgtcccacgttggcgagcgcatggctgtggacatgcggagggccctcttcagctccctgctccgacaagacatcaccttctttgacgccaataagacagggcagctggtgagccgcttgacaactgacgtgcaggagtttaagtcatccttcaagcttgtcatctcccaggggctgcgaagctgcacccaggtggcaggctgcctggtgtccctgtccatgctgtcgacacgcctcacgctgctgctgatggtggccacaccagccctgatgggagtgggcaccctgatgggctcaggcctccgaaaattgtctcgccagtgtcaggagcagatcgccagggcaatgggcgtagcagacgaggccctgggcaatgtgcggactgtgcgtgccttcgccatggagcaacgggaagaggagcgctatggggcagagctggaagcctgccgctgccgggcagaggagctgggccgcggcatcgccttgttccaagggctttccaacatcgccttcaactgcatggtcttgggtaccctatttattgggggctcccttgtggccggacagcagctgacagggggagacctcatgtccttcctggtggcctcccagacagtgcaaaggtccatggccaacctctctgtcctgtttgggcaggtggtccgggggctgagtgcaggtgcccgggtctttgagtacatggccctgaacccctgcatcccactgtctgggggctgctgcgtccccaaagagcagctgcgtggctccgttacatttcagaacgtctgcttcagctacccctgccgccccggcttcgaggtgctgaaagacttcaccctgacgctgccccctggcaagatcgtggccctcgtgggccagtctggcggaggaaagaccaccgtggcttccctgctggagcgcttctacgaccccacggcaggcgtggtgatgctggatgggcgggacctgcgcacccttgacccctcctggctccggggccaggttgtcggcttcatcagccaggagcccgtcctgtttgggacgaccatcatggaaaacatccgctttgggaagctggaagcttccgatgaagaggtgtacacagccgcccgggaagcgaatgctcacgagttcatcaccagcttccccgagggctacaacacggtcgtcggtgaacggggcactaccctgtctgggggccagaagcagcgcctggccatcgcccgagcccttatcaagcagcccacggtgctgatactggatgaagctaccagcgcgctggatgcagagtccgagcgggttgtacaggaggccctggaccgggccagtgcaggccgcacggtgctggtaattgcccaccggctcagcactgtccgtggggcccactgcattgtcgtcatggccgatggccgtgtctgggaggctgggacacatgaagagctcctgaagaaaggcgggctatacgccgagctcatccggaggcaggccctggatgccccgaggacagcggccccaccgcccaaaaagccagaaggccccaggagccaccagcacaagtcctga

SEQ ID NO: 8942 - DNA, 1328 bp, synthetic construct
  misc_feature 1..1328: note = Synthetic polypeptide
  source 1..1328: mol_type = other DNA
tggcagagtagagccagcctgggtgctggagtcagactgcagacttggttccctgctcgtcccagttctgctgcctgcggacaagttatttcagctctcttagctccacatgatttttttcatctgtcaggtactctgatggctaccgcagctcctccctcctccgggccgtggcccacctgcggtcccagctctgggcccacctccctcgagcccccctagctcccagatggagcccctctgcctggtgctgggttgggggagccctgctaggccccatggtactgagtaagcatccccacctctgccttgtggccctgtgtgaggcagaagaggcccctcctgccagctccacaccccatgtcgtggggtctcgctttaactggaagctcttctggcagtttctgcacccccacctgctggtcctgggggtagccgtcgtgctggccttgggtgcggcactcgtgaatgtacagatccccctgctcctgggccagctggtagaggtcgtggccaagtacacaagggaccacgtagggagtttcatgactgagtcccagaatctcagcacccacctgcttatcctctatggtgtccagggactgctgaccttcgggtacctggtgctgctgtcccacgttggcgagcgcatggctgtggacatgcggagggccctcttcagctccctgctccgacaagacatcaccttctttgacgccaataagacagggcagctggtgagccgcttgacaactgacgtgcaggagtttaagtcatccttcaagcttgtcatctcccaggggctgcgaagctgcacccaggtggcaggctgcctggtgtccctgtccatgctgtcgacacgcctcacgctgctgctgatggtggccacaccagccctgatgggagtgggcaccctgatgggctcaggcctccgaaaattgtctcgccagtgtcaggagcagatcgccagggcaatgggcgtagcagacgaggccctgggcaatgtgcggactgtgcgtgccttcgccatggagcaacgggaagaggagcgctatggggcagagctggaagcctgccgctgccgggcagaggagctgggccgcggcatcgccttgttccaagggctttccaacatcgccttcaactgcatggtcttgggtaccctatttattgggggctcccttgtggccggacagcagctgacagggggagacctcatgtccttcctggtggcctcccagacagtgcaaaggcaggtccatggccaacctctctgtcctgtttgggcaggtggtccgggggctgagtgcaggtgcccgggtctttga

SEQ ID NO: 8943 - DNA, 2117 bp, synthetic construct
  misc_feature 1..2117: note = Synthetic polypeptide
  source 1..2117: mol_type = other DNA
tggcagagtagagccagcctgggtgctggagtcagactgcagacttggttccctgctcgtcccagttctgctgcctgcggacaagttatttcagctctcttagctccacatgatttttttcatctgtcaggtactctgatggctaccgcagctcctccctcctccgggccgtggcccacctgcggtcccagctctgggcccacctccctcgagcccccctagctcccagatggagcccctctgcctggtgctgggttgggggagccctgctaggccccatggtactgagtaagcatccccacctctgccttgtggccctgtgtgaggcagaagaggcccctcctgccagctccacaccccatgtcgtggggtctcgctttaactggaagctcttctggcagtttctgcacccccacctgctggtcctgggggtagccgtcgtgctggccttgggtgcggcactcgtgaatgtacagatccccctgctcctgggccagctggtagaggtcgtggccaagtacacaagggaccacgtagggagtttcatgactgagtcccagaatctcagcacccacctgcttatcctctatggtgtccagggactgctgaccttcgggtacctggtgctgctgtcccacgttggcgagcgcatggctgtggacatgcggagggccctcttcagctccctgctccgacaagacatcaccttctttgacgccaataagacagggcagctggtgagccgcttgacaactgacgtgcaggagtttaagtcatccttcaagcttgtcatctcccaggggctgcgaagctgcacccaggtggcaggctgcctggtgtccctgtccatgctgtcgacacgcctcacgctgctgctgatggtggccacaccagccctgatgggagtgggcaccctgatgggctcaggcctccgaaaattgtctcgccagtgtcaggagcagatcgccagggcaatgggcgtagcagacgaggccctgggcaatgtgcggactgtgcgtgccttcgccatggagcaacgggaagaggagcgctatggggcagagctggaagcctgccgctgccgggcagaggagctgggccgcggcatcgccttgttccaagggctttccaacatcgccttcaactgcatggtcttgggtaccctatttattgggggctcccttgtggccggacagcagctgacagggggagacctcatgtccttcctggtggcctcccagacagtgcaaaggtccatggccaacctctctgtcctgtttgggcaggtggtccgggggctgagtgcaggtgcccgggtctttgagtacatggccctgaacccctgcatcccactgtctgggggctgctgcgtccccaaagagcagctgcgtggctccgttacatttcagaacgtctgcttcagctacccctgccgccccggcttcgaggtgctgaaagacttcaccctgacgctgccccctggcaagatcgtggccctcgtgggccagtctggcggaggaaagaccaccgtggcttccctgctggagcgcttctacgaccccacggcaggcgtggtgatgctggatgggcgggacctgcgcacccttgacccctcctggctccggggccaggttgtcggcttcatcagccaggagcccgtcctgtttgggacgaccatcatggaaaacatccgctttgggaagctggaagcttccgatgaagaggtgtacacagccgcccgggaagcgaatgctcacgagttcatcaccagcttccccgagggctacaacacggtcgtcggtgaacggggcactaccctgtctgggggccagaagcagcgcctggccatcgcccgagcccttatcaagcagcccacggtgctgatactggatgaagctaccagcgcgctggatgcagagtccgagcgggttgtacaggaggccctggaccgggccagtgcaggccgcacggtgctggctgggacacatgaagagctcctgaagaaaggcgggctatacgccgagctcatccggaggcaggccctggatgccccgaggacagcggccccaccgcccaaaaagccagaaggccccaggagccaccagcacaagtcctga

SEQ ID NO: 8944 - DNA, 1265 bp, synthetic construct
  misc_feature 1..1265: note = Synthetic polypeptide
  source 1..1265: mol_type = other DNA
tggcagagtagagccagcctgggtgctggagtcagactgcagacttggttccctgctcgtcccagttctgctgcctgcggacaagttatttcagctctcttagctccacatgatttttttcatctgtcaggtactctgatggctaccgcagctcctccctcctccgggccgtggcccacctgcggtcccagctctgggcccacctccctcgagcccccctagctcccagatggagcccctctgcctggtgctgggttgggggagccctgctaggccccatggtactgagtaagcatccccacctctgccttgtggccctgtgtgaggcagaagaggcccctcctgccagctccacaccccatgtcgtggggtctcgctttaactggaagctcttctggcagtttctgcacccccacctgctggtcctgggggtagccgtcgtgctggccttgggtgcggcactcgtgaatgtacagatccccctgctcctgggccagctggtagaggtcgtggccaagtacacaagggaccacgtagggagtttcatgactgagtcccagaatctcagcacccacctgcttatcctctatggtgtccagggactgctgaccttcgggtacctggtgctgctgtcccacgttggcgagcgcatggctgtggacatgcggagggccctcttcagctccctgctccgacaagacatcaccttctttgacgccaataagacagggcagctggtgagccgcttgacaactgacgtgcaggagtttaagtcatccttcaagcttgtcatctcccaggggctgcgaagctgcacccaggtggcaggctgcctggtgtccctgtccatgctgtcgacacgcctcacgctgctgctgatggtggccacaccagccctgatgggagtgggcaccctgatgggctcaggcctccgaaaattgtctcgccagtgtcaggagcagatcgccagggcaatgggcgtagcagacgaggccctgggcaatgtgcggactgtgcgtgccttcgccatggagcaacgggaagaggagcgctatggggcagagctggaagcctgccgctgccgggcagaggagctgggccgcggcatcgccttgttccaagggctttccaacatcgccttcaactgcatggtcttgggtaccctatttattgggggctcccttgtggccggacagcagctgacagggggagacctcatgtccttcctggtggcctcccagacagtgcaaagggacgtcctctaa

SEQ ID NO: 8945 - DNA, 1331 bp, synthetic construct
  misc_feature 1..1331: note = Synthetic polypeptide
  source 1..1331: mol_type = other DNA
tggcagagtagagccagcctgggtgctggagtcagactgcagacttggttccctgctcgtcccagttctgctgcctgcggacaagttatttcagctctcttagctccacatgatttttttcatctgtcaggtactctgatggctaccgcagctcctccctcctccgggccgtggcccacctgcggtcccagctctgggcccacctccctcgagcccccctagctcccagatggagcccctctgcctggtgctgggttgggggagccctgctaggccccatggtactgagtaagcatccccacctctgccttgtggccctgtgtgaggcagaagaggcccctcctgccagctccacaccccatgtcgtggggtctcgctttaactggaagctcttctggcagtttctgcacccccacctgctggtcctgggggtagccgtcgtgctggccttgggtgcggcactcgtgaatgtacagatccccctgctcctgggccagctggtagaggtcgtggccaagtacacaagggaccacgtagggagtttcatgactgagtcccagaatctcagcacccacctgcttatcctctatggtgtccagggactgctgaccttcgggtacctggtgctgctgtcccacgttggcgagcgcatggctgtggacatgcggagggccctcttcagctccctgctccgacaagacatcaccttctttgacgccaataagacagggcagctggtgagccgcttgacaactgacgtgcaggagtttaagtcatccttcaagcttgtcatctcccaggggctgcgaagctgcacccaggtggcaggctgcctggtgtccctgtccatgctgtcgacacgcctcacgctgctgctgatggtggccacaccagccctgatgggagtgggcaccctgatgggctcaggcctccgaaaattgtctcgccagtgtcaggagcagatcgccagggcaatgggcgtagcagacgaggccctgggcaatgtgcggactgtgcgtgccttcgccatggagcaacgggaagaggagcgctatggggcagagctggaagcctgccgctgccgggcagaggagctgggccgcggcatcgccttgttccaagggctttccaacatcgccttcaactgcatggtcttgggtaccctatttattgggggctcccttgtggccggacagcagctgacagggggagacctcatgtccttcctggtggcctcccagacagtgcaaagcttcctccgtgttgcaccctgtccgaattcccttccgctgcaggctgtgacattccatgcatggaaggaccatccttga

SEQ ID NO: 8946 - DNA, 413 bp, synthetic construct
  misc_feature 1..413: note = Synthetic polypeptide
  source 1..413: mol_type = other DNA
tttggcgtgcaacatggggcttgagaaagggcattgaagttgatatcgatgtggagcacggagggaaaagaagccgcctgacccccgtctctccagagagttccagcacagaggagaagagcagctcacagccaagcagctgctgctctgaccccagcaagccgggtgggaatgttgagggcgccacgcagtctctggcggagcagatgaggaagatcgccttggaatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtag

SEQ ID NO: 8947 - DNA, 599 bp, synthetic construct
  misc_feature 1..599: note = Synthetic polypeptide
  source 1..599: mol_type = other DNA
tttggcgtgcaacatggggcttgagaaagggcattgaagttgatatcgatgtggagcacggagggaaaagaagccgcctgacccccgtctctccagagagttccagcacagaggagaagagcagctcacagccaagcagctgctgctctgaccccagcaagccgggtgggaatgttgagggcgccacgcagtctctggcggagcagatgaggaagatcgccttggagtccgaggggcgccctgaggaacagatggagtcggataactgttcaggaggagatgatgactggacccatctgtcttcaaaagaagtggacccgtctacaggtgaactccagtccctacagatgccagaatccgaagggccaagctctctggacccctcccaggagggacccacagggctgaaggaagctgccttgtacccacatctcccgccagaggctgacccgcggctgattgagtccctctcccagatgctgtccatgggcttctctgatgaaggcggctggctcaccaggctcctgcagaccaagaactatgacatcggagcggctctggacaccatccagtattcaaagcatcccccgccgttgtga

SEQ ID NO: 8948 - DNA, 289 bp, synthetic construct; identical to SEQ ID NO: 7343
  misc_feature 1..289: note = Synthetic polypeptide
  source 1..289: mol_type = other DNA

SEQ ID NO: 8949 - DNA, 246 bp, synthetic construct; identical to SEQ ID NO: 7344
  misc_feature 1..246: note = Synthetic polypeptide
  source 1..246: mol_type = other DNA

SEQ ID NO: 8950 - DNA, 149 bp, synthetic construct; identical to SEQ ID NO: 7345
  misc_feature 1..149: note = Synthetic polypeptide
  source 1..149: mol_type = other DNA

SEQ ID NO: 8951 - DNA, 89 bp, synthetic construct; identical to SEQ ID NO: 7346
  misc_feature 1..89: note = Synthetic polypeptide
  source 1..89: mol_type = other DNA

SEQ ID NO: 8952 - DNA, 80 bp, synthetic construct; identical to SEQ ID NO: 7347
  misc_feature 1..80: note = Synthetic polypeptide
  source 1..80: mol_type = other DNA

SEQ ID NO: 8953 - DNA, 271 bp, synthetic construct
  misc_feature 1..271: note = Synthetic polypeptide
  source 1..271: mol_type = other DNA
gagctcttggcttccatacgtgtctcagacagaatcatctcccctgccccacaaacatgaaagaaaagacaagagaagcaccccagaagaggaggggagaagtgccccagaaaaaatcatccagtctctgaagctttgcccaggtgggcacaggccagccagcctctcctctggttgcccagctggctgcaggctgtcatttaaccttccgcccagcatgcttttgagtgtgcagaagtgctgcatgccctcttctttgaaaacctgttga

SEQ ID NO: 8954 - DNA, 60 bp, synthetic construct
  misc_feature 1..60: note = Synthetic polypeptide
  source 1..60: mol_type = other DNA
gagctcttggcttccatacgtgtctcagacagaatcatctcccctgccccacaaacatga

SEQ ID NO: 8955 - DNA, 254 bp, synthetic construct
  misc_feature 1..254: note = Synthetic polypeptide
  source 1..254: mol_type = other DNA
atttacatcctgagcccacatagcttcttgaactcaggactcatgtccagcatcacatttcgacatctccatttggatgtgtcatagaaaagcctgccattgctccgcccgtctttgtgtttcagaaggataaaggacaaaaggtaaggggccgaggtcagctggcggctccagtcctgaaggcggagaagattctgacagagaagatggaaattactgccctcctgtcaagcgagaaagaacatcctctttaa

SEQ ID NO: 8956 - DNA, 1754 bp, synthetic construct
  misc_feature 1..1754: note = Synthetic polypeptide
  source 1..1754: mol_type = other DNA
atttacatcctgagcccacatagcttcttgaactcaggactcatgtccagcatcacatttcgacatctccatttggatgtgtcatagaaaagcctgccattgctccgcccgtctttgtgtttcagaaggataaaggacaaaagtcccctgcagagcaaaaaaacttgtcggattcgggagaggagcctcggggggaggctgaggccccccaccatggcacgggtcaccccgagtcagctggcgagcatgccctagaacctcctgcccctgctggcgcctcagccagcactcctccgcctcccgctcctgaagcccagcttcctccttttccgcgagaactggcagggaggtcagctggcggctccagtcctgaaggcggagaagattctgacagagaagatggaaattactgccctcctgtcaagcgagaaagaacatcctctttaacccagttcccaccctcacagtcagaggaaaggagcagtggcttccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactgtccccagcagtggcaccaacggggtcagcctcccagcagactgcacgggggcagtgcccgcagcatcccctgacactgctgcatggagaagtccttccgaagctgccgatgaggagaaagagccccagaaaaatgagtccagcaatgcctctgaagaggaagcctgtgagaaaaaagaccccgccacacagcaagcctttgtatttgggcagaacttgagggacagagttaagctgataaatgagagcgtggacgaagccgacatggagaatgctggacaccccagcgcagacacgccaaccgcaacgaactatttcctccagtatatcagttccagtttagagaactcaaccaatagtgccgacgcctccagcaacaaatttgtatttggccagaacatgagcgagcgagttttgagccccccaaaattaaacgaggtcagttcagatgccaacagggaaaatgcagctgccgagtcagggtctgagtcctcgtcccaggaggccacccctgagaaagagtccctggctgagtcggcagccgcctacaccaaggcaacagcgcggaagtgtttgttggaaaaagtggaagtcatcaccggggaggaggcggagagcaatgtgttacagatgcagtgcaagctgtttgtctttgacaagacctcacagtcctgggtggagagaggccgggggctgctcagactcaatgacatggcgtccaccgatgacggcacactacagtcccgactagtgatgcggacccaggggagcctgcgactgatcctcaacaccaagctgtgggcccagatgcagatcgacaaggccagcgagaagagcattcgcatcacagccatggacaccgaggaccagggcgtgaaggtcttcctgatctcggccagctccaaggacacaggtcagttgtatgcagccctgcaccaccgcatcctggccctgcgcagccgcgtggagcaggagcaggaggccaagatgcccgcgcctgagcctggggcagccccatccaacgaggaggacgacagcgacgatgacgatgtcctggctccttcaggggccaccgcagctggtgctggtgacgaaggggacgggcagacgaccgggagcacatag

SEQ ID NO: 8957 - DNA, 1769 bp, synthetic construct
  misc_feature 1..1769: note = Synthetic polypeptide
  source 1..1769: mol_type = other DNA
atttacatcctgagcccacatagcttcttgaactcaggactcatgtccagcatcacatttcgacatctccatttggatgtgtcatagaaaagcctgccattgctccgcccgtctttgtgtttcagaaggataaaggacaaaagtcccctgcagagcaaaaaaacttgtcggattcgggagaggagcctcggggggaggctgaggccccccaccatggcacgggtcaccccgagtcagctggcgagcatgccctagaacctcctgcccctgctggcgcctcagccagcactcctccgcctcccgctcctgaagcccagcttcctccttttccgcgagaactggcagggaggtcagctggcggctccagtcctgaaggcggagaagattctgacagagaagatggaaattactgccctcctgtcaagcgagaaagaacatcctctttaacccagttcccaccctcacagtcagaggaaaggagcagtggcttccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactgtccccagcagtggcaccaacggggtcagcctcccagcagactgcacgggggcagtgcccgcagcatcccctgacactgctgcatggagaagtccttccgaagctgccgatgaggtgtgtgcacttgaggagaaagagccccagaaaaatgagtccagcaatgcctctgaagaggaagcctgtgagaaaaaagaccccgccacacagcaagcctttgtatttgggcagaacttgagggacagagttaagctgataaatgagagcgtggacgaagccgacatggagaatgctggacaccccagcgcagacacgccaaccgcaacgaactatttcctccagtatatcagttccagtttagagaactcaaccaatagtgccgacgcctccagcaacaaatttgtatttggccagaacatgagcgagcgagttttgagccccccaaaattaaacgaggtcagttcagatgccaacagggaaaatgcagctgccgagtcagggtctgagtcctcgtcccaggaggccacccctgagaaagagtccctggctgagtcggcagccgcctacaccaaggcaacagcgcggaagtgtttgttggaaaaagtggaagtcatcaccggggaggaggcggagagcaatgtgttacagatgcagtgcaagctgtttgtctttgacaagacctcacagtcctgggtggagagaggccgggggctgctcagactcaatgacatggcgtccaccgatgacggcacactacagtcccgactagtgatgcggacccaggggagcctgcgactgatcctcaacaccaagctgtgggcccagatgcagatcgacaaggccagcgagaagagcattcgcatcacagccatggacaccgaggaccagggcgtgaaggtcttcctgatctcggccagctccaaggacacaggtcagttgtatgcagccctgcaccaccgcatcctggccctgcgcagccgcgtggagcaggagcaggaggccaagatgcccgcgcctgagcctggggcagccccatccaacgaggaggacgacagcgacgatgacgatgtcctggctccttcaggggccaccgcagctggtgctggtgacgaaggggacgggcagacgaccgggagcacatag

SEQ ID NO: 8958 - DNA, 290 bp, synthetic construct
  misc_feature 1..290: note = Synthetic polypeptide
  source 1..290: mol_type = other DNA
atttacatcctgagcccacatagcttcttgaactcaggactcatgtccagcatcacatttcgacatctccatttggatgtgtcatagaaaagcctgccattgctccgcccgtctttgtgtttcagaaggataaaggacaaaagaggtcagctggcggctccagtcctgaaggcggagaagattctgacagagaagatggaaattactgccctcctgtcaagcgagaaagaacatcctctttaacccagttcccaccctcacagtcagaagaaaatttctggaaggaatga

SEQ ID NO: 8959 - DNA, 1550 bp, synthetic construct
  misc_feature 1..1550: note = Synthetic polypeptide
  source 1..1550: mol_type = other DNA
atttacatcctgagcccacatagcttcttgaactcaggactcatgtccagcatcacatttcgacatctccatttggatgtgtcatagaaaagcctgccattgctccgcccgtctttgtgtttcagaaggataaaggacaaaagaggtcagctggcggctccagtcctgaaggcggagaagattctgacagagaagatggaaattactgccctcctgtcaagcgagaaagaacatcctctttaacccagttcccaccctcacagtcagaggaaaggagcagtggcttccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactgtccccagcagtggcaccaacggggtcagcctcccagcagactgcacgggggcagtgcccgcagcatcccctgacactgctgcatggagaagtccttccgaagctgccgatgaggagaaagagccccagaaaaatgagtccagcaatgcctctgaagaggaagcctgtgagaaaaaagaccccgccacacagcaagcctttgtatttgggcagaacttgagggacagagttaagctgataaatgagagcgtggacgaagccgacatggagaatgctggacaccccagcgcagacacgccaaccgcaacgaactatttcctccagtatatcagttccagtttagagaactcaaccaatagtgccgacgcctccagcaacaaatttgtatttggccagaacatgagcgagcgagttttgagccccccaaaattaaacgaggtcagttcagatgccaacagggaaaatgcagctgccgagtcagggtctgagtcctcgtcccaggaggccacccctgagaaagagtccctggctgagtcggcagccgcctacaccaaggcaacagcgcggaagtgtttgttggaaaaagtggaagtcatcaccggggaggaggcggagagcaatgtgttacagatgcagtgcaagctgtttgtctttgacaagacctcacagtcctgggtggagagaggccgggggctgctcagactcaatgacatggcgtccaccgatgacggcacactacagtcccgactagtgatgcggacccaggggagcctgcgactgatcctcaacaccaagctgtgggcccagatgcagatcgacaaggccagcgagaagagcattcgcatcacagccatggacaccgaggaccagggcgtgaaggtcttcctgatctcggccagctccaaggacacaggtcagttgtatgcagccctgcaccaccgcatcctggccctgcgcagccgcgtggagcaggagcaggaggccaagatgcccgcgcctgagcctggggcagccccatccaacgaggaggacgacagcgacgatgacgatgtcctggctccttcaggggccaccgcagctggtgctggtgacgaaggggacgggcagacgaccgggagcacatag

SEQ ID NO: 8960 - DNA, 1565 bp, synthetic construct
  misc_feature 1..1565: note = Synthetic polypeptide
  source 1..1565: mol_type = other DNA
atttacatcctgagcccacatagcttcttgaactcaggactcatgtccagcatcacatttcgacatctccatttggatgtgtcatagaaaagcctgccattgctccgcccgtctttgtgtttcagaaggataaaggacaaaagaggtcagctggcggctccagtcctgaaggcggagaagattctgacagagaagatggaaattactgccctcctgtcaagcgagaaagaacatcctctttaacccagttcccaccctcacagtcagaggaaaggagcagtggcttccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactgtccccagcagtggcaccaacggggtcagcctcccagcagactgcacgggggcagtgcccgcagcatcccctgacactgctgcatggagaagtccttccgaagctgccgatgaggtgtgtgcacttgaggagaaagagccccagaaaaatgagtccagcaatgcctctgaagaggaagcctgtgagaaaaaagaccccgccacacagcaagcctttgtatttgggcagaacttgagggacagagttaagctgataaatgagagcgtggacgaagccgacatggagaatgctggacaccccagcgcagacacgccaaccgcaacgaactatttcctccagtatatcagttccagtttagagaactcaaccaatagtgccgacgcctccagcaacaaatttgtatttggccagaacatgagcgagcgagttttgagccccccaaaattaaacgaggtcagttcagatgccaacagggaaaatgcagctgccgagtcagggtctgagtcctcgtcccaggaggccacccctgagaaagagtccctggctgagtcggcagccgcctacaccaaggcaacagcgcggaagtgtttgttggaaaaagtggaagtcatcaccggggaggaggcggagagcaatgtgttacagatgcagtgcaagctgtttgtctttgacaagacctcacagtcctgggtggagagaggccgggggctgctcagactcaatgacatggcgtccaccgatgacggcacactacagtcccgactagtgatgcggacccaggggagcctgcgactgatcctcaacaccaagctgtgggcccagatgcagatcgacaaggccagcgagaagagcattcgcatcacagccatggacaccgaggaccagggcgtgaaggtcttcctgatctcggccagctccaaggacacaggtcagttgtatgcagccctgcaccaccgcatcctggccctgcgcagccgcgtggagcaggagcaggaggccaagatgcccgcgcctgagcctggggcagccccatccaacgaggaggacgacagcgacgatgacgatgtcctggctccttcaggggccaccgcagctggtgctggtgacgaaggggacgggcagacgaccgggagcacatag

SEQ ID NO: 8961 - DNA, 588 bp, synthetic construct
  misc_feature 1..588: note = Synthetic polypeptide
  source 1..588: mol_type = other DNA
atttacatcctgagcccacatagcttcttgaactcaggactcatgtccagcatcacatttcgacatctccatttggatgtgtcatagaaaagcctgccattgctccgcccgtctttgtgtttcagaaggataaaggacaaaagaggtcagctggcggctccagtcctgaaggcggagaagattctgacagagaagatggaaattactgccctcctgtcaagcgagaaagaacatcctctttaacccagttcccaccctcacagtcagaggaaaggagcagtggcttccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactgtccccagcagtggcaccaacggggtcagcctcccagcagactgcacgggggcagtgcccgcagcatcccctgacactgctgcatggagaagtccttccgaagctgccgatgaggtgtgtgcacttgaggtttttgctctgtcacccaggctggagtgcagtg

SEQ ID NO: 8962 - DNA, 243 bp, synthetic construct
  misc_feature 1..243: note = Synthetic polypeptide
  source 1..243: mol_type = other DNA
atttacatcctgagcccacatagcttcttgaactcaggactcatgtccagcatcacatttcgacatctccatttggatgtgtcatagaaaagcctgccattgctccgcccgtctttgtgtttcagaaggataaaggacaaaagaggtcagctggcggctccagtcctgaaggcggagaagattctgacagagaagatggaaattactgccctcctgtcaagcgagaaagaacatcctctttaa

SEQ ID NO: 8963 - DNA, 287 bp, synthetic construct
  misc_feature 1..287: note = Synthetic polypeptide
  source 1..287: mol_type = other DNA
atttacatcctgagcccacatagcttcttgaactcaggactcatgtccagcatcacatttcgacatctccatttggatgtgtcatagaaaagcctgccattgctccgcccgtctttgtgtttcagaaggataaaggacaaaagaggtcagctggcggctccagtcctgaaggcggagaagattctgacagagaagatggaaattactgccctcctgtcaagcgagaaagaacatcctctttaacccagttcccaccctcacagtcaggcgccttccaggcctgctga

SEQ ID NO: 8964 - DNA, 255 bp, synthetic construct
  misc_feature 1..255: note = Synthetic polypeptide
  source 1..255: mol_type = other DNA
atttacatcctgagcccacatagcttcttgaactcaggactcatgtccagcatcacatttcgacatctccatttggatgtgtcatagaaaagcctgccattgctccgcccgtctttgtgtttcagaaggataaaggacaaaagtcccctgcagagcaaaaaaacttgtcggattcgggagaggagcctcggggggaggctgaggccccccaccatggcacgggtcaccccgagtcagctggcgagcatgccctag

SEQ ID NO: 8965 - DNA, 392 bp, synthetic construct
  misc_feature 1..392: note = Synthetic polypeptide
  source 1..392: mol_type = other DNA
atttacatcctgagcccacatagcttcttgaactcaggactcatgtccagcatcacatttcgacatctccatttggatgtgtcatagaaaagcctgccattgctccgcccgtctttgtgtttcagaaggataaaggacaaaagtcccctgcagagcaaaaaaacttgtcggattcgggagaggagcctcggggggaggctgaggccccccaccatggcacgggtcaccccgagtcagctggcgagcatgccctagaacctcctgcccctgctggcgcctcagccagcactcctccgcctcccgctcctgaagcccagcttcctccttttccgcgagaactggcaggggaagaagaaaagactcttcctttgaacccagaaggaatcccctga

SEQ ID NO: 8966 - DNA, 421 bp, synthetic construct
  misc_feature 1..421: note = Synthetic polypeptide
  source 1..421: mol_type = other DNA
atttacatcctgagcccacatagcttcttgaactcaggactcatgtccagcatcacatttcgacatctccatttggatgtgtcatagaaaagcctgccattgctccgcccgtctttgtgtttcagaaggataaaggacaaaagtcccctgcagagcaaaaaaacttgtcggattcgggagaggagcctcggggggaggctgaggccccccaccatggcacgggtcaccccgagtcagctggcgagcatgccctagaacctcctgcccctgctggcgcctcagccagcactcctccgcctcccgctcctgaagcccagcttcctccttttccgcgagaactggcagggaggtcagctggcggctccagtcctgaaggcggagaagattctgacagagaagatggaaattactgccctcctgt

SEQ ID NO: 8967 - DNA, 252 bp, synthetic construct; identical to SEQ ID NO: 8153
  misc_feature 1..252: note = Synthetic polypeptide
  source 1..252: mol_type = other DNA

SEQ ID NO: 8968 - DNA, 989 bp, synthetic construct
  misc_feature 1..989: note = Synthetic polypeptide
  source 1..989: mol_type = other DNA
actgggagaggggggatcttgactgacattttagatcctgtctgctgctcactgattatgactgtggacgcgtctccctgcttctctgggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctga

SEQ ID NO: 8969 - DNA, 174 bp, synthetic construct
  misc_feature 1..174: note = Synthetic polypeptide
  source 1..174: mol_type = other DNA
tgactcttctggggttttaacagtgtatgccagggaacacacattctctttcgagaattcagcttcgtccaagccaccccccacaatagggtatcatttttacgggccttctggagatgcttccgaactgtgggcaaaaatggcgatttttatatacaaggaaaaccaaactaa

SEQ ID NO: 8970 - DNA, 861 bp, synthetic construct
  misc_feature 1..861: note = Synthetic polypeptide
  source 1..861: mol_type = other DNA
tgactcttctggggttttaacagtgtatgccagggaacacacattctctttcgagaattcagcttcgtccaagccaccccccacaatagggtatcatttttacgggccttctggagatgcttccgaactgtgggcaaaaatggcgatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacagctgcccacccccagcacttgtcaaagaggccctcagcaatgttcagagactgaccttctatggattcctcatggctctctcaaagcaccgtggaatcaaccaagccctcggagctttgcctgacaagggggatctgatgcacgacccagcaatggatgaagagctggaacggctgctggcccaggtcccaggcctggtcaactcggtcacagccagtccagaggccagttgcctgccttcccggacccctccccgggttggctctccctggagacctctccatcattcccgaaaagtggatggagagagtgatggctccactgaagagacagacgagtcggagacttga

SEQ ID NO: 8971 - DNA, 846 bp, synthetic construct
  misc_feature 1..846: note = Synthetic polypeptide
  source 1..846: mol_type = other DNA
tgactcttctggggttttaacagtgtatgccagggaacacacattctctttcgagaattcagcttcgtccaagccaccccccacaatagggtatcatttttacgggccttctggagatgcttccgaactgtgggcaaaaatggcgatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacagctgcccacccccagcacttgtcaaagaggccctcagcaatgttcagagactgaccttctatggattcctcatggctctctcaaagcaccgtggaatcaaccaagccctcggagctttgcctgacaagggggatctgatgcacgacccagcaatggatgaagagctggaacggctggtggtgaggtcgaagctgcaccggacctcacggcagcacagagccaaggagccaggggcctttggctttcagagaagagagaagcaggaggccctggagagagtgtcctcagcttcggtaccgacgccctaccattaccggtgggagcccagagagtga

SEQ ID NO: 8972 - DNA, 690 bp, synthetic construct
  misc_feature 1..690: note = Synthetic polypeptide
  source 1..690: mol_type = other DNA
tgactcttctggggttttaacagtgtatgccagggaacacacattctctttcgagaattcagcttcgtccaagccaccccccacaatagggtatcatttttacgggccttctggagatgcttccgaactgtgggcaaaaatggcgatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacagctgcccacccccagcacttgtcaaagaggccctcagcaatgttcagagactgaccttctatggattcctcatggctctctcaaagcaccgtggaatcaaccaagccctcggagctttgcctgacaagggggatctgatgcacgacccagcaatggatgaagagctggaacggctgtaa

SEQ ID NO: 8973 - DNA, 879 bp, synthetic construct
  misc_feature 1..879: note = Synthetic polypeptide
  source 1..879: mol_type = other DNA
tgactcttctggggttttaacagtgtatgccagggaacacacattctctttcgagaattcagcttcgtccaagccaccccccacaatagggtatcatttttacgggccttctggagatgcttccgaactgtgggcaaaaatggcgatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacagctgcccacccccagcacttgtcaaagaggccctcagcaatgttcagagactgaccttctatggattcctcatggctctctcaaagcaccgtggaatcaaccaagccctcggagctttgcctgacaagggggatctgatgcacgacccagcaatggatgaagagctggaacggctgcttcttcccttcttcaggctggcccaggtcccaggcctggtcaactcggtcacagccagtccagaggccagttgcctgccttcccggacccctccccgggttggctctccctggagacctctccatcattcccgaaaagtggatggagagagtgatggctccactgaagagacagacgagtcggagacttga

SEQ ID NO: 8974 - DNA, 154 bp, synthetic construct
  misc_feature 1..154: note = Synthetic polypeptide
  source 1..154: mol_type = other DNA
tgactcttctggggttttaacagtgtatgccagggaacacacattctctttcgagaattcagcttcgtccaagccaccccccacaatagggtatcatttttacgggccttctggagatgcttccgaactgtgggcaaaaatggcgatttgctga

SEQ ID NO: 8975 - DNA, 1593 bp, synthetic construct; identical to SEQ ID NO: 870
  misc_feature 1..1593: note = Synthetic polypeptide
  source 1..1593: mol_type = other DNA

SEQ ID NO: 8976 - DNA, 1431 bp, synthetic construct; identical to SEQ ID NO: 871
  misc_feature 1..1431: note = Synthetic polypeptide
  source 1..1431: mol_type = other DNA

SEQ ID NO: 8977 - DNA, 147 bp, synthetic construct
  misc_feature 1..147: note = Synthetic polypeptide
  source 1..147: mol_type = other DNA
ttggagttaaccatcccgggcgaaggaaaatcacctcggcagtgtttgaaggaaggatactgcaactctttgaagtacgcattttttgagtgtaaaagatcagtgttggataacagggcaagattcagaggaagaaaaggatattga

SEQ ID NO: 8978 - DNA, 144 bp, synthetic construct
  misc_feature 1..144: note = Synthetic polypeptide
  source 1..144: mol_type = other DNA
ttggagttaaccatcccgggcgaaggaaaatcacctcggcagtgtttgaaggaaggatactgcaactctttgaagtacgcattttttgagtgtaaaagatcagtgatggagtctcgctctgttgcccgggctggagtgcagtag

SEQ ID NO: 8979 - DNA, 1975 bp, synthetic construct
  misc_feature 1..1975: note = Synthetic polypeptide
  source 1..1975: mol_type = other DNA
ggccagatgcagtggttcatgcctgtaatctcagcactttgggaggccgaggcaggcggatcacctgaggtcaggagtttgagaccagcctggccaacgtggtgaaaccctgtctctactaaaaatacaaaaattagctgggcatggtggcaggtgcctgtaatcccagctactcgggaggctgaggcaggagaatcgcttgaacccaggaggtggaggttgcagtgaaccgagatcacaccactacagtacagctgggaaggtggaggatctgcagttccgcgtggaggaggagtccatcaccaagggagacctggagctgaccacagtggccgagaagtcgcgcgtgctgcagctggaggaggagctcaccctgcgccgaggtgaaatcgaggagctccagcagtgcctgttgcactcgggtcccccacctccggaccacccagacgccgccgagatcctgcggctacgggagcggctgctctcggccagcaaggaacaccagagggagagtggggtgctgcgggataaatacgagaaggccctgaaggcctaccaggcggaggtggacaagctccgcgcggccaacgagaagtacgcacaggaggtggcgggcctgaaggacaaggttcagcaggccaccagcgagaacatggggctaatggacaactggaaatccaagctggactcgctggcctcggaccaccagaagtccctggaggacctcaaagccaccctgaactcgggcccaggcgcccagcagaaggagatcggcgagctgaaggcagtgatggagggcatcaagatggagcaccagctggagctgggtaacttgcaggccaagcatgacctggagaccgccatgcacgtgaaggagaaggaggccctgcgagagaagctgcaggaggcccaggaggagctggctgggctgcagcggcactggcgggcccagctggaggtgcaagccagccagcaccggctggagctgcaggaggcccaggaccagcgccgggatgccgagctgcgtgtgcacgagctggaaaaactggacgtggagtaccggggccaggcgcaggctatcgagttcctcaaggagcagatctcgctggccgagaagaagatgttggactacgagcggctgcagcgggcagaagcccagggcaaacaggaggtcgagagtttgcgggagaagctcctggtggctgagaacagactccaggcggtcgaggccctgtgctcctcccagcacacccacatgattgagtcgaatgacatttcagaggagacgatcaggacgaaggaaactgtggagggcctgcaggacaagctgaacaagagggacaaagaggtgacagccttgacctcccagaccgagatgctcagggcccaagtaagtgcgctggagagcaagtgtaagtcaggcgagaagaaggtggacgccctcctgaaggagaagcggcgcctggaggcagagctggagaccgtgtcccggaagacccatgacgcctcgggccagctagtcctcatcagccaggagctgctgcggaaggagcggagcctgaacgaactgcgggtgttgctgctggaggccaatcgtcactccccagggccggagagggacctgagccgtgaggtacacaaggctgagtggcggatcaaggagcagaaactcaaggatgacatccggggcctgcgtgaaaagctgaccgggctggacaaagagaaatccctgtcggatcagaggcgctactccctcatcgaccggtcctcggcgcccgagcttctgcggctgcagcaccagctgatgagcacggaggacgccctgcgggatgcgctggaccaggctcagcaggtggagaagctgatggaggccatgaggagctgccctgacaaggcccagaccatcggcaattccggttctgcaaacggcatccaccagcaggacaaagctcagaaacaagaggacaagcactga

SEQ ID NO: 8980 - DNA, 2080 bp, synthetic construct
  misc_feature 1..2080: note = Synthetic polypeptide
  source 1..2080: mol_type = other DNA
ggccagatgcagtggttcatgcctgtaatctcagcactttgggaggccgaggcaggcggatcacctgaggtcaggagtttgagaccagcctggccaacgtggtgaaaccctgtctctactaaaaatacaaaaattagctgggcatggtggcaggtgcctgtaatcccagctactcgggaggctgaggcaggagaatcgcttgaacccaggaggtggaggttgcagtgaaccgagatcacaccactacagtacagctgggaaggtggaggatctgcagttccgcgtggaggaggagtccatcaccaagggagacctggagacccagacgcagctggagcacgcgcgcattggggagctggaacagagcctgctactggagaaggcgcaggccgagcggctgctccgagaattagcggacaacaggctgaccacagtggccgagaagtcgcgcgtgctgcagctggaggaggagctcaccctgcgccgaggtgaaatcgaggagctccagcagtgcctgttgcactcgggtcccccacctccggaccacccagacgccgccgagatcctgcggctacgggagcggctgctctcggccagcaaggaacaccagagggagagtggggtgctgcgggataaatacgagaaggccctgaaggcctaccaggcggaggtggacaagctccgcgcggccaacgagaagtacgcacaggaggtggcgggcctgaaggacaaggttcagcaggccaccagcgagaacatggggctaatggacaactggaaatccaagctggactcgctggcctcggaccaccagaagtccctggaggacctcaaagccaccctgaactcgggcccaggcgcccagcagaaggagatcggcgagctgaaggcagtgatggagggcatcaagatggagcaccagctggagctgggtaacttgcaggccaagcatgacctggagaccgccatgcacgtgaaggagaaggaggccctgcgagagaagctgcaggaggcccaggaggagctggctgggctgcagcggcactggcgggcccagctggaggtgcaagccagccagcaccggctggagctgcaggaggcccaggaccagcgccgggatgccgagctgcgtgtgcacgagctggaaaaactggacgtggagtaccggggccaggcgcaggctatcgagttcctcaaggagcagatctcgctggccgagaagaagatgttggactacgagcggctgcagcgggcagaagcccagggcaaacaggaggtcgagagtttgcgggagaagctcctggtggctgagaacagactccaggcggtcgaggccctgtgctcctcccagcacacccacatgattgagtcgaatgacatttcagaggagacgatcaggacgaaggaaactgtggagggcctgcaggacaagctgaacaagagggacaaagaggtgacagccttgacctcccagaccgagatgctcagggcccaagtaagtgcgctggagagcaagtgtaagtcaggcgagaagaaggtggacgccctcctgaaggagaagcggcgcctggaggcagagctggagaccgtgtcccggaagacccatgacgcctcgggccagctagtcctcatcagccaggagctgctgcggaaggagcggagcctgaacgaactgcgggtgttgctgctggaggccaatcgtcactccccagggccggagagggacctgagccgtgaggtacacaaggctgagtggcggatcaaggagcagaaactcaaggatgacatccggggcctgcgtgaaaagctgaccgggctggacaaagagaaatccctgtcggatcagaggcgctactccctcatcgaccggtcctcggcgcccgagcttctgcggctgcagcaccagctgatgagcacggaggacgccctgcgggatgcgctggaccaggctcagcaggtggagaagctgatggaggccatgaggagctgccctgacaaggcccagaccatcggcaattccggttctgcaaacggcatccaccagcaggacaaagctcagaaacaagaggacaagcactga

SEQ ID NO: 8981 - DNA, 622 bp, synthetic construct
  misc_feature 1..622: note = Synthetic polypeptide
  source 1..622: mol_type = other DNA
gaccaggtgcagtgactcacacctgcaattccagagctttgggaggctgtggatcacatgaagctaagagttcaagaccagcctgggcaacataacttggattcacttgctggtcatcattggtagcatcttgtcttattttttatttgccatagtttttggagccatgtgtgtaacttgcaacccaccatccaacccttactggattatgcaggagcacatgctggatccagtattctacttagtttgtatcctcacgacgtccattgctcttctgcccaggtttgtatacagagttcttcagggatccctgtttccatctccaattctgagagctaagcactttgacagactaactccagaggagaggactaaagctctcaagaagtggagaggggctggaaagatgaatcaagtgacatcaaagtatgctaaccaatcagctggcaagtcaggaagaagacccatgcctggcccttctgctgtatttgcaatgaagtcagcaagttcctgtgctattgagcaaggaaacttatctctgtgtgaaactgctttagatcaaggctactctgaaactaaggcctttgagatggctggaccctccaaaggtaaagaaagctag

SEQ ID NO: 8982 - DNA, 575 bp, synthetic construct
  misc_feature 1..575: note = Synthetic polypeptide
  source 1..575: mol_type = other DNA
ctgggtgcagtggctcatgcctgtaatcccagcactttgggaggcgagctaagaggatctcctgaacccaagagttcaagaccagcctgggcaacatgattctttcttgtggagaagttattcatgtgaagatccttggaattttggctcttattgatgaaggtgaaacagattggaaattaattgctatcaatgcgaatgatcctgaagcctcaaagtttcatgatattgatgatgttaagaagttcaaaccgggttacctggaagctactcttaattggtttagattatataaggtaccagatggaaaaccagaaaaccagtttgcttttaatggagaattcaaaaacaaggcttttgctcttgaagttattaaatccactcatcaatgttggaaagcattgcttatgaagaagtgtaatggaggagctataaattgcacaaacgtgcagatatctgatagccctttccgttgcactcaagaggaagcaagatcattagttgaatcggtatcatcttcaccaaataaagaaagtaatgaagaagagcaagtgtggcacttccttggcaagtga

SEQ ID NO: 8983 - DNA, 362 bp, synthetic construct
  misc_feature 1..362: note = Synthetic polypeptide
  source 1..362: mol_type = other DNA
ctgggtgcagtggctcatgcctgtaatcccagcactttgggaggcgagctaagaggatctcctgaacccaagagttcaagaccagcctgggcaacatgattctttcttgtggagaagttattcatgtgaagatccttggaattttggctcttattgatgaaggtgaaacagattggaaattaattgctatcaatgcgaatgatcctgaagcctcaaagtttcatgatattgatgatgttaagaagttcaaaccgggttacctggaagctactcttaattggtttagattatataaggtaccagatggaaaaccagaaaaccagtttgcttttaatggagaattcaaaaacaaggcttttgct

SEQ ID NO: 8984 - DNA, 311 bp, synthetic construct
  misc_feature 1..311: note = Synthetic polypeptide
  source 1..311: mol_type = other DNA
ctgggtgcagtggctcatgcctgtaatcccagcactttgggaggcgagctaagaggatctcctgaacccaagagttcaagaccagcctgggcaacatgattctttcttgtggagaagttattcatgtgaagatccttggaattttggctcttattgatgaaggtgaaacagattggaaattaattgctatcaatgcgaatgatcctgaagcctcaaagtttcatgatattgatgatgttaagaagttcaaaccgggttacctggaagctactcttaattggtttagattatataaggtaccagatggaaaa

SEQ ID NO: 8985 - DNA, 416 bp, synthetic construct
  misc_feature 1..416: note = Synthetic polypeptide
  source 1..416: mol_type = other DNA
ctgggtgcagtggctcatgcctgtaatcccagcactttgggaggcgagctaagaggatctcctgaacccaagagttcaagaccagcctgggcaacatgattctttcttgtggagaagttattcatgtgaagatccttggaattttggctcttattgatgaaggtgaaacagattggaaattaattgctatcaatgcgaatgatcctgaagcctcaaagtttcatggtctcagaaatattccagtatatacaataaatcgcatagtcatcctgccttcacttgacaggagccaaacttccagcctgtcctacctgcctgcacatcaggattcctgtgtgcccctggatgcagccctacatgttgttttgtatttttgttccctcttgggtctacaaagttacttatcttgtttttga

SEQ ID NO: 8986 - DNA, 172 bp, synthetic construct
  misc_feature 1..172: note = Synthetic polypeptide
  source 1..172: mol_type = other DNA
ctgggtgcagtggctcatgcctgtaatcccagcactttgggaggcgagctaagaggatctcctgaacccaagagttcaagaccagcctgggcaacatgattctttcttgtggagaagttattcatgtgaagatccttggaattttggctcttattgatgaaggtgaaacaga

SEQ ID NO: 8987 - DNA, 2157 bp, synthetic construct; identical to SEQ ID NO: 6426
  misc_feature 1..2157: note = Synthetic polypeptide
  source 1..2157: mol_type = other DNA

SEQ ID NO: 8988 - DNA, 799 bp, synthetic construct; identical to SEQ ID NO: 6427
  misc_feature 1..799: note = Synthetic polypeptide
  source 1..799: mol_type = other DNA

SEQ ID NO: 8989 - DNA, 336 bp, synthetic construct; identical to SEQ ID NO: 6428
  misc_feature 1..336: note = Synthetic polypeptide
  source 1..336: mol_type = other DNA

SEQ ID NO: 8990 - DNA, 126 bp, synthetic construct
  misc_feature 1..126: note = Synthetic polypeptide
  source 1..126: mol_type = other DNA
ggctgggcacagtggctcatgcctttaatcccagcccttgaggtcaggagttcgagaccgcaagccaacatgggtaatctacagttgctgcagaactgcctggcagtgttaaatggagacacataa

SEQ ID NO: 8991 - DNA, 263 bp, synthetic construct
  misc_feature 1..263: note = Synthetic polypeptide
  source 1..263: mol_type = other DNA
taggaggaagaacacatggtttctggtcatactctgtcaagaagtagatatgtaacatattgggcatttaacttaaaaattctaagtcatgttttctttttccactataagattgtactaggtgatataaagttcatgtcacttaaaattcaacgactgtttaccgagctgatacccagacataccagccttataacaaagactggattaaagagaagatctacgtgctccttcgtcggcaggcccaacaggctgggaaataa

SEQ ID NO: 8992 - DNA, 466 bp, synthetic construct
  misc_feature 1..466: note = Synthetic polypeptide
  source 1..466: mol_type = other DNA
tgaactttgcagttttcctcaactgtaaaatggggatgacagtgcatgagggtgttgtgaggatcaaatgaaataaagcatgactgaggctgatgtgaatccaaaggcctatccccttgccgatgcccacctcaccaagaagctactggacctcgttcagcagtcatgtaactataagcagcttcggaaaggagccaatgaggccaccaaaaccctcaacaggggcatctctgagttcatcgtgatggctgcagacgccgagccactggagatcattctgcacctgccgctgctgtgtgaagacaagaatgtgccctacgtgtttgtgcgctccaagcaggccctggggagagcctgtggggtctccaggcctgtcatcgcctgttctgtcaccatcaaagaaggctcgcagctgaaacagcagatccaatccattcagcagtccattgaaaggctcttagtctaa

SEQ ID NO: 8993 - DNA, 198 bp, synthetic construct
  misc_feature 1..198: note = Synthetic polypeptide
  source 1..198: mol_type = other DNA
aatatctccagttttcctttccagctcaggataggcttccacttcccagtctgctttggttaggtgtggccacatgccttgccttggccagtgaagtgaacagaagtgaggtgcatcacttcctggaagaagccataagaaccggcagccagatctgccagtgagcctcaggctttaggaactgaagagtgtttctga

SEQ ID NO: 8994 - DNA, 461 bp, synthetic construct
  misc_feature 1..461: note = Synthetic polypeptide
  source 1..461: mol_type = other DNA
gaggctgaggagggaggatcgcttgagctgaggagttcaaggctgcagtgagctatgatggtgccactgcacaccagcctagatttggactgagcaacaaatttgaatctgaattcccttcttcattaactggaaaagtagctcctgaagaatttaaagccagcatcaacagagttaacagttgtcttaagaagaaccttcctgttaatgtacgttggctactttgtggctgcctttgttgctgctgcacattaggttgcagtatgtggccagttatttgcctcagtaaaagaacacgaagatcgattgagaagttattagaatgggaaaacaataggttataccacaagctgtgcttgcattggagactgagcaaaaggaaatgtgaaacgaataacatgatggaatatgtcatcctcatagaatttttaccaaagacaccgatttttcgaccagattag

SEQ ID NO: 8995 - DNA, 404 bp, synthetic construct
  misc_feature 1..404: note = Synthetic polypeptide
  source 1..404: mol_type = other DNA
gaggctgaggagggaggatcgcttgagctgaggagttcaaggctgcagtgagctatgatggtgccactgcacaccagcctagatttggactgagcaacaaatttgaatctgaattcccttcttcattaactggaaaagtagctcctgaagaatttaaagccagcatcaacagagttaacagttgtcttaagaagaaccttcctgttaatgtacgttggctactttgtggctgcctttgttgctgctgcacattaggttgcagtatgtggccagttatttgcctcagtaaaagactgtgcttgcattggagactgagcaaaaggaaatgtgaaacgaataacatgatggaatatgtcatcctcatagaatttttaccaaagacaccgatttttcgaccagattag

SEQ ID NO: 8996 - DNA, 377 bp, synthetic construct
  misc_feature 1..377: note = Synthetic polypeptide
  source 1..377: mol_type = other DNA
gaggctgaggagggaggatcgcttgagctgaggagttcaaggctgcagtgagctatgatggtgccactgcacaccagcctagatttggactgagcaacaaatttgaatctgaattcccttcttcattaactggaaaagtagctcctgaagaatttaaagccagcatcaacagagttaacagttgtcttaagaagaaccttcctgttaatacacgaagatcgattgagaagttattagaatgggaaaacaataggttataccacaagctgtgcttgcattggagactgagcaaaaggaaatgtgaaacgaataacatgatggaatatgtcatcctcatagaatttttaccaaagacaccgatttttcgaccagattag

SEQ ID NO: 8997 - DNA, 1583 bp, synthetic construct; identical to SEQ ID NO: 828
  misc_feature 1..1583: note = Synthetic polypeptide
  source 1..1583: mol_type = other DNA

SEQ ID NO: 8998 - DNA, 1421 bp, synthetic construct; identical to SEQ ID NO: 829
  misc_feature 1..1421: note = Synthetic polypeptide
  source 1..1421: mol_type = other DNA

SEQ ID NO: 8999 - DNA, 1912 bp, synthetic construct
  misc_feature 1..1912: note = Synthetic polypeptide
  source 1..1912: mol_type = other DNA
ttaaaaaaatgccaggcctccaccattccacacccccacccccaggatcagtcgaaaaccaggaggaaattctccctacaatgaaaaggtaggcaagaggaccccagcatcccccatcaacaccacctcagatagctacagtccactggggtctcctgcagtcctcacagacactaagcctgccggagggagctatctacctagagtccacacggctgtactccccctagaaagagctgacactgtgccttgcccctgtggcccatgcagctactgccctatgtcattttgaaaagggaactaatgctggagaatattgctctggcggtgagtagccacagcaccccttatccctgagcctaaactacaattaaaccacccatacctgatggctcagcatccccaaaccaagcttcaggcaactgtcacactcttcttggtggtaccaagcagtgatgaaactgctccacctacccccgcatccccaaactggctacctcaggcaagaggtgaagctgcacactcccgcctggaaaatgatgctttgacagaacagcttcatctacctctgtcaacagtggctgcaccctgcctctagggcctaaactaaaactacacattatctgccagggacatagtgctttgatggagccctacataacagaaaaatggtgcctgggctgcctagaacactcaaggccccagggcctgagctgaaatggcacttcgtcccctggggaattggtgtctttgtcaagctgagcagctgtgtagtccaaaactgagctggtatagcactctgcattgcagggaaacagagcaatgactgagctgagacacctcaccctacaggccaaacaactctagtaatggaactggattacttccctagagtctgagctgctgagacacccctctccctggagagtacagtcattgctgtgcttttccctgtctcctaaggccaaaataacagctttgcttggcccttctggggtacttgctgccagtgcatctggcttcacagagtcagggatactaccaagccctaccatccccagagtatagaatcaccactatatggtgtttcatccccagggagctgagttgtcactgaaccttattggttcaggctcctgcatggcagctgtagctgacagtgacactgatggtgctgagctccccactggctttggctggggacacccgaccacgtttcttgcagcaggataagtatgagtgtcatttcttcaacgggacggagcgggtgcggttcctgcacagagacatctataaccaagaggaggacttgcgcttcgacagcgacgtgggggagtaccgggcggtgacggagctggggcggcctgacgctgagtactggaacagccagaaggacttcctggaagacaggcgcgccgcggtggacacctactgcagacacaactacggggttggtgagagcttcacagtgcagcggcgagttgagcctaaggtgactgtgtatcctgcaaggacccagaccctgcagcaccacaacctcctggtctgctctgtgaatggtttctatccaggcagcattgaagtcaggtggttccggaacagccaggaagagaaggctggggtggtgtccacaggcctgattcagaatggagactggaccttccagaccctggtgatgctggaaacagttcctcgaagtggagaggtttacacctgccaagtggagcacccaagcgtgacgagccctctcacagtggaatggagagcacagtctgaatctgcacagagcaagatgctgagtggagtcgggggctttgtgctgggcctgctcttccttggggccgggctattcatctacttcaagaatcagaaagggcactctggacttcacccaacaggactcgtgagctga

SEQ ID NO: 9000 - DNA, 578 bp, synthetic construct
  misc_feature 1..578: note = Synthetic polypeptide
  source 1..578: mol_type = other DNA
ggccggcgcggtggctcacacctgtaatcccagcactttgggaggccgagaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatga

SEQ ID NO: 9001 - DNA, 590 bp, synthetic construct
  misc_feature 1..590: note = Synthetic polypeptide
  source 1..590: mol_type = other DNA
ggccggcgcggtggctcacacctgtaatcccagcactttgggaggccgagaaggagcttcaagagcagggggagatcagaatcgtccagctgggcttcgacttggatgcccatggaattatcttcactgaggactacaggaccagagtatgtgactgtgtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatga

SEQ ID NO: 9002 - DNA, 130 bp, synthetic construct
  misc_feature 1..130: note = Synthetic polypeptide
  source 1..130: mol_type = other DNA
ggccggcgcggtggctcacacctgtaatcccagcactttgggaggccgagaaggagcttcaagagcagggggagatcagaatcgtccagctgggcttcgacttggatgcccatggaattatcttcactga

SEQ ID NO: 9003 - DNA, 67 bp, synthetic construct
  misc_feature 1..67: note = Synthetic polypeptide
  source 1..67: mol_type = other DNA
ccaggtgcggtggttcacgcctgtaatcccagcactttgggaggcccagactgagcaagtggagtag

SEQ ID NO: 9004 - DNA, 427 bp, synthetic construct; identical to SEQ ID NO: 573
  misc_feature 1..427: note = Synthetic polypeptide
  source 1..427: mol_type = other DNA

SEQ ID NO: 9005 - DNA, 74 bp, synthetic construct; identical to SEQ ID NO: 7010
  misc_feature 1..74: note = Synthetic polypeptide
  source 1..74: mol_type = other DNA

SEQ ID NO: 9006 - DNA, 952 bp, synthetic construct; identical to SEQ ID NO: 8583
  misc_feature 1..952: note = Synthetic polypeptide
  source 1..952: mol_type = other DNA

SEQ ID NO: 9007 - DNA, 87 bp, synthetic construct; identical to SEQ ID NO: 8584
  misc_feature 1..87: note = Synthetic polypeptide
  source 1..87: mol_type = other DNA

SEQ ID NO: 9008 - DNA, 396 bp, synthetic construct
  misc_feature 1..396: note = Synthetic polypeptide
  source 1..396: mol_type = other DNA
agggacatcagggatgaggatgaaggagggagggcactggagcctaagagaatcagctccaatatcgcttctgccccttccagacagtgtgactctgggcaagtagcttgccttctctgggctgcaacttctttccaccattgcaagaggcggcagcgtgagagggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtgacgactacgatgacacagacgatgacgaccctttcaaccctcagcaggaatccaagcgctttgtgcagtggcagtcgtctatctga

SEQ ID NO: 9009 - DNA, 393 bp, synthetic construct
  misc_feature 1..393: note = Synthetic polypeptide
  source 1..393: mol_type = other DNA
agggacatcagggatgaggatgaaggagggagggcactggagcctaagagaatcagctccaatatcgcttctgccccttccagacagtgtgactctgggcaagtagcttgccttctctgggctgcaacttctttccaccattgcaagaggcggcagcgtgagagggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtgacgactacgatgacacagacgatgacgaccctttcaaccctcaggaatccaagcgctttgtgcagtggcagtcgtctatctga

SEQ ID NO: 9010 - DNA, 311 bp, synthetic construct
  misc_feature 1..311: note = Synthetic polypeptide
  source 1..311: mol_type = other DNA
agggacatcagggatgaggatgaaggagggagggcactggagcctaagagaatcagctccaatatcgcttctgccccttccagacagtgtgactctgggcaagtagcttgccttctctgggctgcaacttctttccaccattgcaagaggcggcagcgtgagagggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtga

SEQ ID NO: 9011 - DNA, 423 bp, synthetic construct
  misc_feature 1..423: note = Synthetic polypeptide
  source 1..423: mol_type = other DNA
agggacatcagggatgaggatgaaggagggagggcactggagcctaagagaatcagctccaatatcgcttctgccccttccagacagtgtgactctgggcaagtagcttgccttctctgggctgcaacttctttccaccattgcaagaggcggcagcgtgagagggactatggtgcagccctgcggggcctgtgcgaagacgccctggaaggcctgctcttcctgctactcttctccctgctgtctgcaggagcgctggccactgccctctgcagcctgccccgagcctgggccctcttcccacccaggaatccaagcgctttgtgcagtggcagtcgtctatctgagcccctcctcccggctggactggagcctggctcccctcttcgttccttccctggctgccggaggagaccccactaa

SEQ ID NO: 9012 - DNA, 1012 bp, synthetic construct
  misc_feature 1..1012: note = Synthetic polypeptide
  source 1..1012: mol_type = other DNA
gttcctggcttacagctcttataacccatgtaatttcctaagggactagagcaataatagtatgttttgttaaaatatttgaccttttgtccttggtttctgaaacagctccagaacagctccagagtgataaaggtaccccaagaagctagtgcagacttattcagtgtttccctaccaggacgagatgagcgacgtagtggttcagccctacaattcactcctgacactcaagaggctgacgcagaacgcagattgtgtggtggtgctggacaacacagccctgaaccggattgccacagaccgcctgcacatccagaacccgtccttctcccagatcaaccagctggtgtccaccatcatgtcggccagcaccaccaccctgcgctaccccggctacatgaacaatgacctcatcggcctcatcgcctcgctcattcccaccccacggctccacttcctcatgaccggctacaccccgctcactacagaccagtcagtggccagcgtgaggaagaccacggtcctggatgtcatgaggcggctgctgcagcccaagaacgtgatggtgtccacaggccgagaccgccagaccaaccactgctacatcgccatcctcaacatcatccagggagaggtggaccccacccaggtccacaagagcctgcagaggatccgggaacggaagttggccaacttcatcccgtggggccccgccagcatccaggtggccctgtcgaggaagtctccctacctgccctcggcccaccgggtcagcgggctcatgatggccaaccacaccagcatctcctcgctctttgaaagttcctgccagcagtttgacaagctgcggaagcgggatgccttcctcgagcagttccgtaaggaggacatgttcaaggacaactttgatgagatggacaggtctagggaggttgttcaggagctcattgatgagtaccatgcggccacccagccagactacatttcctggggcacccaggagcagtga

SEQ ID NO: 9013 - DNA, 363 bp, synthetic construct; identical to SEQ ID NO: 7059
  misc_feature 1..363: note = Synthetic polypeptide
  source 1..363: mol_type = other DNA

SEQ ID NO: 9014 - DNA, 465 bp, synthetic construct; identical to SEQ ID NO: 7060
  misc_feature 1..465: note = Synthetic polypeptide
  source 1..465: mol_type = other DNA

SEQ ID NO: 9015 - DNA, 2104 bp, synthetic construct
  misc_feature 1..2104: note = Synthetic polypeptide
  source 1..2104: mol_type = other DNA
agtggagtgggctggttgtggagagagtgagcccctcgtcacaagaggcatgcaagcaggagtgggggccacgagggacatcggctcggcgctcacacgcatgtgcatgcgccaccgcagcatcgagaccaagctgcggcagttcaccaacgcactgctggagagcctcatcaacccgctgcaggagcgcatcgaggactggaagaaggcggccaaccagctggacaaggaccacgcgaaagagtacaaacgagcccggcatgagatcaaaaagaagtcgtcggacacgctgaagctgcagaagaaggcgcgcaaagagctacttgggaaaggagacctgcagccccagctggacagtgccctgcaggacgtcaacgacatgtacctgctgctggaggagacggagaagcaggccgtgcgccgggcgctgatcgaggagcggggccgcttctgcaccttcatcaccttcctgcagcctgtggtgaatggagagctgaccatgctgggagagatcacccacctgcagggcatcatcgacgacttggtggtgctgacagcagaaccccacaaactgcctcccgccagcgagcaggtaatcaaagacctaaagggctcggactacagctggtcctaccagaccccaccctcatcacccagcagctccagctcccggaagtccagcatgtgcagtgcccccagcagcagtagcagtgccaagggtggcggagccccatggcctgggggtgcccaaacatactcacccagttccacctgtcgctaccgcagcctggcgcagccagccaccaccaccgctcgcctctccagcgtttcctcccatgactctggcttcgtctcccaggacgccacctactccaagcccccctcgcctatgccttcagacatcaccagccagaagtcctccagctctgcatcttccgaggcctcggaaacctgccagtccgttagcgagtgcagctcccccacctcggactggtccaaggtcggctcccatgagcagccctcaggcgccactctgcagcggaggaaggaccgagtggagctcctgcgagacacagagccaggccctgccagtgggggcaccctgggccccagcggggaagaggcaccgcgaccccggatgtcccctgccaccatcgcagccaagcacggtgaggaggtgtcccccgccgccagtgacctggccatggtgctgacgcggggcctgagcctggagcaccagaagagcagccgggactcgctgcagtactccagcggctacagcacgcagaccaccacgccctcctgctctgaggacaccatcccctcccaaggctccgactacgactgctactccgtgaatggggatgcggacagcgagggcccgcccgagtttgacaagtcatccaccatcccgcgcaacagcaacatcgcccagaactaccgccgcctgatccagaccaagcgcccagcctccactgctgggctgcccaccgcggggctgcccacggccactggcctgccctcgggcgcaccccccggcgtggccaccatccgccgcacaccctccaccaagcccaccgtgcgccgcgccctgtccagcgctggccccatccccatccggccgcccatcgtccctgtgaagacgcccacggtgcctgactcccccggctacatggggcccacacgggcgggcagtgaggagtgcgtcttctataccgacgagaccgcctcacccctggcaccggacctcgccaaggcctccccaaagaggctcagcctgcccaacacagcctggggcagcccatccccagaggcagccgggtaccccggggcaggggccgaggacgagcagcagcagctggcggccaaccggcacagcctggtggagaagctgggggagctggtggcgggtgcccacgcactgggtgagggccagttccccttccccactgctctgtcggccacccccacggaggagacgcccaccccacccccagccgccaccagcgaccccccggccgaagacatgctggtggccatccggcgtggggtccggctccgcaggaccgtcaccaacgacaggtcggcgccccgcatcttatga

SEQ ID NO: 9016 - DNA, 365 bp, synthetic construct; identical to SEQ ID NO: 7364
  misc_feature 1..365: note = Synthetic polypeptide
  source 1..365: mol_type = other DNA

SEQ ID NO: 9017 - DNA, 664 bp, synthetic construct
  misc_feature 1..664: note = Synthetic polypeptide
  source 1..664: mol_type = other DNA
ggtgcggaggctcatgcctgtaatcccagcactctgggaggccaaggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccgcccccacctgagttctatccaggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgagccagccgccgccacctccctactacccaccggaagataagaagacccagtag

SEQ ID NO: 9018 - DNA, 574 bp, synthetic construct
  misc_feature 1..574: note = Synthetic polypeptide
  source 1..574: mol_type = other DNA
ggtgcggaggctcatgcctgtaatcccagcactctgggaggccaaggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccgcccccacctgagttctatccaggaccccccatgatggacggggccatgggatacgtgcagcccccaccaccgccctaccctgggcccatggaacctccggtcagcggccccgatgtcccctccactcctgcagagccagccgccgccacctccctactacccaccggaagataa

SEQ ID NO: 9019 - DNA, 652 bp, synthetic construct
  misc_feature 1..652: note = Synthetic polypeptide
  source 1..652: mol_type = other DNA
ggtgcggaggctcatgcctgtaatcccagcactctgggaggccaaggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccgcccccacctggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgagccagccgccgccacctccctactacccaccggaagataagaagacccagtag

SEQ ID NO: 9020 - DNA, 529 bp, synthetic construct
  misc_feature 1..529: note = Synthetic polypeptide
  source 1..529: mol_type = other DNA
ggtgcggaggctcatgcctgtaatcccagcactctgggaggccaaggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagagttctatccaggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgagccagccgccgccacctccctactacccaccggaagataagaagacccagtag

SEQ ID NO: 9021 - DNA, 445 bp, synthetic construct
  misc_feature 1..445: note = Synthetic polypeptide
  source 1..445: mol_type = other DNA
ggtgcggaggctcatgcctgtaatcccagcactctgggaggccaaggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccgcccccacctgagttctatccaggaccccccatgatggacggggcc

SEQ ID NO: 9022 - DNA, 857 bp, synthetic construct
  misc_feature 1..857: note = Synthetic polypeptide
  source 1..857: mol_type = other DNA
gtctgggcgcaaagcacaggctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgagaaaccagcctggacaccaagtctgtgtcagaaggccacctcaagaggaacatcgtggtgaagaccgtggagatgcgggatggagaggtcattaaggagtccaagcaggagcacaaggatgtgatgtga

SEQ ID NO: 9023 - DNA, 854 bp, synthetic construct
  misc_feature 1..854: note = Synthetic polypeptide
  source 1..854: mol_type = other DNA
gtctgggcgcaaagcacaggctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgagggggcaaaagcaccaaagacggggaaaatcacaaggtcacaagatatctcaaaagcctcacaatacgagttataccaatacaggctcaccagattgtaaatggaacgccgccggctcgcggttag

SEQ ID NO: 9024 - DNA, 875 bp, synthetic construct
  misc_feature 1..875: note = Synthetic polypeptide
  source 1..875: mol_type = other DNA
gtctgggcgcaaagcacaggctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgaggtcagtacagcagggcctcgtgggaagggcactggagtcctgccccctcctccagggcctgtaggttgctccagactgggactgaggatcagggcaaagggatccagctctccctgggggccttcgtgacactgcagcgctcctag

SEQ ID NO: 9025 - DNA, 302 bp, synthetic construct
  misc_feature 1..302: note = Synthetic polypeptide
  source 1..302: mol_type = other DNA
gtctgggcgcaaagcacaggctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggagtaccaggacctgctcaatgtcaagctggccctggacatcgagatcgccacctacaggaagctgctagagggcgaggagaaccggatcaccattcccgtgcagaccttctccaacctgcagatt

SEQ ID NO: 9026 - DNA, 343 bp, synthetic construct
  misc_feature 1..343: note = Synthetic polypeptide
  source 1..343: mol_type = other DNA
gtctgggcgcaaagcacaggctccaggatgaaaccaacctgaggctggaagccgagaacaacctggctgcctatagacaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctg

SEQ ID NO: 9027 - DNA, 105 bp, synthetic construct
  misc_feature 1..105: note = Synthetic polypeptide
  source 1..105: mol_type = other DNA
gtctgggcgcaaagcacaggctccaggatgaaaccaacctgaggctggaagccgagaacaacctggctgcctatagacaggaagcagatgaagccaccctggccc

SEQ ID NO: 9028 - DNA, 1579 bp, synthetic construct
  misc_feature 1..1579: note = Synthetic polypeptide
  source 1..1579: mol_type = other DNA
cagcagacccctgaataacatccttctgttataacgttgatgaggaaaaaaaattgtttccctgctgggatcaccgtctgtgtggcatttgcatgtcctccccatgtcttcctgggttttctccaggtaccccggtcagtttcctcccacatcccgaagatatgcatgttaggcaaactgctgtgtctatgtagtcccagtgtgaacgattgtgggtgtgggtgagtctgctctgcgatgtgatggcgtcctgtccagggctggttactgcctcgagccctgagctgccgggacaggctctggccactgaactctaaactggaataagcaggtggactcccattattgtcccagttgtttagaaaatatgccatcggctgaagccaaactaaaaaagaatagatgtgccaattgttttgactgtcctggctgcatgcacaccctctctactcgggccacgagcatctccacacagcttccagatgacccagccaagaccaccatgaagaaagcctattacctggcatgtggattttgtcgctggacgtctagagatgtgggcatggcagacaaatctgtagctagtggcggttggcaggaacctgaaaatcctcacacacaacggatgaacaaattgattgaatattaccagcagcttgctcagaaagagaaggttgagcgagatcgcaagaaactggcacgacgtagaaactatatgcctctggctttttcggacaaatatggtcttggaaccaggcttcagcgaccacgagctggtgcatccatcagtacccttgccggactttcccttaaagaaggagaggatcagaaagagataaagattgagccagctcaggctgtggatgaagtggaacctctacctgaagactattatacaagaccagtaaatttaacagaggtaacaacccttcagcagcgtctgttacagcctgacttccagccagtctgtgcttcacagctctatcctcgccacaaacatcttctgatcaaacggtccctgcgctgccgtaaatgtgaacataatttgagcaagccagaatttaacccaacgtcaatcaaattcaaaatccagctggtcgctgtcaattatattccagaagtgagaatcatgtcaattcccaaccttcgctacatgaaggagagccaggtcctcctgactcttacaaatccagttgagaacctcacccatgtgactctcttcgagtgtgaggagggggaccctgatgatatcaacagcactgctaaggtggtggtgcctcccaaagagctcgttttagctggcaaggatgcagcagcagagtacgatgagttggcagaacctcaagactttcaggacgatcctgacattatagccttcagaaaggccaacaaagtgggtattttcatcaaagttacaccacagcgtgaggagggtgaagtgaccgtgtgcttcaagatgaagcatgattttaaaaacctggcagcccccattcgccccattgaagaaagtgaccagggaacagaagtcatctggctcacccagcatgtggaacttagcttgggcccacttcttccttaa

SEQ ID NO: 9029 - DNA, 1600 bp, synthetic construct
  misc_feature 1..1600: note = Synthetic polypeptide
  source 1..1600: mol_type = other DNA
cagcagacccctgaataacatccttctgttataacgttgatgaggaaaaaaaattgtttccctgctgggatcaccgtctgtgtggcatttgcatgtcctccccatgtcttcctgggttttctccaggtaccccggtcagtttcctcccacatcccgaagatatgcatgttaggcaaactgctgtgtctatgtagtcccagtgtgaacgattgtgggtgtgggtgagtctgctctgcgatgtgatggcgtcctgtccagggctggttactgcctcgagccctgagctgccgggacaggctctggccactgaactctaaactggaataagcaggtggactcccattattgtcccagttgtttagaaaatatgccatcggctgaagccaaactaaaaaagaatagatgtgccaattgttttgactgtcctggctgcatgcacaccctctctactcgggccacgagcatctccacacagcttccagatgacccagccaagaccaccatgaagaaagcctattacctggcatgtggattttgtcgctggacgtctagagatgtgggcatggcagacaaatctgtagctagtggcggttggcaggaacctgaaaatcctcacacacaacggatgaacaaattgattgaatattaccagcagcttgctcagaaagagaaggttgagcgagatcgcaagaaactggcacgacgtagaaactatatgcctctggctttttcgcaacatactattcatgtagtggacaaatatggtcttggaaccaggcttcagcgaccacgagctggtgcatccatcagtacccttgccggactttcccttaaagaaggagaggatcagaaagagataaagattgagccagctcaggctgtggatgaagtggaacctctacctgaagactattatacaagaccagtaaatttaacagaggtaacaacccttcagcagcgtctgttacagcctgacttccagccagtctgtgcttcacagctctatcctcgccacaaacatcttctgatcaaacggtccctgcgctgccgtaaatgtgaacataatttgagcaagccagaatttaacccaacgtcaatcaaattcaaaatccagctggtcgctgtcaattatattccagaagtgagaatcatgtcaattcccaaccttcgctacatgaaggagagccaggtcctcctgactcttacaaatccagttgagaacctcacccatgtgactctcttcgagtgtgaggagggggaccctgatgatatcaacagcactgctaaggtggtggtgcctcccaaagagctcgttttagctggcaaggatgcagcagcagagtacgatgagttggcagaacctcaagactttcaggacgatcctgacattatagccttcagaaaggccaacaaagtgggtattttcatcaaagttacaccacagcgtgaggagggtgaagtgaccgtgtgcttcaagatgaagcatgattttaaaaacctggcagcccccattcgccccattgaagaaagtgaccagggaacagaagtcatctggctcacccagcatgtggaacttagcttgggcccacttcttccttaa

SEQ ID NO: 9030 - DNA, 457 bp, synthetic construct
  misc_feature 1..457: note = Synthetic polypeptide
  source 1..457: mol_type = other DNA
cagcagacccctgaataacatccttctgttataacgttgatgaggaaaaaaaattgtttccctgctgggatcaccgtctgtgtggcatttgcatgtcctccccatgtcttcctgggttttctccaggtaccccggtcagtttcctcccacatcccgaagatatgcatgttaggcaaactgctgtgtctatgtagtcccagtgtgaacgattgtgggtgtgggtgagtctgctctgcgatgtgatggcgtcctgtccagggctggttactgcctcgagccctgagctgccgggacaggctctggccactgaactctaaactggaataagcaggtggactcccattattgtcccagttgtttagaaaatatgccatcggctgaagccaaactaaaaaagaatagactaggggaatgtattttgcggaggagaaccacagagatgtgccaattgttttga

SEQ ID NO: 9031 - DNA, 3055 bp, synthetic construct; identical to SEQ ID NO: 709
  misc_feature 1..3055: note = Synthetic polypeptide
  source 1..3055: mol_type = other DNA

SEQ ID NO: 9032 - DNA, 3058 bp, synthetic construct; identical to SEQ ID NO: 710
  misc_feature 1..3058: note = Synthetic polypeptide
  source 1..3058: mol_type = other DNA

SEQ ID NO: 9033 - DNA, 525 bp, synthetic construct
  misc_feature 1..525: note = Synthetic polypeptide
  source 1..525: mol_type = other DNA
ggccaggtgcagtggttcatgcctgcaatcccagcacttttggaggccaagcaatttgagaactggcgagagaaccagccggacaatttcttcgcgggtggcgaggactgtgtggtgatggtggcgcatgaaagcgggcgctggaacgatgtcccctgcaactacaacctaccctatgtctgcaagaagggcacagtgctctgtggtccccctccggcagtggagaatgcctcactcatcggtgcccgcaaggccaagtacaatgtccatgccactgtaaggtaccagtgcaatgaaggatttgcccagcaccatgtggccaccattcgatgccggagcaatggcaagtgggacaggccccaaattgtctgcaccaaacccagacgttcacatcggatgcggcgacaccaccaccaccaccaacaccaccaccagcatcaccaccacaaatcccgcaaggagcgcagaaaacacaagaaacacccaacggaggactgggagaaggacgaagggaatttctgctga

SEQ ID NO: 9034 - DNA, 342 bp, synthetic construct
  misc_feature 1..342: note = Synthetic polypeptide
  source 1..342: mol_type = other DNA
ggccaggtgcagtggttcatgcctgcaatcccagcacttttggaggccaagcaatttgagaactggcgagagaaccagccggacaatttcttcgcgggtggcgaggactgtgtggtgatggtggcgcatgaaagcgggcgctggaacgatgtcccctgcaactacaacctaccctatgtctgcaagaagggcacagccagacgttcacatcggatgcggcgacaccaccaccaccaccaacaccaccaccagcatcaccaccacaaatcccgcaaggagcgcagaaaacacaagaaacacccaacggaggactgggagaaggacgaagggaatttctgctga

SEQ ID NO: 9035 - DNA, 2287 bp, synthetic construct; identical to SEQ ID NO: 6799
  misc_feature 1..2287: note = Synthetic polypeptide
  source 1..2287: mol_type = other DNA

SEQ ID NO: 9036 - DNA, 2234 bp, synthetic construct; identical to SEQ ID NO: 6800
  misc_feature 1..2234: note = Synthetic polypeptide
  source 1..2234: mol_type = other DNA

SEQ ID NO: 9037 - DNA, 456 bp, synthetic construct
  misc_feature 1..456: note = Synthetic polypeptide
  source 1..456: mol_type = other DNA
cagcctacatgcgcaacggcggtggagtacaacatcttcgagggtatggagtgccacggctccccactagtggtcatcagccagggcaagatcgtctttgaagacggaaacatcaacgtcaacaagggcatgggccgcttcattccgcggaaggcgttcccggagcacctgtaccagcgcgtcaaaatcaggaataaggtttttggattgcaaggggtttccaggggcatgtatgacggtcctgtgtacgaggtaccagctacacccaaatatgcaactcccgctccttcagccaaatcttcgccttctaaacaccagcccccacccatcagaaacctccaccagtccaacttcagcttatcaggtgcccagatagatgacaacaatcccaggcgcaccggccaccgcatcgtggcgccccctggtggccgctccaacatcaccagcctcggttga

SEQ ID NO: 9038 - DNA, 3519 bp, synthetic construct
  misc_feature 1..3519: note = Synthetic polypeptide
  source 1..3519: mol_type = other DNA
gagcaacttccagtcctgcaagctccattcatggctcctgtgacgtttgatgacatcactgtgtacttactccaggaggaatgggtgctgctgagccagcaacagaaggagctctgtggttccaacaagctggtggcaccactgggaccaactgttgccaatcctgagctgttccgcaagttcggacgagggccagagccatggcttggcagcgtccagggccagaggagccttctggagcatcacccaggaaaaaaacagatgggctacatgggagaaatggaggtgcaaggtcccaccagggagagtggacagtccctcccgcctcagaagaaagcctacctttcccacctcagtacaggcagtggacacatcgagggagactgggccggaagaaacaggaaacttctgaagccccggtccatccagaagtcgtggtttgtgcagtttccgtggctgatcatgaatgaggagcagacggctctgttctgctctgcttgccgagaatacccctccatcagggacaaacggtcaagactaatagaaggttatacaggaccattcaaggtggagactctcaaataccacgcgaagagcaaggcccacatgttctgtgtcaatgccttggcagcgagggaccccatctgggcagcccggttccggagcatcagagacccacctggagatgttctggccagcccggagccgctcttcactgcagattgccccatattctaccccccagggcctctgggaggatttgatagcatggctgagctcctgccaagttcaagagctgaactagaggaccctgggggggatggagcaattcctgcaatgtatctagactgcatttcagatttgaggcaaaaagaaatcactgatggcatccacagctcctcagacattaatattttatataatgatgcagtagaatcctgcattcaggacccttctgcagaggggctgtcggaggaggttcctgtggtgtttgaggagctgccggtggtgttcgaggatgtggcagtgtatttcacccgggaggagtggggcatgctagacaagcggcagaaggagctgtacagagacgtgatgcggatgaactacgagctgttggcatccttgggacctgccgctgccaagccagacttgatctccaaactggagcggagggctgcaccctggatcaaggacccaaatgggccaaagtgggggaaaggtcgtcctccagggaacaagaagatggtggcagtgagagaggcagacacacaggcctcggctgcagactccgcgttgcttccaggctctcccgtggaggcccgtgcctcctgctgcagttccagcatttgtgaggaaggagatggacctaggagaatcaagaggacatacaggccccgttccattcagaggtcatggtttgggcagttcccatggttagtaattgaccccaaagagaccaaactcttctgctcagcctgcatagaaagacctaatctccatgataaatcatctcggttagtcagaggttacacggggccttttaaagtggagactttaaaataccatgaagtcagcaaagcgcacaggctctgtgtcaacacggttgaaatcaaggaagacacccctcacactgccctcgttccagagatctccagcgacctcatggccaacatggagcactttttcaatgccgcctactccattgcataccactcaaggcccctgaatgactttgagaagatcctgcagctcctccaaagcacggggaccgtgatattaggcaagtaccgcaatcgcacggcgtgcactcagttcatcaagtacatctcagagaccctgaagagggagatcctggaggacgtgcggaactcgccctgtgtgagcgtgctgctggacagctccaccgacgcctccgagcaggcctgcgtggggatttacatccgctacttcaagcagatggaggtgaaagagtcctacatcactctggcccctctctacagtgagacagcagatgggtacttcgagaccatcgtttctgccctggatgagctggacatccccttccggaagcctggctgggtggtggggctggggacggatggctcagccatgttgagctgcagaggaggccttgtggaaaagttccaggaggtcatcccgcagctgctgcctgtccactgcgtggcccaccggctgcacctggctgtggtggacgcctgcgggagcatcgatctggtgaagaagtgtgaccggcacatccgcaccgtcttcaagttttatcagtcctcaaacaagaggctgaacgagctgcaggaaggtgcggcgcctctggagcaggagatcatccgcctgaaggatctgaatgcggtccgctgggtggccagcaggaggcgcacgctgcacgcgctgctcgtgagctggcccgccctggccaggcacctccagagggtggcagaggctgggggccagattgggcaccgggccaaagggatgctgaagctcatgcgcggcttccactttgtcaagttctgccacttcctgttggacttcctgagcatctacaggcctctgtccgaggtgtgccagaaggagatcgtgctgattacagaggtgaacgccacgctgggccgcgcctacgtggcactggagagcctccgtcaccaggcagggcccaaagaggaagaattcaacgccagcttcaaggatgggcggctccacggcatctgcttggacaaactggaggtagcggaacagcggttccaggcggatagggagaggacagtcctgacggggattgagtacctccagcagaggtttgacgcagaccgacccccacagctgaagaacatggaggtgtttgacaccatggcctggccaagtgggattgaacttgccagttttgggaatgatgacattctcaacctggccaggtatttcgagtgctccctcccaacaggatacagtgaggaagctctgctggaggagtggctgggcctgaaaaccattgcccagcacctcccgttctccatgctctgcaaaaacgccctggcccagcactgccgcttccccctgctaagcaagctcatggccgtggtggtctgtgtgcccatctccacctcttgctgtgagcgggggttcaaggccatgaaccgaatcaggaccgatgagaggaccaagctctccaacgaggtgctcaacatgctcatgatgacagctgtgaacggcgtggccgtcacggagtacgacccccagcccgccatccagcactggtacctgacctcctcaggccggcgtttcagccatgtctacacctgtgcccaggtgccagcccgctcccctgcaagcgccaggctcaggaaggaggagatgggagccctctatgtggaggagcccaggacccagaagccacccatcctgccctccagggaagcagcggaggttctgaaggactgcatcatggagcctcccgagagactcctgtatccccacaccagccaggaggcccccgggatgtcctga

SEQ ID NO: 9039 - DNA, 2086 bp, synthetic construct
  misc_feature 1..2086: note = Synthetic polypeptide
  source 1..2086: mol_type = other DNA
aaagacagaacaaattcaaagtgagaaaatccagatctctttcctagttctgcccggcatttgctatatggccttgggcatgtcaattacccacctaggacttggtttctcctgtttaccatttgggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgagacactgaaagagttttaccaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaa

SEQ ID NO: 9040 - DNA, 2065 bp, synthetic construct
  misc_feature 1..2065: note = Synthetic polypeptide
  source 1..2065: mol_type = other DNA
aaagacagaacaaattcaaagtgagaaaatccagatctctttcctagttctgcccggcatttgctatatggccttgggcatgtcaattacccacctaggacttggtttctcctgtttaccatttgggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaa

SEQ ID NO: 9041 - DNA, 1875 bp, synthetic construct
  misc_feature 1..1875: note = Synthetic polypeptide
  source 1..1875: mol_type = other DNA
tttcttcaacaaacgaatgacattgaaaagggaggaggggccagtgcagatgctgacagaggctgccgagatgatgaggcaggtgtgctgtggggcctggtatggctgttggttcaaaccttccaactacaaaaagacgtctatgagaccatcaaggcacattgaagagggcctgattattgactgataagcaagagtgaccgactcctcatcaaaggtggacggatcatcaacgatgaccaatccctttatgctgacgtctacctggaggatggacttatcaaacaaataggagagaacttaatcgttcctggtggagtgaagaccattgaagccaacgggcggatggttattcccggaggtattgatgtcaacacgtacctgcagaagccctcccaggggatgactgcggctgatgacttcttccaagggaccagggcggcactggtgggcgggaccacgatgatcattgaccatgttgttcctgaacctgggtccagcctactgacctctttcgagaagtggcacgaagcagctgacaccaaatcctgctgtgattactccctccacgtggacatcacaagctggtacgatggcgttcgggaggagctggaggtgctggtgcaggacaaaggcgtcaattccttccaagtctacatggcctataaggatgtctaccaaatgtccgacagccagctctatgaagcctttaccttccttaagggcctgggagctgtgatcttggtccatgcagaaaatggagatttgatagctcaggaacaaaagcggatcctggagatgggcatcacgggtcccgagggccatgccctgagcagacctgaagagctggaggccgaggcggtgttccgggccatcaccattgcgggccggatcaactgccctgtgtacatcaccaaggtcatgagcaagagtgcagccgacatcatcgctctggccaggaagaaagggcccctagtttttggagagcccattgccgccagcctggggaccgatggcacccattactggagcaagaactgggccaaggctgcggcgttcgtgacttcccctcccctgagcccggaccctaccacgcccgactacttgacctccctactggcctgtggggacttgcaggtcacaggcagcggccactgtccctacagcactgcccagaaggcggtgggcaaggacaactttaccctgatccccgagggtgtcaacgggatagaggagcggatgacggtcgtctgggacaaggcggtggctactggcaaaatggatgagaaccagtttgtcgctgtcaccagcaccaatgcagccaagatctttaacctgtacccaaggaaagggcggattgccgtgggctcggatgccgacgtggtcatctgggaccccgacaagttgaagaccataacagccaaaagtcacaagtcggcggtggagtacaacatcttcgagggtatggagtgccacggctccccactagtggtcatcagccagggcaagatcgtctttgaagacggaaacatcaacgtcaacaagggcatgggccgcttcattccgcggaaggcgttcccggagcacctgtaccagcgcgtcaaaatcaggaataaggtttttggattgcaaggggtttccaggggcatgtatgacggtcctgtgtacgaggtaccagctacacccaaatatgcaactcccgctccttcagccaaatcttcgccttctaaacaccagcccccacccatcagaaacctccaccagtccaacttcagcttatcaggtgcccagatagatgacaacaatcccaggcgcaccggccaccgcatcgtggcgccccctggtggccgctccaacatcaccagcctcggttga

SEQ ID NO: 9042 - DNA, 23 bp, synthetic construct
  misc_feature 1..23: note = Synthetic polypeptide
  source 1..23: mol_type = other DNA
tcaagctccctcctgctgagtga

SEQ ID NO: 9043 - DNA, 1088 bp, synthetic construct
  misc_feature 1..1088: note = Synthetic polypeptide
  source 1..1088: mol_type = other DNA
ctgtgcttccaaatgctggtgctgtttgcacacttgtgtctttggccttcactggttctgcttagaatctcccttccatgggtatctacctgaccatctgctcctcttctttccagtcttccactcaacaggtacttcgttagagcaggcccccaggctgcccttacccatgccacaacagctacctacttccttgtgtcatcattgaagagcttgtctgtttgagttgtgatcgtgtttgtctgtctgccctcaccagcaaactgagctcccgtgaagtcagggccaggttcatctgtgcatcgtcagtggctgacaggacatggacatcttccagcaacagatctcgagaagacagctggctaaaatccttatttgtccggaaagttgatccaagaaaagatgcccactccaatctcctagccaaaaaggaaacaagcaatctatacaaattacagtttcacaatgttaaaccggaatgcctagaagcatacaacaaaatttgtcaagaggtgttgccaaagattcacgaagataaacactacccttgtactttggtggggacttggaacacgtggtatggcgagcaggaccaagctgtccacctctggaggtatgaaggaggctatccagccctcacagaagtcatgaataaactcagagaaaataaggaatttttggaatttcgtaaggcaagaagtgacatgcttctctccaggaagaatcagctcctgttggagttcagtttctggaatgagcctgtgccaagatccggacctaatatatatgaactcaggtcttaccaactccgaccaggaaccatgattgaatggggcaattactgggctcgtgcaatccgcttcagacaggatggtaacgaagccgtcggaggattcttctctcagattgggcagctgtacatggtgcaccatctttgggcttacagggatcttcagaccagggaagacatacggaatgcagcatggcacaaacatggctgggaggaattggtatattacacagttccacttattcaggaaatggaatccagaatcatgatcccactgaagacctcgcccctccagtaa

SEQ ID NO: 9044 - DNA, 971 bp, synthetic construct
  misc_feature 1..971: note = Synthetic polypeptide
  source 1..971: mol_type = other DNA
ctgtgcttccaaatgctggtgctgtttgcacacttgtgtctttggccttcactggttctgcttagaatctcccttccatgggtatctacctgaccatctgctcctcttctttccagtcttccactcaacaggtacttcgttagagcaggcccccaggctgcccttacccatgccacaacagctacctacttccttgtgtcatcattgaagagcttgtctgtttgagttgtgatcgtgtttgtctgtctgccctcaccagcaaactgagctcccgtgaagtcagggccaggttcatctgtgcatcgtcagtggctgacaggacatggacatcttccagcaacagatctcgagaagacagctggctaaaatccttatttgtccggaaagttgatccaagaaaagatgcccactccaatctcctagccaaaaaggaaacaagcaatctatacaaattacagttcaagaggtgttgccaaagattcacgaagataaacactacccttgtactttggtggggacttggaacacgtggtatggcgagcaggaccaagctggaatttttggaatttcgtaaggcaagaagtgacatgcttctctccaggaagaatcagctcctgttggagttcagtttctggaatgagcctgtgccaagatccggacctaatatatatgaactcaggtcttaccaactccgaccaggaaccatgattgaatggggcaattactgggctcgtgcaatccgcttcagacaggatggtaacgaagccgtcggaggattcttctctcagattgggcagctgtacatggtgcaccatctttgggcttacagggatcttcagaccagggaagacatacggaatgcagcatggcacaaacatggctgggaggaattggtatattacacagttccacttattcaggaaatggaatccagaatcatgatcccactgaagacctcgcccctccagtaa

SEQ ID NO: 9045 - DNA, 665 bp, synthetic construct
  misc_feature 1..665: note = Synthetic polypeptide
  source 1..665: mol_type = other DNA
ctgtgcttccaaatgctggtgctgtttgcacacttgtgtctttggccttcactggttctgcttagaatctcccttccatgggtatctacctgaccatctgctcctcttctttccagtcttccactcaacaggtacttcgttagagcaggcccccaggctgcccttacccatgccacaacagctacctacttccttgtgtcatcattgaagagcttgtctgtttgagttgtgatcgtgtttgtctgtctgccctcaccagcaaactgagctcccgtgaagtcagggccaggttcatctgtgcatcgtcagtggctgacaggacatggacatcttccagcaacagatctcgagaagacagctggctaaaatccttatttgtccggaaagttgatccaagaaaagatgcccactccaatctcctagccaaaaaggaaacaagcaatctatacaaattacagtttcacaatgttaaaccggaatgcctagaagcatacaacaaaatttgcagctccctgtttgcagaacataaagacttaactcctgcctggtttttaggggtcccaataatgggattctgcccaacccatccagttctgggtacaagtactgcctgccttacaatctccattcagtcaagaggtgttgccaaagattcacgaagataa

SEQ ID NO: 9046 - DNA, 820 bp, synthetic construct
  misc_feature 1..820: note = Synthetic polypeptide
  source 1..820: mol_type = other DNA
gaacagcatgcgtgttgactggattgttgctgacatcttggccatcaggcagaatgcgctaggacatgtgcgctacgtgctgaaagaagggttaaaatggctgccattgtatgggtgttactttgctcagcatggaggaatctatgtaaagcgcagtgccaaatttaacgagaaagagatgcgaaacaagttgcagagctacgtggacgcaggaactccaatgtatcttgtgatttttccagaaggtacaaggtataatccagagcaaacaaaagtcctttcagctagtcaggcatttgctgcccaacgtggccttgcagtattaaaacatgtgctaacaccacgaataaaggcaactcacgttgcttttgattgcatgaagaattatttagatgcaatttatgatgttacggtggtttatgaagggaaagacgatggagggcagcgaagagagtcaccgaccatgacggaatttctctgcaaagaatgtccaaaaattcatattcacattgatcgtatcgacaaaaaagatgtcccagaagaacaagaacatatgagaagatggctgcatgaacgtttcgaaatcaaagataagatgcttatagaattttatgagtcaccagatccagaaagaagaaaaagatttcctgggaaaagtgttaattccaaattaagtatcaagaagactttaccatcaatgttgatcttaagtggtttgactgcaggcatgcttatgaccgatgctggaaggaagctgtatgtgaacacctggatatatggaaccctacttggctgcctgtgggttactattaaagcatag

SEQ ID NO: 9047 - DNA, 62 bp, synthetic construct
  misc_feature 1..62: note = Synthetic polypeptide
  source 1..62: mol_type = other DNA
gaacagcatgcgtgttgactggattgttgctgacatcttggccatcaggcagaatgcgctag

SEQ ID NO: 9048 - DNA, 514 bp, synthetic construct
  misc_feature 1..514: note = Synthetic polypeptide
  source 1..514: mol_type = other DNA
gaccgggcacagtggctcgcgcctgtaatcccagcactttgggaggccaaggtaccacaatgtgggcatccttgtgctcttcctgcacgatatcagtgacgtgcagcttgagttcaccaagctcaacatttacttcaagtcccgcggcggctcctaccatcggctgcatgccttggcagcagacttgggctgcctcagcttcggcttcagctggttctggttccgcctctactggttcccgctcaaggtcctgtatgccaccagtcactgcagtctgcgcacggtgcctgacatccccttctacttcttcttcaatgcgctcctgctgctgctcacccttatgaacctctactggttcctgtacatcgtggcgtttgcagccaaggtgttgacaggccaggtgcacgagctgaaggacctgcgggagtatgacacagccgaggcccagagcctgaagcccagcaaagccgagaagccactgaggaacggcctggtgaaggacaagcgcttctga

SEQ ID NO: 9049 - DNA, 475 bp, synthetic construct
  misc_feature 1..475: note = Synthetic polypeptide
  source 1..475: mol_type = other DNA
gaccgggcacagtggctcgcgcctgtaatcccagcactttgggaggccaaggtaccacaatgtgggcatccttgtgctcttcctgcacgatatcagtgacgtgcagcttgagttcaccaagctcaacatttacttcaagtcccgcggcggctcctaccatcggctgcatgccttggcagcagacttgggctgcctcagcttcggcttcagctggttctggttccgcctctactggttcccgctcaaggtcctgtatgccaccagtcactgcagtctgcgcacggtgcctgacatccccttctacttcttcttcaatgcgctcctgctgctgctcacccttatgaacctctactggttcctgtacatcgtggcgtttgcagccaaggtgttgacaggccaggtgcacgagctgaaggacctgcgggagtatgacacagccgaggcccagagcctgaagcccagcaaagccgagtga

SEQ ID NO: 9050 - DNA, 553 bp, synthetic construct
  misc_feature 1..553: note = Synthetic polypeptide
  source 1..553: mol_type = other DNA
gaccgggcacagtggctcgcgcctgtaatcccagcactttgggaggccaaggtaccacaatgtgggcatccttgtgctcttcctgcacgatatcagtgacgtgcagcttgagttcaccaagctcaacatttacttcaagtcccgcggcggctcctaccatcggctgcatgccttggcagcagacttgggctgcctcagcttcggcttcagctggttctggttccgcctctactggttcccgctcaaggtcctgtatgccaccagtcactgcagtctgcgcacggtgcctgacatccccttctacttcttcttcaatgcgctcctgctgctgctcacccttatgaacctctactggttcctgtacatcgtggcgtttgcagccaaggtgttgacaggccaggtgcacgagctgaaggacctgcgggagtatgacacagccgaggcccagagcctgaagcccagcaaagccgaggaagcagtggctcagagctccgtgacgttttttggaacgggaggtgcgagatgcagacatttaacacatccggggctgtag

SEQ ID NO: 9051 - DNA, 213 bp, synthetic construct
  misc_feature 1..213: note = Synthetic polypeptide
  source 1..213: mol_type = other DNA
tgaagatttagtgaaacattgtggaaagctcccagcacagtacctggcacctggcagacaacagtgagctgggacggagacaagctccagtgtgtgcagaagggtgagaaggaggggcgtggctggacccagtggatcgagggtgatgagctgcacctggagatgagagtggaaggtgtggtctgcaagcaagtattcaagaaggtgcagtga

SEQ ID NO: 9052 - DNA, 853 bp, synthetic construct
  misc_feature 1..853: note = Synthetic polypeptide
  source 1..853: mol_type = other DNA
ttttacttaaaattttctttgttgttttttctcctacccattagaatgtaagttccataaagcccagtacaacatcagcgctctagtcacgattgccaccaagaccttcctccgttatgatcggctacgggctctcatcaccagtatccgccgcttctacccaacggttaccgtggtcatcgctgacgacagcgacaagccagagcgcgttagtggcccctacgtggaacactatctcatgcccttcggcaagggctggttcgcaggccggaacctggccgtgtctcaagtaaccaccaagtacgtgctgtgggtggacgacgacttcgtcttcacggcgcggacgcggctggagaggcttgtggacgtgctggagcggacgccgctggacctggtggggggcgcggtgcgcgagatctccggctttgccaccacttatcggcagctgctgagcgtggagcccggcgccccaggcctcgggaactgcctccggcaaaggcgcggcttccaccacgagctcgtcggcttcccaggctgcgtggtcaccgacggcgtggttaacttcttcctggcgcggactgacaaggtgcgcgaggtcggtttcgacccccgcctcagccgcgtggctcatctggaattcttcttggatgggcttggttcccttcgggttggctcctgctccgacgtcgtggtggatcatgcatccaaactgaagctgccttggacatcaagggatgccggagcagagacttacgcccggtaccgttacccaggatcactggacgagagccagatggccaaacaccggctgctcttcttcaaacaccggctgcagtgcatgacctcccagtga

SEQ ID NO: 9053 - DNA, 265 bp, synthetic construct
  misc_feature 1..265: note = Synthetic polypeptide
  source 1..265: mol_type = other DNA
ttttacttaaaattttctttgttgttttttctcctacccattagaatgtaagttccataaagcccagtacaacatcagcgctctagtcacgattgccaccaagaccttcctccgttatgatcggctacgggctctcatcaccagtatccgccgcttctacccaacggttaccgtggtcatcgctgacgacagcgacaagccagagcgcgttagtggcccctacgtggaacactatctcatgcccttcggcaaggtgtgcagctag

SEQ ID NO: 9054 - DNA, 393 bp, synthetic construct
  misc_feature 1..393: note = Synthetic polypeptide
  source 1..393: mol_type = other DNA
ggccgggcgcggtggctcacgcctgtaatcccagcactttggaaggccgaggagggcagatcacgaggtgtggggttagccaccagaaaactgggaaatttggccaaacccactgtgatcatcagcaagaaaggagatattataactatacgaactgaaagtacctttaaaaatacagaaatctccttcaagctaggccaggaatttgaagaaaccacagctgacaatagaaagaccaagagcatcgtaaccctgcagagaggatcactgaatcaagtgcagagatgggatggcaaagagacaaccataaagagaaagctagtgaatgggaaaatggtagcggaatgtaaaatgaagggcgtggtgtgcaccagaatctatgagaaggtctga

SEQ ID NO: 9055 - DNA, 304 bp, synthetic construct
  misc_feature 1..304: note = Synthetic polypeptide
  source 1..304: mol_type = other DNA
cttggggccacaagtttgagaccagcctgggcaacatagcaagatcttgtctctacaaaaaaaaatgtttaaagaatttttttaaattagcacccgtagctccagcttctcagaagattgagctatcatggtgaacttacttcagattgtgcgggaccactgggttcatgttcttgtccctatgggatttgtcattggatgttatttagacagaaagagtgatgaacggctaactgccttccggaacaagagtatgttatttaaaagggaattgcaacccagtgaagaagttacctggaagtaa

SEQ ID NO: 9056 - DNA, 89 bp, synthetic construct
  misc_feature 1..89: note = Synthetic polypeptide
  source 1..89: mol_type = other DNA
aagccgaggcagggtgatcacgaggtcaggagttcaagaccagcctggcaaacatgacgtgcctgcttccccttcgccttctgccgtga

SEQ ID NO: 9057 - DNA, 267 bp, synthetic construct
  misc_feature 1..267: note = Synthetic polypeptide
  source 1..267: mol_type = other DNA
aagccgaggcagggtgatcacgaggtcaggagttcaagaccagcctggcaaacatgacgtgcctgcttccccttcgccttctgccgtgattgtcagtttcctgaggcctccccagccacgcttcctgtacagcctgcagaactctgccccagagcacatcagctatgtgccccagctctcaaacgacaccttggcggggaggctcaccctgtccaccttcacgctggagcagcctctaggccagttcagcagccacaacatctctga

SEQ ID NO: 9058 - DNA, 739 bp, synthetic construct
  misc_feature 1..739: note = Synthetic polypeptide
  source 1..739: mol_type = other DNA
aagccgaggcagggtgatcacgaggtcaggagttcaagaccagcctggcaaacatgacgtgcctgcttccccttcgccttctgccgtgattgtcagtttcctgaggcctccccagccacgcttcctgtacagcctgcagaacttctggcatggaaaagcccctgtgcaactggtaaagatatcaataagcaccaggaggtatctaaatccaccaggagccataggcatcacgttgacatccatttaccagtcttccctggcaagattcttctgaattgtgctgccttggccaaaagagctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaacaaagtggtccagcgacactcgcc

SEQ ID NO: 9059 - DNA, 460 bp, synthetic construct
  misc_feature 1..460: note = Synthetic polypeptide
  source 1..460: mol_type = other DNA
aagccgaggcagggtgatcacgaggtcaggagttcaagaccagcctggcaaacatgacgtgcctgcttccccttcgccttctgccgtgattgtcagtttcctgaggcctccccagccacgcttcctgtacagcctgcagaacttctggcatggaaaagcccctgtgcaactggtaaagatatcaataagcaccaggaggtatctaaatccaccaggagccataggcatcacgttgacatccatttaccagtcttccctggcaagattcttctgaattgtgctgccttggccaaaagagctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacg

SEQ ID NO: 9060 - DNA, 147 bp, synthetic construct
  misc_feature 1..147: note = Synthetic polypeptide
  source 1..147: mol_type = other DNA
aagccgaggcagggtgatcacgaggtcaggagttcaagaccagcctggcaaacatgacgtgcctgcttccccttcgccttctgccgtgattgtcagtttcctgaggcctccccagccacgcttcctgtacagcctgcagaactatga

SEQ ID NO: 9061 - DNA, 147 bp, synthetic construct
  misc_feature 1..147: note = Synthetic polypeptide
  source 1..147: mol_type = other DNA
aagccgaggcagggtgatcacgaggtcaggagttcaagaccagcctggcaaacatgacgtgcctgcttccccttcgccttctgccgtgattgtcagtttcctgaggcctccccagccacgcttcctgtacagcctgcagaactgtga

SEQ ID NO: 9062 - DNA, 113 bp, synthetic construct
  misc_feature 1..113: note = Synthetic polypeptide
  source 1..113: mol_type = other DNA
ggttgggcgcagtggcccacgcctgtaaccccagcactttgggaggccaaggcaggaggatcatttgagcccaggagtttgagaccagcctggccaatatggacaagcactga

SEQ ID NO: 9063 - DNA, 985 bp, synthetic construct
  misc_feature 1..985: note = Synthetic polypeptide
  source 1..985: mol_type = other DNA
tcctagggctgttctaaagtcggtgctgctgggcattgtgatcctgcttgcttaccgcctggagttcacggacaccttccctgtgcacacccagggattcttctgctatgacagtacctacgccaagccctacccagggcctgaggctgccagccgagtgcctcctgctcttgtctacgcactggtcactgccgggcccaccctcacgatcctgctgggagagctggcgcgtgcctttttccctgcaccaccttcagccgtcccagtcatcggggagagcaccatcgtgtctggggcctgctgccgcttcagccccccagtgcggaggctggtccgcttcctgggggtctactccttcggcctcttcaccacgaccatcttcgccaacgcggggcaggtggtgaccggcaatcccacgccacacttcctgtccgtgtgccgccccaactacacggccctgggctgcctgccaccttctccggatcggccaggtcccgaccgctttgtcactgaccagggtgcctgcgctggcagtcccagcctcgtggccgccgcgcgccgcgccttcccctgcaaggatgcggccctctgcgcctacgcggtcacctacacagcgatgtacgtgactctcgtgttccgcgtgaagggctcccgcctggtcaaaccctcgctctgcctggccttgctgtgcccggccttcctggtgggcgtggtccgcgtggccgagtaccgaaaccactggtcggacgtgctggctggcttcctgacaggggcggccatcgccacctttttggtcacctgcgttgtgcataactttcagagccggccaccctctggccgaaggctctctccctgggaggacctgggccaagcccccaccatggatagccccctcgaaaagaacccgaggtctgcaggccgcattcgacaccggcacggctcaccccatccaagtcgcagaactgcgcccgccgtggccacctga

SEQ ID NO: 9064 - DNA, 207 bp, synthetic construct
  misc_feature 1..207: note = Synthetic polypeptide
  source 1..207: mol_type = other DNA
tcctagggctgttctaaagtcggtgctgctgggcattgtgatcctgcttgcttaccgcctggagttcacggacaccttccctgtgcacacccagggattcttctgctatgacagtacctacgccaagccctacccagggcctgaggctgccagccgagtgcctcctgctcttgtctacgcactggtcactgccgggcccaccctcac

SEQ ID NO: 9065 - DNA, 1672 bp, synthetic construct
  misc_feature 1..1672: note = Synthetic polypeptide
  source 1..1672: mol_type = other DNA
tcctccaccagatgccccctccaccgttcccatcatgcaccaagtcagtgccactatgaggagcatcaccttgtcatggccacagccggagcagcccaatggcatcatcctggactatgagatccggtactatgagaaggaacacaatgagttcaactcctccatggccaggagtcagaccaacacagcaaggattgatgggctgcggcctggcatggtatatgtggtacaggtgcgtgcccgcactgttgctggctacggcaagttcagtggcaagatgtgcttccagactctgactgacgatgattacaagtcagagctgagggagcagctgcccctgattgctggctcggcagcggccggggtcgtgttcgttgtgtccttggtggccatctctatcgtctgtagcaggaaacgggcttatagcaaagaggctgtgtacagcgataagctccagcattacagcacaggccgaggctccccagggatgaagatctacattgaccccttcacttacgaggatcccaacgaagctgtccgggagtttgccaaggagattgatgtatcttttgtgaaaattgaagaggtcatcggagcaggggagtttggagaagtgtacaaggggcgtttgaaactgccaggcaagagggaaatctacgtggccatcaagaccctgaaggcagggtactcggagaagcagcgtcgggactttctgagtgaggcgagcatcatgggccagttcgaccatcctaacatcattcgcctggagggtgtggtcaccaagagtcggcctgtcatgatcatcacagagttcatggagaatggtgcattggattctttcctcaggcaaaatgacgggcagttcaccgtgatccagcttgtgggtatgctcaggggcatcgctgctggcatgaagtacctggctgagatgaattatgtgcatcgggacctggctgctaggaacattctggtcaacagtaacctggtgtgcaaggtgtccgactttggcctctcccgctacctccaggatgacacctcagatcccacctacaccagctccttgggagggaagatccctgtgagatggacagctccagaggccatcgcctaccgcaagttcacttcagccagcgacgtttggagctatgggatcgtcatgtgggaagtcatgtcatttggagagagaccctattgggatatgtccaaccaagatgtcatcaatgccatcgagcaggactaccggctgcccccacccatggactgtccagctgctctacaccagctcatgctggactgttggcagaaggaccggaacagccggccccggtttgcggagattgtcaacaccctagataagatgatccggaacccggcaagtctcaagactgtggcaaccatcaccgccgtgccttcccagcccctgctcgaccgctccatcccagacttcacggcctttaccaccgtggatgactggctcagcgccatcaaaatggtccagtacagggacagcttcctcactgctggcttcacctccctccagctggtcacccagatgacatcagaagacctcctgagaataggcatcaccttggcaggccatcagaagaagatcctgaacagcattcattctatgagggtccagataagtcagtcaccaacggcaatggcatga

SEQ ID NO: 9066 - DNA, 2346 bp, synthetic construct
  misc_feature 1..2346: note = Synthetic polypeptide
  source 1..2346: mol_type = other DNA
ttcacatgattgactcctactcattaagactcacccaaggaaatccacattcaggaagccttttctgccccttcaccgctctggtatcccctccaccagtcttgagtggatgctcctcctgtgtctctcagtgcccagtgcatacttctatcatggaacattgttctggcagctgttgtgctgtgtatggacgtgggctttaccatgagtaactccattcctggtatagaatccccatttgaacaagcaaagaaggtgataaccatgtttgtacagcgacaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgacttcctggatgcactaatcgtgagcatggatgtgattcaacatgaaacaataggaaagaagtttgagaagaggcatattgaaatattcactgacctcagcagccgattcagcaaaagtcagctggatattataattcatagcttgaagaaatgtgacatctccctgcaattcttcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccctaaaaaaagaagatatacaaaaagaaacagtttattgcttaaatgatgatgatgaaactgaagttttaaaagaggatattattcaagggttccgctatggaagtgatatagttcctttctctaaagtggatgaggaacaaatgaaatataaatcggaggggaagtgcttctctgttttgggattttgtaaatcttctcaggttcagagaagattcttcatgggaaatcaagttctaaaggtctttgcagcaagagatgatgaggcagctgcagttgcactttcctccctgattcatgctttggatgacttagacatggtggccatagttcgatatgcttatgacaaaagagctaatcctcaagtcggcgtggcttttcctcatatcaagcataactatgagtgtttagtgtatgtgcagctgcctttcatggaagacttgcggcaatacatgttttcatccttgaaaaacagtaagaaatatgctcccaccgaggcacagttgaatgctgttgatgctttgattgactccatgagcttggcaaagaaagatgagaagacagacacccttgaagacttgtttccaaccaccaaaatcccaaatcctcgatttcagagattatttcagtgtctgctgcacagagctttacatccccgggagcctctacccccaattcagcagcatatttggaatatgctgaatcctcccgctgaggtgacaacaaaaagtcagattcctctctctaaaataaagaccctttttcctctgattgaagccaagaaaaaggatcaagtgactgctcaggaaattttccaagacaaccatgaagatggacctacagctaaaaaattaaagactgagcaagggggagcccacttcagcgtctccagtctggctgaaggcagtgtcacctctgttggaagtgtgaatcctgctgaaaacttccgtgttctagtgaaacagaagaaggccagctttgaggaagcgagtaaccagctcataaatcacatcgaacagtttttggatactaatgaaacaccgtattttatgaagagcatagactgcatccgagccttccgggaagaagccattaagttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacacagcagctgtatttgaagaaggtggtgatgtggacgatttattggacatgatatag

SEQ ID NO: 9067 - DNA, 379 bp, synthetic construct
  misc_feature 1..379: note = Synthetic polypeptide
  source 1..379: mol_type = other DNA
tgggactcatcatgtacccattattagaccaggcaagaattattaatggatgctaaatatggggattgtttcactaaggagaagaatatttgcgtggttttcttattacagacttactttcaaagggggctggggggaggagtaattatatattggagaaaggggacaatgccttgaccagataatcaaaatcaacatcaccaatgagggacagataggcttatattatctctctaggtggatactctaaaggcacgacatctctgcagcattccagccaaaaatacatgatgcatacccagagtatcttatcacttaccagatcatgaagccagaagccccttcccagaccgcaacagccgcagagcagaagacctag

SEQ ID NO: 9068 - DNA, 740 bp, synthetic construct
  misc_feature 1..740: note = Synthetic polypeptide
  source 1..740: mol_type = other DNA
ggccggacgtggttactcacgcctgtaatcccagcactttgggaggccaaggtgaaattgatcttcaaattctctccaaagttcaggctcaatacccaggagtttgtatcaacaatgaagttgttgagccaagtgctgaacaaattgccaaatacaaagagcttgtagccaagacatcgaacctcgagaacgtaaagtttgcttggcataaggagacatcatctgaataccaaagtagaatgttggagaaaaaggagcttcaaaagtgggactttattcatatgattcaaatgctgtattatgtaaaagacatcccagctaccctgaaattcttccatagtctcttaggtaccaatgctaagatgctcattattgttgtgtcaggaagcagtggctgggacaagctgtggaaaaagtacggatcacgctttccccaggatgacctctgccagtatatcacatcagatgacctcactcagatgctggacaacctagggcttaagtatgagtgctatgaccttttgtccaccatggatatatctgactgctttattgatggtaatgaaaatggagacctgctttgggattttttgactgaaacctgcaactttaatgccacagcaccacctgatctcagagcagagcttgggaaagatctacaagagcctgaatttagtgctaagaaagaggggaaggttctttttaataatactctgagtttcatagtgattgaggcataa

SEQ ID NO: 9069 - DNA, 1607 bp, synthetic construct
  misc_feature 1..1607: note = Synthetic polypeptide
  source 1..1607: mol_type = other DNA
ggctaggtgtggtggctcacacctatcccagcactttgggaggcagaggtgggaggatcgcttaaacccaggagttcaagaccagcctggatatcatggtgacagagtacgtggagcacggacccctggatgtgtggctgcggagggagcggggccatgtgcccatggcttggaagatggtggtggcccagcagctggccagcgccctcagctacctggagaacaagaacctggttcatggtaatgtgtgtggccggaacatcctgctggcccggctggggttggcagagggcaccagccccttcatcaagctgagtgatcctggcgtgggcctgggcgccctctccagggaggagcgggtggagaggatcccctggctggcccccgaatgcctaccaggtggggccaacagcctaagcaccgccatggacaagtgggggtttggcgccaccctcctggagatctgctttgacggagaggcccctctgcagagccgcagtccctccgagaaggagcatttctaccagaggcagcaccggctgcccgagccctcctgcccacagctggccacactcaccagccagtgtctgacctatgagccaacccagaggccatcattccgcaccatcctgcgtgacctcacccggctgcagccccacaatcttgctgacgtcttgactgtgaacccggactcaccggcgtcggaccctacggttttccacaagcgctatttgaaaaagatccgagatctgggcgagggtcacttcggcaaggtcagcttgtactgctacgatccgaccaacgacggcactggcgagatggtggcggtgaaagccctcaaggcagactgcggcccccagcaccgctcgggctggaagcaggagattgacattctgcgcacgctctaccacgagcacatcatcaagtacaagggctgctgcgaggaccaaggcgagaagtcgctgcagctggtcatggagtacgtgcccctgggcagcctccgagactacctgccccggcacagcatcgggctggcccagctgctgctcttcgcccagcagatctgcgagggcatggcctatctgcacgcgcagcactacatccaccgagacctagccgcgcgcaacgtgctgctggacaacgacaggctggtcaagatcggggactttggcctagccaaggccgtgcccgaaggccacgagtactaccgcgtgcgcgaggatggggacagccccgtgttctggtatgccccagagtgcctgaaggagtataagttctactatgcgtcagatgtctggtccttcggggtgaccctgtatgagctgctgacgcactgtgactccagccagagcccccccacgaaattccttgagctcataggcattgctcagggtcagatgacagttctgagactcactgagttgctggaacgaggggagaggctgccacggcccgacaaatgtccctgtgaggtctatcatctcatgaagaactgctgggagacagaggcgtcctttcgcccaaccttcgagaacctcatacccattctgaagacagtccatgagaagtaccaaggccaggccccttcagtgttcagcgtgtgctga

SEQ ID NO: 9070 - DNA, 809 bp, synthetic construct
  misc_feature 1..809: note = Synthetic polypeptide
  source 1..809: mol_type = other DNA
ggctaggtgtggtggctcacacctatcccagcactttgggaggcagaggtgggaggatcgcttaaacccaggagttcaagaccagcctggatatcatggtgacagagtacgtggagcacggacccctggatgtgtggctgcggagggagcggggccatgtgcccatggcttggaagatggtggtggcccagcagctggccagcgccctcagctacctggagaacaagaacctggttcatggtaatgtgtgtggccggaacatcctgctggcccggctggggttggcagagggcaccagccccttcatcaagctgagtgatcctggcgtgggcctgggcgccctctccagggaggagcgggtggagaggatcccctggctggcccccgaatgcctaccaggtggggccaacagcctaagcaccgccatggacaagtgggggtttggcgccaccctcctggagatctgctttgacggagaggcccctctgcagagccgcagtccctccgaggtatgtctaggagacccttgggccctccccgcagtgggggcccctccaagaaatccagaggacagaatcagagctcaaagctgcatcccttctggcctcgtgacttcaagtctctctgggctaccagcaggtgggccactcgctggggctcaatgtagtcccagcctttttaggtccttgtggaagtcacttgtgcctggcacacagaaggcaagtaagagacttgatttcagttttaggcagagtgaccagggcagcgatgggagacgcccaggctgcagagtggggaagaagggctga

SEQ ID NO: 9071 - DNA, 543 bp, synthetic construct
  misc_feature 1..543: note = Synthetic polypeptide
  source 1..543: mol_type = other DNA
agtcagttttgtcacagacaagctctgtgaccttggagaagttacttagccacactgagctacagttttctcatccgttgaatggagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagaatcagcagaatctgccaaaataggaggaataattactgtgtttttgatagcattggtcttgacaagcaccatagtgacactgaaatggattggttatatatgcttaagaaatagcctccccaaagtcttgaggcaaggtctcgctaagggctggaatgcagtggctattcacaggtgcagtcataatgcactacagtctgaaactcctgagctcaaacagtcgtcctgcctaagcttccccagtagctgggattacaagcgtgcatccctgtgccccagtgattaa

SEQ ID NO: 9072 - DNA, 1095 bp, synthetic construct
  misc_feature 1..1095: note = Synthetic polypeptide
  source 1..1095: mol_type = other DNA
agtcagttttgtcacagacaagctctgtgaccttggagaagttacttagccacactgagctacagttttctcatccgttgaatggagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagaatcagcagaatctgccaaaataggaggaataattactgtgtttttgatagcattggtcttgacaagcaccatagtgacactgaaatggattggttatatatgcttaagaaatagcctccccaaagtcttgaattttcataactttttagcctggccatttcctaacctgccaccgttggaagccatggatatggtggaggtcatttacatcaacagaaagaagaaagtgtgggattataattatgatgatgaaagtgatagcgatactgaggcagcgcccaggacaagtggcggtggctataccatgcatggactgactgtcaggcctctgggtcaggcctctgccacctctacagaatcccagttgatagacccggagtccgaggaggagcctgacctgcctgaggttgatgtggagctccccacgatgccaaaggacagccctcagcagttggaactcttgagtgggccctgtgagaggagaaagagtccactccaggacccttttcccgaagaggactacagctccacggaggggtctgggggcagaattaccttcaatgtggacttaaactctgtgtttttgagagttcttgatgacgaggacagtgacgacttagaagcccctctgatgctatcgtctcatctggaagagatggttgacccagaggatcctgataatgtgcaatcaaaccatttgctggccagcggggaagggacacagccaacctttcccagcccctcttcagagggcctgtggtccgaagatgctccatctgatcaaagtgacacttctgagtcagatgttgaccttggggatggttatataatgagatga

SEQ ID NO: 9073 - DNA, 267 bp, synthetic construct
  misc_feature 1..267: note = Synthetic polypeptide
  source 1..267: mol_type = other DNA
agtcagttttgtcacagacaagctctgtgaccttggagaagttacttagccacactgagctacagttttctcatccgttgaatggagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagaattttcataa

SEQ ID NO: 9074 - DNA, 450 bp, synthetic construct
  misc_feature 1..450: note = Synthetic polypeptide
  source 1..450: mol_type = other DNA
agtcagttttgtcacagacaagctctgtgaccttggagaagttacttagccacactgagctacagttttctcatccgttgaatggagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagaatcagcagaatctgccaaaataggaggaataattactgtgtttttgatagcattggtcttgacaagcaccatagtgacactgaaatggattggttatatatgcttaagaaatagcctccccaaagtcttgaattttcataactttttagcctggccatttcctaacctgccaccgttggaagccatggatatg

SEQ ID NO: 9075 - DNA, 824 bp, synthetic construct
  misc_feature 1..824: note = Synthetic polypeptide
  source 1..824: mol_type = other DNA
agtcagttttgtcacagacaagctctgtgaccttggagaagttacttagccacactgagctacagttttctcatccgttgaatggagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagcattgggaatggtaccacctcccgaaaatgtcagaatgaattctgttaatttcaagaacattctacagtgggagtcacctgcttttgccaaagggaacctgactttcacagctcagtacctaagttataggatattccaagataaatgcatgaatactaccttgacggaatgtgatttctcaagtctttccaagtatggtgaccacaccttgagagtcagggctgaatttgcagatgagcattcagactgggtaaacatcaccttctgtcctgtggatgacaccattattggaccccctggaatgcaagtagaagtacttgctgattctttacatatgcgtttcttagcccctaaaattgagaatgaatacgaaacttggactatgaagaatgtgtataactcatggacttataatgtgcaatactggaaaaacggtactgatgaaaagtttcaaattactccccagtatgactttgaggtcctcagaaacctggagccatggacaacttattgtgttcaagttcgagggtttcttcctgatcggaacaaagctggggaatggagtga

SEQ ID NO: 9076 - DNA, 285 bp, synthetic construct
  misc_feature 1..285: note = Synthetic polypeptide
  source 1..285: mol_type = other DNA
agtcagttttgtcacagacaagctctgtgaccttggagaagttacttagccacactgagctacagttttctcatccgttgaatggagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagttataggatattccaagataaatgcatga

SEQ ID NO: 9077 - DNA, 454 bp, synthetic construct
  misc_feature 1..454: note = Synthetic polypeptide
  source 1..454: mol_type = other DNA
gactgggcgcagtggctcacgcctgtaatcccagcactttgggaggccgaggcgggcggatcacgagtttcattcattggctcccatgtactatcgaggctcagctgcagctgttatcgtgtatgatattaccaagcaggattcattttataccttgaagaaatgggtcaaggagctgaaagaacatggtccagaaaacattgtaatggccatcgctggaaacaagtgcgacctctcagatattagggaggttcccctgaaggatgctaaggaatacgctgaatccataggtgccatcgtggttgagacaagtgcaaaaaatgctattaatatcgaagagctctttcaaggaatcagccgccagatcccacccttggacccccatgaaaatggaaacaatggaacaatcaaagttgagaagccaaccatgcaagccagccgccggtgctgttga

SEQ ID NO: 9078 - DNA, 682 bp, synthetic construct
  misc_feature 1..682: note = Synthetic polypeptide
  source 1..682: mol_type = other DNA
tggagagggcaggagctccgatgtcagccagactggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaatctggaaggacttttcagcctcatccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaaggatatgtttgccttcatgggcagcctggataccaagggtaccagctacaagtatgaggtggcactggctgggccagccctggagttgcacaactgcatggcgaaactgttggcccaccccctgcagcggccttgccagagccatgcttcctacagcctgctggaggaggaggatgaagccattgaggttgaggccactgtctga

SEQ ID NO: 9079 - DNA, 78 bp, synthetic construct
  misc_feature 1..78: note = Synthetic polypeptide
  source 1..78: mol_type = other DNA
tggagagggcaggagctccgatgtcagccagactggctccaaaaccaacgccctcaatgtctcccagaagatgattga

SEQ ID NO: 9080 - DNA, 481 bp, synthetic construct
  misc_feature 1..481: note = Synthetic polypeptide
  source 1..481: mol_type = other DNA
tggagagggcaggagctccgatgtcagccagactggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaatctggaaggacttttcagcctcatccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaagtag

SEQ ID NO: 9081 - DNA, 292 bp, synthetic construct
  misc_feature 1..292: note = Synthetic polypeptide
  source 1..292: mol_type = other DNA
tggagagggcaggagctccgatgtcagccagactggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaatctggaaggacttttcagcctcatccagcagaaaactgagcttccggtcacagag

SEQ ID NO: 9082 - DNA, 236 bp, synthetic construct
  misc_feature 1..236: note = Synthetic polypeptide
  source 1..236: mol_type = other DNA
tggagagggcaggagctccgatgtcagccagactggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttca

SEQ ID NO: 9083 - DNA, 682 bp, synthetic construct
  misc_feature 1..682: note = Synthetic polypeptide
  source 1..682: mol_type = other DNA
tggagagggcaggagctccgatgtcagccagactggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaacatcagtggggcctcacctgcccgccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaaggatatgtttgccttcatgggcagcctggataccaagggtaccagctacaagtatgaggtggcactggctgggccagccctggagttgcacaactgcatggcgaaactgttggcccaccccctgcagcggccttgccagagccatgcttcctacagcctgctggaggaggaggatgaagccattgaggttgaggccactgtctga

SEQ ID NO: 9084 - DNA, 347 bp, synthetic construct
  misc_feature 1..347: note = Synthetic polypeptide
  source 1..347: mol_type = other DNA
tggagagggcaggagctccgatgtcagccagactggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaccttctccttagcacccccaccagatctggaaggacttttcagcctcatccagcagaaaactgagcttccggtcacagagaacgtgcagacgattcccccgccatatgtgg

SEQ ID NO: 9085 - DNA, 273 bp, synthetic construct
  misc_feature 1..273: note = Synthetic polypeptide
  source 1..273: mol_type = other DNA
tggagagggcaggagctccgatgtcagccagactggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcacacccccaccagatctggaaggacttttcagcctcat

SEQ ID NO: 9086 - DNA, 317 bp, synthetic construct
  misc_feature 1..317: note = Synthetic polypeptide
  source 1..317: mol_type = other DNA
tggagagggcaggagctccgatgtcagccagactggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaatctggaaggacttttcagcctcatccagcagaaaactgagcttccggtcacagagaacgtgcagacgattcccccgccat

SEQ ID NO: 9087 - DNA, 369 bp, synthetic construct
  misc_feature 1..369: note = Synthetic polypeptide
  source 1..369: mol_type = other DNA
tggagagggcaggagctccgatgtcagccagactggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaatctggaaggacttttcagcctcatccagcagaaaactgagcttccggtcacagagaacgtgcagacgattcccccgccatatgtggtccgcaccatccttgtctacagccgtccaccttgccagccccagtt

SEQ ID NO: 9088 - DNA, 175 bp, synthetic construct
  misc_feature 1..175: note = Synthetic polypeptide
  source 1..175: mol_type = other DNA
tggagagggcaggagctccgatgtcagccagactggctccaaaaccaacgccctcaatgtctcccagaagatgattgagatgttcgtgcggacaaaacacaagatcgacaaaagccactgtctgaaccatccctgtacatctgcaccttcttgtgcaaggaagtccttggcctaa

SEQ ID NO: 9089 - DNA, 650 bp, synthetic construct
  misc_feature 1..650: note = Synthetic polypeptide
  source 1..650: mol_type = other DNA
ggtgagagtccctggccggcttcctcctctctgtcagtgccaccaccagggttgccaggctgcgaatcccattcccgcagacggggacctggttcctggccctccgctccctgtgcggggtggggcctcggttcgtgcggtgccgcaacgcgacggccgaggtgcggatgcgcaccttcctgtccccatgcgtggacgactgcgggccctacggccagtgcaagctgctgcgcacacacaattatctgtacgcagcctgcgagtgcaaggccgggtggagaggctggggctgcaccgacagtgcagatgcgctcacctatggattccagctgctgtccacactcctgctctgcctgagcaacctcatgtttctgccacctgtggtcctggccattcggagtcgatatgtgctggaagctgcagtctacaccttcaccatgttcttctccacggtatgcggtggtgtctgcatcttatcactgggtgcttgtgcatggtggtgggtcacagtctgtatttccaccacgttctccgagggtttgggaatgtctgtgccttcactgtgtcttctacagacagagacagcagtgcttcccaaactgtcatgcatagataatggtcatttttgtaagacacattggagtaaatga

SEQ ID NO: 9090 - DNA, 1052 bp, synthetic construct
  misc_feature 1..1052: note = Synthetic polypeptide
  source 1..1052: mol_type = other DNA
ggtgagagtccctggccggcttcctcctctctgtcagtgccaccaccagggttgccaggctgcgaatcccattcccgcagacggggacctggttcctggccctccgctccctgtgcggggtggggcctcggttcgtgcggtgccgcaacgcgacggccgaggtgcggatgcgcaccttcctgtccccatgcgtggacgactgcgggccctacggccagtgcaagctgctgcgcacacacaattatctgtacgcagcctgcgagtgcaaggccgggtggagaggctggggctgcaccgacagtgcagatgcgctcacctatggattccagctgctgtccacactcctgctctgcctgagcaacctcatgtttctgccacctgtggtcctggccattcggagtcgatatgtgctggaagctgcagtctacaccttcaccatgttcttctccacgttctatcatgcctgtgaccagccaggcatcgtggttttctgcatcatggactacgatgtgctgcagttctgtgatttcctgggctccttaatgtccgtgtgggtcactgtcattgccatggctcgtttacagcccgtggtcaagcaggtgctgtatttgctgggagctatgctgctgtccatggctctgcagcttgaccgacatggactctggaacctgcttggacccagtctcttcgccctggggatcttggccacagcctggacagtacgcagcgtccgccgccggcactgctacccacccacgtggcgccgctggcttttctacttgtgccctggcagccttattgcaggcagtgccgtcctgctttatgcttttgtggagacccgggacaactacttctacattcacagcatttggcatatgctcattgcgggcagtgtgggcttcctgctgccccctcgtgccaagactgaccacggggtcccatctggagcccgggcccggggctgtggttaccagctatgcatcaacgagcaggaggagctgggcctcgtgggcccaggaggggccactgtcagcagcatctgtgccagctga

SEQ ID NO: 9091 - DNA, 959 bp, synthetic construct; identical to SEQ ID NO: 7258
  misc_feature 1..959: note = Synthetic polypeptide
  source 1..959: mol_type = other DNA

SEQ ID NO: 9092 - DNA, 649 bp, synthetic construct; identical to SEQ ID NO: 7259
  misc_feature 1..649: note = Synthetic polypeptide
  source 1..649: mol_type = other DNA

SEQ ID NO: 9093 - DNA, 1521 bp, synthetic construct
  misc_feature 1..1521: note = Synthetic polypeptide
  source 1..1521: mol_type = other DNA
atgggtatggcagcagccaaacttctgcatgactctggactgaatgtggttgttctggaagcccgggaccgtgtgggaggcaggacttacactcttaggaaccaaaaggttaaatatgtggaccttggaggatcctatgttggaccaacccagaatcgtatcttgagattagccaaggagctaggattggagacctacaaagtgaatgaggttgagcgtctgatccaccatgtaaagggcaaatcataccccttcagggggccattcccacctgtatggaatccaattacctacttagatcataacaacttttggaggacaatggatgacatggggcgagagattccgagtgatgccccatggaaggctccccttgcagaagagtgggacaacatgacaatgaaggagctactggacaagctctgctggactgaatctgcaaagcagcttgccactctctttgtgaacctgtgtgtcactgcagagacccatgaggtctctgctctctggttcctgtggtatgtgaagcagtgtggaggcacaacaagaatcatctcgacaacaaatggaggacaggagaggaaatttgtgggcggatctggtcaagtgagtgagcggataatggacctccttggagaccgagtgaagctggagaggcctgtgatctacattgaccagacaagagaaaatgtccttgtggagaccctaaaccatgagatgtatgaggctaaatatgtgattagtgctattcctcctactctgggcatgaagattcacttcaatccccctctgccaatgatgagaaaccagatgatcactcgtgtgcctttgggttcagtcatcaagtgtatagtttattataaagagcctttctggaggaaaaaggattactgtggaaccatgattattgatggagaagaagctccagttgcctacacgttggatgataccaaacctgaaggcaactatgctgccataatgggatttatcctggcccacaaagccagaaaactggcacgtcttaccaaagaggaaaggttgaagaaactttgtgaactctatgccaaggttctgggttccctagaagctctggagccagtgcattatgaagaaaagaactggtgtgaggagcagtactctgggggctgctacacaacttatttcccccctgggatcctgactcaatatggaagggttctacgccagccagtggacaggatttactttgcaggcaccgagactgccacacactggagcggctacatggagggggctgtagaggccggggagagagcagcccgagagatcctgcatgccatggggaagattccagaggatgaaatctggcagtcagaaccagagtctgtggatgtccctgcacagcccatcaccaccacctttttggagagacatttgccctccgtgccaggcctgctcaggctgattggattgaccaccatcttttcagcaacggctcttggcttcctggcccacaaaagggggctacttgtgagagtctaa

SEQ ID NO: 9094 - DNA, 792 bp, synthetic construct
  misc_feature 1..792: note = Synthetic polypeptide
  source 1..792: mol_type = other DNA
tgtggtggttctaaaatttgtccagagattctttgatgctgcttccattaagtggtggagcttaatttccctctcctggagtgtggggtggacgcagtggctcactgctaatgaacagaataaagcacaagtgttagtgtgtgattgcagaaactaggtcgtaaaaatcactgcagcttcctcctttcttcctaactgtgcactctgggtaaagccagctgccatgtcataaggagatcaagcagctccacagaaaagtcagcatggcaaggagctaaggctttctgccgatagcctctgagggactgaggcctccagccaacagccacgcaaatgagccatcatggaatcagatcagcccaagttaaaccttcagcttcttggtgatggcttacctgaatcatcatgacagactcagtcagagtcacctggccctgaatccttgacccacagaaactgtgagctaataaatgtgtgttgttttgagctgctaaacaaaaagatctcagtgaccagctgctggaggtggtcggcttggaaggagccatggagatggggcaaatatacacaggcctgaaaagtgctggccggcggctggctcagtgctcctgcgtggtcatcaggacgagcaagtctctgccaatgcaaattgatggggagccatggatgcagaccccatgcacaataaaaattacacacaagaaccaagccccaatgctgatgggcccgcctccaaaaaccggtttattctgctccctcgtcaaaaggacaagaaaccgaagcaaggaataa

SEQ ID NO: 9095 - DNA, 699 bp, synthetic construct
  misc_feature 1..699: note = Synthetic polypeptide
  source 1..699: mol_type = other DNA
tgtggtggttctaaaatttgtccagagattctttgatgctgcttccattaagtggtggagcttaatttccctctcctggagtgtggggtggacgcagtggctcactgctaatgaacagaataaagcacaagtgttagtgtgtgattgcagaaactaggtcgtaaaaatcactgcagcttcctcctttcttcctaactgtgcactctgggtaaagccagctgccatgtcataaggagatcaagcagctccacagaaaagtcagcatggcaaggagctaaggctttctgccgatagcctctgagggactgaggcctccagccaacagccacgcaaatgagccatcatggaatcagatcagcccaagttaaaccttcagcttcttggtgatggcttacctgaatcatcatgacagactcagtcagagtcacctggccctgaatccttgacccacagaaactgtgagctaataaatgtgtgttgttttgagctgctaaacaaaaagatctcagtgaccagctgctggaggtggtcggcttggaaggagccatggagatggggcaaatatacacaggcctgaaaagtgctggccggcggctggctcagtgctcctgcgtggtcatcaggacgagcaagtctctgccaatgcaaattgatggggagccatggatgcagaccccatgcacagtgagtacagagtag

SEQ ID NO: 9096 - DNA, 89 bp, synthetic construct; identical to SEQ ID NO: 9056
  misc_feature 1..89: note = Synthetic polypeptide
  source 1..89: mol_type = other DNA

SEQ ID NO: 9097 - DNA, 267 bp, synthetic construct; identical to SEQ ID NO: 9057
  misc_feature 1..267: note = Synthetic polypeptide
  source 1..267: mol_type = other DNA

SEQ ID NO: 9098 - DNA, 423 bp, synthetic construct; identical to SEQ ID NO: 6550
  misc_feature 1..423: note = Synthetic polypeptide
  source 1..423: mol_type = other DNA

SEQ ID NO: 9099 - DNA, 340 bp, synthetic construct; identical to SEQ ID NO: 8550
  misc_feature 1..340: note = Synthetic polypeptide
  source 1..340: mol_type = other DNA

SEQ ID NO: 9100 - DNA, 1143 bp, synthetic construct
  misc_feature 1..1143: note = Synthetic polypeptide
  source 1..1143: mol_type = other DNA
cttggcaggtggtgagctccccactgcaggctgtattcaggaagagtcagtgaatggctgcggtgtgacaacatgcaccaccagtggcttctgctggccgcatgcttttgggtgattttcatgttcatggtggctagcaagttcatcacgttgacctttaaagacccagatgtgtacagtgccaaacaggagtttctgttcctgacaaccatgccggaagtgaggaagttgccagaagagaagcacattcctgaggaactgaagccaactgggaaggagcttccagacagccagctcgttcagcccctggtctacatggagcgcctggaactcatcagaaacgtctgcagggatgatgccctgaagaatctctcgcacactcctgtctccaagtttgtcctggaccgaatatttgtctgtgacaagcacaagattcttttctgccagactcccaaagtgggcaacacccagtggaagaaagtgctgattgttctaaatggagcattttcttccattgaggagatccccgaaaacgtggtgcacgaccacgagaagaacggccttcctcggctctcttccttcagtgatgcagaaattcagaagcgattgaaaacatacttcaagttttttattgtaagagatcccttcgaaagacttatttctgcatttaaggataaatttgttcacaatccccggtttgagccttggtacaggcatgagattgctcctggcatcatcagaaaatacaggaggaaccggacagagacccgggggatccagtttgaagatttcgtgcgctacctcggcgatccgaaccacagatggctagaccttcagtttggggaccacatcattcactgggtgacgtatgtagagctctgtgctccctgtgagataatgtacagtgtgattggacaccacgagaccctggaggacgatgccccatacatcttaaaagaggctggcattgaccacctggtgtcatacccgactatccctccgggcattaccgtgtataacagaaccaaggtggagcactatttcctgggcatcagcaaacgagacatccgacgcctgtatgcccgtttcgaaggggactttaagctctttgggtaccagaaaccagactttttgctaaactaa

SEQ ID NO: 9101 - DNA, 355 bp, synthetic construct
  misc_feature 1..355: note = Synthetic polypeptide
  source 1..355: mol_type = other DNA
cttggcaggtggtgagctccccactgcaggctgtattcaggaagagtcagtgaatggctgcggtgtgacaacatgcaccaccagtggcttctgctggccgcatgcttttgggtgattttcatgttcatggtggctagcaagttcatcacgttgacctttaaagacccagatgtgtacagtgccaaacaggagtttctgttcctgacaaccatgccggaagtgaggaagttgccagaagagaagcacattcctgaggaactgaagccaactgggaaggagcttccagacagccagctcgttcagcccctggtctacatggagcgcctggaactcatcagaaacgtctgcagggatg

SEQ ID NO: 9102 - DNA, 156 bp, synthetic construct; identical to SEQ ID NO: 6906
  misc_feature 1..156: note = Synthetic polypeptide
  source 1..156: mol_type = other DNA

SEQ ID NO: 9103 - DNA, 662 bp, synthetic construct
  misc_feature 1..662: note = Synthetic polypeptide
  source 1..662: mol_type = other DNA
gatttaaatgagattgccagcctagagagggtctctattggcatgccgtagagctctgccattggctattttttgtagaacttattaatgacttggatgaagaaaaggaagacctgtgtgttaagttagtggatggcttaaagctgtgtgctgtcaccattcatgagacgatgcaattgagattccaaaagattttgcaattttgctggtctggaagatgtccaaataaggaatgaaattcagtggagatggatgtaaaatcctacccttaagccccatagcatccatcatcatccaaggacggacggagaagcagcacatgcagataaagcttgcatttctctgcaggctcagagagaatcctcagcggcttgggcccagcacaggagaggtcactgccacacatttgcccttggcatggtctccagaaccatgcattgcatcctgggagcaacattttctgagatattctggaatatgagagcctggagcaagaaaacaccatgctgcggagagagatcgggaagctgacagaggagctgaagcacctgacagaggcactgaaggagcacgagaagatgtgcccgctgctgctctgccctatgaactttgtgccagtgcctccccggccggaccctgtggccggctgcttgccccgatga

SEQ ID NO: 9104 - DNA, 1771 bp, synthetic construct
  misc_feature 1..1771: note = Synthetic polypeptide
  source 1..1771: mol_type = other DNA
cgtgagccagagacggggcacaggctgccttcgggagctcccagacccagtgctgagtgaggaggtggtggagggcattgctgctggcattgaggcagccctctgggacctgacacaaggcaccaatggccggtacaagaccaagtatcgcagcctgctgttcaacctgcgggaccccaggaacctggacttgtttctcaaagtggttcatggagatgtcaccccctacgacctggtgcggatgagctcgatgcagctggccccccaggagctggcccgctggcgggaccaggaggagaaaaggggcctgaatatcattgagcagcaacagaaggagccgtgcagacttccagcctccaaaatgacccacaagggcgaagtggagattcagcgggacatggaccagacactgaccctggaggatctggtgggaccgcagatgttcatggactgcagcccacaggccctgcccatcgcatcagaggacaccacggggcagcatgaccaccacttcttagaccccaactgccacatctgcaaggactgggagccctcgaatgagctgctaggctccttcgaagccgccaagagctgcggggacaatatcttccagaaagccctaagccaaactcctatgcctgctccagagatgcccaaaaccagggagttgtctcccacggaaccacaggacagggtccctccatctgggctccatgtgcctgctgcacccacaaaggccctgccctgcctgccaccctgggaaggtgttctggacatgttctccatcaagcggttccgggccagggcccagctggtctcgggacacagctgtcggcttgtccaggctctgcccaccgtgatccgctcggcaggctgcatcccctccaacattgtctgggaccttctggccagcatctgcccagccaaggccaaggacgtctgcgtggtcagactgtgcccacatggggcccgggacacccagaactgccgcctgctctactcatacctcaatgataggcagcgccacgggctggcctctgtggagcacatggggatggtcctgctgcccctgcctgccttccagcccctgcccaccaggctgcgccctttggggggcccaggtctggaggtcactcactcaagtctgttgctggctgtgctgctccccaaggaagggcttccagacacagcagggtccagcccctggttggggaaggttcaaaagatggtctccttcaacagtaaggtggagaagagatactatcagccagatgacaggaggccgaatgtgcccctgaagggcacccctcccccaggaggtgcctggcagcagagccagggcaggggcagtatagctccaaggggaatctctgcttggcagaggccccccagaggcagggggaggctctggccagagcctgaaaactggcagcatcctgggcgagggcagtggcccccagagccaggcttgcgccagtcccagcatccctattcagtagcaccagctggtcatggctttggccgtggccagcacttccacagggactcctgtccccaccaagccctgctccggcacctcgaatccctggcgaccatgagtcaccagctccaagccttactgtgcccccagaccaagagctccatcccccgccctctgcagcgtttgtctagcgcccttgcagctccagagccccctggcccagcccgtgactcctctttggggcctacagatgaagctggctctgagtgtcccttccctagaaaggcctga

SEQ ID NO: 9105 - DNA, 56 bp, synthetic construct
  misc_feature 1..56: note = Synthetic polypeptide
  source 1..56: mol_type = other DNA
cgtgagccagagacggggcacaggctgccttcgggagctcccagacccagtgctga

SEQ ID NO: 9106 - DNA, 1810 bp, synthetic construct
  misc_feature 1..1810: note = Synthetic polypeptide
  source 1..1810: mol_type = other DNA
cgtgagccagagacggggcacaggctgccttcgggagctcccagacccagtgctgagtgaggaggtggtggagggcattgctgctggcattgaggcagccctctgggacctgacacaaggcaccaatggccggtacaagaccaagtatcgcagcctgctgttcaacctgcgggaccccaggaacctggacttgtttctcaaagtggttcatggagatgtcaccccctacgacctggtgcggatgagctcgatgcagctggccccccaggagctggcccgctggcgggaccaggaggagaaaaggggcctgaatatcattgagcagcaacagaaggagccgtgcagacttccagcctccaaaatgacccacaagggcgaagtggagattcagcgggacatggaccagacactgaccctggaggatctggtgggaccgcagatgttcatggactgcagcccacaggccctgcccatcgcatcagaggacaccacggggcagcatgaccaccacttcttagaccccaactgccacatctgcaaggactgggagccctcgaatgagctgctaggctccttcgaagccgccaagagctgcggggacaatatcttccagaaagccctaagccaaactcctatgcctgctccagagatgcccaaaaccagggagttgtctcccacggaaccacaggacagggtccctccatctgggctccatgtgcctgctgcacccacaaaggccctgccctgcctgccaccctgggaaggtgttctggacatgttctccatcaagcggttccgggccagggcccagctggtctcgggacacagctgtcggcttgtccaggctctgcccaccgtgatccgctcggcaggctgcatcccctccaacattgtctgggaccttctggccagcatctgcccagccaaggccaaggacgtctgcgtggtcagactgtgcccacatggggcccgggacacccagaactgccgcctgctctactcatacctcaatgataggcagcgccacgggctggcctctgtggagcacatggggatggtcctgctgcccctgcctgccttccagcccctgcccaccaggctgcgccctttggggggcccaggcctttgggctcttcctgtctcccctctcctttccccaggtctggaggtcactcactcaagtctgttgctggctgtgctgctccccaaggaagggcttccagacacagcagggtccagcccctggttggggaaggttcaaaagatggtctccttcaacagtaaggtggagaagagatactatcagccagatgacaggaggccgaatgtgcccctgaagggcacccctcccccaggaggtgcctggcagcagagccagggcaggggcagtatagctccaaggggaatctctgcttggcagaggccccccagaggcagggggaggctctggccagagcctgaaaactggcagcatcctgggcgagggcagtggcccccagagccaggcttgcgccagtcccagcatccctattcagtagcaccagctggtcatggctttggccgtggccagcacttccacagggactcctgtccccaccaagccctgctccggcacctcgaatccctggcgaccatgagtcaccagctccaagccttactgtgcccccagaccaagagctccatcccccgccctctgcagcgtttgtctagcgcccttgcagctccagagccccctggcccagcccgtgactcctctttggggcctacagatgaagctggctctgagtgtcccttccctagaaaggcctga

SEQ ID NO: 9107 - DNA, 1768 bp, synthetic construct
  misc_feature 1..1768: note = Synthetic polypeptide
  source 1..1768: mol_type = other DNA
cgtgagccagagacggggcacaggctgccttcgggagctcccagacccagtgctgagtgaggaggtggtggagggcattgctgctggcattgaggcagccctctgggacctgacacaaggcaccaatggccggtacaagaccaagtatcgcagcctgctgttcaacctgcgggaccccaggaacctggacttgtttctcaaagtggttcatggagatgtcaccccctacgacctggtgcggatgagctcgatgcagctggccccccaggagctggcccgctggcgggaccaggaggagaaaaggggcctgaatatcattgagcagcaacagaaggagccgtgcagacttccagcctccaaaatgacccacaagggcgaagtggagattcagcgggacatggaccagacactgaccctggaggatctgggaccgcagatgttcatggactgcagcccacaggccctgcccatcgcatcagaggacaccacggggcagcatgaccaccacttcttagaccccaactgccacatctgcaaggactgggagccctcgaatgagctgctaggctccttcgaagccgccaagagctgcggggacaatatcttccagaaagccctaagccaaactcctatgcctgctccagagatgcccaaaaccagggagttgtctcccacggaaccacaggacagggtccctccatctgggctccatgtgcctgctgcacccacaaaggccctgccctgcctgccaccctgggaaggtgttctggacatgttctccatcaagcggttccgggccagggcccagctggtctcgggacacagctgtcggcttgtccaggctctgcccaccgtgatccgctcggcaggctgcatcccctccaacattgtctgggaccttctggccagcatctgcccagccaaggccaaggacgtctgcgtggtcagactgtgcccacatggggcccgggacacccagaactgccgcctgctctactcatacctcaatgataggcagcgccacgggctggcctctgtggagcacatggggatggtcctgctgcccctgcctgccttccagcccctgcccaccaggctgcgccctttggggggcccaggtctggaggtcactcactcaagtctgttgctggctgtgctgctccccaaggaagggcttccagacacagcagggtccagcccctggttggggaaggttcaaaagatggtctccttcaacagtaaggtggagaagagatactatcagccagatgacaggaggccgaatgtgcccctgaagggcacccctcccccaggaggtgcctggcagcagagccagggcaggggcagtatagctccaaggggaatctctgcttggcagaggccccccagaggcagggggaggctctggccagagcctgaaaactggcagcatcctgggcgagggcagtggcccccagagccaggcttgcgccagtcccagcatccctattcagtagcaccagctggtcatggctttggccgtggccagcacttccacagggactcctgtccccaccaagccctgctccggcacctcgaatccctggcgaccatgagtcaccagctccaagccttactgtgcccccagaccaagagctccatcccccgccctctgcagcgtttgtctagcgcccttgcagctccagagccccctggcccagcccgtgactcctctttggggcctacagatgaagctggctctgagtgtcccttccctagaaaggcctga

SEQ ID NO: 9108 - DNA, 677 bp, synthetic construct
  misc_feature 1..677: note = Synthetic polypeptide
  source 1..677: mol_type = other DNA
cgtgagccagagacggggcacaggctgccttcgggagctcccagacccagtgctgagtgaggaggtggtggagggcattgctgctggcattgaggcagccctctgggacctgacacaaggcaccaatggccggtacaagaccaagtatcgcagcctgctgttcaacctgcgggaccccaggaacctggacttgtttctcaaagtggttcatggagatgtcaccccctacgacctggtgcggatgagctcgatgcagctggccccccaggagctggcccgctggcgggaccaggaggagaaaaggggaccgcagatgttcatggactgcagcccacaggccctgcccatcgcatcagaggacaccacggggcagcatgaccaccacttcttagaccccaactgccacatctgcaaggactgggagccctcgaatgagctgctaggctccttcgaagccgccaagagctgcggggacaatatcttccagaaagccctaagccaaactcctatgcctgctccagagatgcccaaaaccagggagttgtctcccacggaaccacaggacagggtccctccatctgggctccatgtgcctgctgcacccacaaaggccctgccctgcctgccaccctgggaaggtgttctggacatgttctccatcaagcggttccgggcca

SEQ ID NO: 9109 - DNA, 872 bp, synthetic construct
  misc_feature 1..872: note = Synthetic polypeptide
  source 1..872: mol_type = other DNA
aggggctgtcataggagctcctcattaagctgaagactcaaacatccacggagtacttcctggaggcctgttctcgagaggagcgggatgcctgggcctttgagatcaccggggctattcatgcagggcagccggggaaggtccagcagctgcacagcctgagaaactccttcaagctgcccccgcacatcagcctgcatcgcattgtggacaagatgcacgatagcaacaccggaatccgttcaagccccaacatggagcagggaagcacctataaaaagaccttcctcggctcctccctggtggactggctcatctccaacagcttcacggccagccgtctggaggcggtgaccctggcctccatgctcatggaggagaacttcctcaggcctgtgggtgtccgaagcatgggagccattcgctctggggatctggccgagcagttcctggatgactccacagccctgtacacttttgctgagagctacaaaaagaagataagccccaaggaagaaattagcctgagcactgtggagttaagtggcacggtggtgaaacaaggctacctggccaagcagggacacaagaggaaaaactggaaggtgcgtcgctttgttctaaggaaggatccagctttcctgcattactatgacccttccaaagaagagaacaggccagtgggtgggttttctcttcgtggttcactcgtgtctgctctggaagataatggcgttcccactggggttaaagggaatgtccagggaaacctcttcaaagtgattactaaggatgacacacactattacattcaggccagcagcaaggctgagcgagccgagtggattgaagctatcaaaaagctaacatga

SEQ ID NO: 9110 - DNA, 242 bp, synthetic construct
  misc_feature 1..242: note = Synthetic polypeptide
  source 1..242: mol_type = other DNA
aggggctgtcataggagctcctcattaagctgaagactcaaacatccacggagtacttcctggaggcctgttctcgagaggagcgggatgcctgggcctttgagatcaccggggctattcatgcagggcagccggggaaggtccagcagctgcacagcctgagaaactccttcaagctgcccccgcacatcagcctgcaggacacaagaggaaaaactggaaggtgcgtcgctttgttctaa

SEQ ID NO: 9111 - DNA, 620 bp, synthetic construct
  misc_feature 1..620: note = Synthetic polypeptide
  source 1..620: mol_type = other DNA
aggggctgtcataggagctcctcattaagctgaagactcaaacatccacggagtacttcctggaggcctgttctcgagaggagcgggatgcctgggcctttgagatcaccggggctattcatgcagggcagccggggaaggtccagcagctgcacagcctgagaaactccttcaagctgcccccgcacatcagcctgcatcgcattgtggacaagatgcacgatagcaacaccggaatccgttcaagccccaacatggagcagggaagcacctataaaaagaccttcctcggctcctccctggtggactggctcatctccaacagcttcacggccagccgtctggaggcggtgaccctggcctccatgctcatggaggagaacttcctcaggcctgtgggtgtccgaagcatgggagccattcgctctggggatctggccgagcagttcctggatgactccacagccctgtacacttttggacacaagaggaaaaactggaaggtgcgtcgctttgttctaaggaaggatccagctttcctgcattactatgacccttccaaagaagagaacaggccagtgggtgggttttctcttcgtggttcactcgtgtctgctctg

SEQ ID NO: 9112 - DNA, 803 bp, synthetic construct
  misc_feature 1..803: note = Synthetic polypeptide
  source 1..803: mol_type = other DNA
cagggccaagattaacacccctcctgcaggaggaagacagccaccagcggctgctcatggggctgatggtgtctgagctaaaagaccattttttgagacacctacagggtgtagaaaagaagaaaattgaacagatggttctggactacatttcaaaactgctggatctcatttgccacatcgtagaaaccaattggaggaaacataatcttcattcctgggttctccacttcaatagtcgtggcagtgctgctgaatttgcagtttttcacatcatgaccaggattctggaagctacaaacagtttgtttttacctctgcctcctggttttcatactctgcacaccatcctcggggtccagtgtctccctttgcataacctgctgcattgcattgacagtggagtgttgcttctcactgaaacagctgtcataaggctcatgaaagatctggataatacagagaaaaatgaaaaactgaaattcagtatcattgtgcggcttcctccgcttattgggcagaagatttgtagactttgggatcatcctatgagttctaacatcatttcgcggaaccacgtgacgcgactgcttcagaactataagaaacagcctcggaattctatgattaacaagtcatcgttcagtgtagaatttctgcctctgaactacttcattgaaattctgacagatatagagtcctccaatcaagccctgtatccttttgaaggacatgacaatgtggatgcagaatttgtagaggaagcagctctgaaacacaccgcgatgcttttaggcttatga

SEQ ID NO: 9113 - DNA, 347 bp, synthetic construct
  misc_feature 1..347: note = Synthetic polypeptide
  source 1..347: mol_type = other DNA
cagggccaagattaacacccctcctgcaggaggaagacagccaccagcggctgctcatggggctgctggatctcatttgccacatcgtagaaaccaattggaggaaacataatcttcattcctgggttctccacttcaatagtcgtggcagtgctgctgaatttgcagtttttcacatcatgaccaggattctggaagctacaaacagtttgtttttacctctgcctcctggttttcatactctgcacaccatcctcggggtccagtgtctccctttgcataacctgctgcattgcattgacagtggagtgttgcttctcactgaaacagctgtcataaggctcatg

SEQ ID NO: 9114 - DNA, 470 bp, synthetic construct
  misc_feature 1..470: note = Synthetic polypeptide
  source 1..470: mol_type = other DNA
ggttgctgtgagaattaaatgagaaaagaaaactccttccagacactattttggagaagttaaccacagcttcacagactaacatcaagaaatcgccaggaaaggtgaaagaagttaatttgcaaaagaaaaatgaagactgtgaaaaaggaaatgactccaagaaagttaaagtacaaaaagtacagtctgtcagccagaataaaagctacttggccgtaaggctaaaagaccaagatctgagagattcaaggcaacaagcagcacaagccttcatacataattcattatatgggccaggaaccaacaggactactgtaaataagttcctgtctcttgccaacaagaggttaccagtgaaaagagctgctgtccagtttttgaataatgcttggggaatccaaaaaaaacaaaatgccaagaggtttaaaagacggtggatggtcagaaagatgaaaactaagaagtaa

SEQ ID NO: 9115 - DNA, 134 bp, synthetic construct
  misc_feature 1..134: note = Synthetic polypeptide
  source 1..134: mol_type = other DNA
ggttgctgtgagaattaaatgagaaaagaaaactccttccagacactattttggagaagttaaccacagcttcacagactaacatcaagaaatcgccaggaaaggtgaaagaaggtatgactattctaatttaa

SEQ ID NO: 9116 - DNA, 154 bp, synthetic construct
  misc_feature 1..154: note = Synthetic polypeptide
  source 1..154: mol_type = other DNA
tggtggtgctgattactatgattacggacatggactcagtgaggagacttatgattcctacgggcaagaagagtggactaactcaagacacaaggcaccttcagcgaggacagcaaagggcgtctacagagaccagccatatggcagatactga

SEQ ID NO: 9117 - DNA, 12 bp, synthetic construct
  misc_feature 1..12: note = Synthetic polypeptide
  source 1..12: mol_type = other DNA
tggtggtgctga

SEQ ID NO: 9118 - DNA, 786 bp, synthetic construct
  misc_feature 1..786: note = Synthetic polypeptide
  source 1..786: mol_type = other DNA
cggtgcttcttacctgaggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcattcgcaacgacaggcgcctcctctgccaaccggtttgtcagcatcggaccccgggacggcaactttctga

SEQ ID NO: 9119 - DNA, 969 bp, synthetic construct
  misc_feature 1..969: note = Synthetic polypeptide
  source 1..969: mol_type = other DNA
cggtgcttcttacctgaggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcccaacggtagcggccagggcaaagtcccggggtcatttttgctaccgccgccgcctccagtggccagacctgtgccccttcctatgcctgattccaaatccaccagcactgccccagacggcgccgccttgactcctccatcaccttcattcgcaacgacaggcgcctcctctgccaaccggtttgtcagcatcggaccccgggacggcaactttctgaacatcccacagcagtctcagtcctggttcctctga

SEQ ID NO: 9120 - DNA, 91 bp, synthetic construct
  misc_feature 1..91: note = Synthetic polypeptide
  source 1..91: mol_type = other DNA
cggtgcttcttacctgaggaatccggacaatcagatagttcaaaccagcaaggagatgcggacatcaaaccactgcccaacgggcacttaa

SEQ ID NO: 9121 - DNA, 663 bp, synthetic construct
  misc_feature 1..663: note = Synthetic polypeptide
  source 1..663: mol_type = other DNA
cggtgcttcttacctgaggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcattcgcaacgacaggcgcctcctctgccaaccggtttgtcagcatcggaccccgggacggcaactttctga

SEQ ID NO: 9122 - DNA, 846 bp, synthetic construct
  misc_feature 1..846: note = Synthetic polypeptide
  source 1..846: mol_type = other DNA
cggtgcttcttacctgaggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcccaacggtagcggccagggcaaagtcccggggtcatttttgctaccgccgccgcctccagtggccagacctgtgccccttcctatgcctgattccaaatccaccagcactgccccagacggcgccgccttgactcctccatcaccttcattcgcaacgacaggcgcctcctctgccaaccggtttgtcagcatcggaccccgggacggcaactttctgaacatcccacagcagtctcagtcctggttcctctga

SEQ ID NO: 9123 - DNA, 839 bp, synthetic construct
  misc_feature 1..839: note = Synthetic polypeptide
  source 1..839: mol_type = other DNA
gaaagacgtctgggttctggtcctgactctgttacccttggtacgtacctgtgggcatcatgttccttgttggaagcaagatcgtggaaatgaaagacatcatcgtgctggtgaccagcctggggaaatacatcttcgcatctatattgggccatgttattcatggaggaattgttctgccacttatttattttgttttcacacgaaaaaacccattcagattcctcctgggcctcctcgccccatttgcgacagcatttgctacctgctccagctcagcgacccttccctctatgatgaagtgcattgaagagaacaatggtgtggacaagaggatcagcaggtttattctccccatcggggccaccgtgaacatggacggagcagccatcttccagtgtgtggccgcggtgttcattgcgcaactcaacaacgtagagctcaacgcaggacagattttcaccattctagtgactgccacagcgtccagtgttggagcagcaggcgtgccagctggaggggtcctcaccattgccattatcctggaggccattgggctgcctactcatgacctgcctctgatcctggctgtggactggattgtggaccggaccaccacggtggtgaatgtggaaggggatgccctgggtgcaggcattctccaccacctgaatcagaaggcaacaaagaaaggcgagcaggaacttgctgaggtgaaagtggaagccatccccaactgcaagtctgaggaggagacatcgcccctggtgacacaccagaaccccgctggccccgtggccagtgccccagaactggaatccaaggagtcggttctgtga

SEQ ID NO: 9124 - DNA, 1464 bp, synthetic construct
  misc_feature 1..1464: note = Synthetic polypeptide
  source 1..1464: mol_type = other DNA
cacagaaggaccaccaagtgaagaggcagcaaatgggcagccctctgccagccgaggagacaggcctcagaggaaacccaaccctgctgacatcttgatcgtggacttccagtctctagaacggctctcccacctgtcaccctggcccttctctgcttggatggtgtcttcctctcctcagccgagaatgacttcgtccaccggatccaggaggaactggaccgctttctgctgcagaagcagctgtcaaaggttcttcttttccccccactctccagtcgcctccggtacctgatccatagaacagcagagaattttgatctcttgagcagcttctccgttggggagggctggaagaggaggacggtcatctgtcaccaggacatcagggtacccagttcggatggcctctctggcccctgccgcgctcctgcctcctgccccagcaggtaccacggtcctcggcccatctccaaccaaggagcagctgcggttccccgaggtgcccgggctggccggtggtatcgtggacgcaagcctgaccagcctttgtatgtgccccgggtgctgcgcaggcaggaagaatgggggctgacctctacctcggtgctcaagagagaggccccagctggcagggacccagaagagcctggagatgttggtgctggagaccccaactctgatcagggactccctgtgctgatgactcagggaacagaggacctaaagggcccaggacaaaggtgtgagaatgagccactgctggaccctgttggccctgagcctctggggcctgagagtcagtcagggaagggagacatggtggagatggccacacggtttgggtccaccctgcagctagacctggaaaaggggaaggagagtctgttggagaagaggctggtggcagaggaggaagaggacgaagaggaggtggaagaggatggccccagcagctgctcggaggacgattacagtgagctgctgcaggagatcacagacaacctgacgaagaaggagattcagatagagaagatccatttggacacatcctccttcgtggaggagctgcctggagagaaggaccttgcccacgtggtagagatctatgactttgaaccagcgctcaagacggaggacctgctggcaacgttttctgagttccaagagaaggggttcaggattcagtgggtggatgatactcacgcactcggcatctttccctgcctggcctcagctgcggaagccctgacccgggagttctcggtgctcaagatccggcccctcacacagggaaccaagcagtcaaagctcaaagccttgcagaggccaaaactcctgcgtctggtgaaggagaggccacagacaaatgcgactgtggcccggcggctggtggcccgggccctgggactccaacacaaaaagaaagagcggcctgctgtccggggtccgctgccgccctga

SEQ ID NO: 9125 - DNA, 477 bp, synthetic construct; identical to SEQ ID NO: 8538
  misc_feature 1..477: note = Synthetic polypeptide
  source 1..477: mol_type = other DNA

SEQ ID NO: 9126 - DNA, 357 bp, synthetic construct
  misc_feature 1..357: note = Synthetic polypeptide
  source 1..357: mol_type = other DNA
ggtttctgacctttattctcccggctcggcctcccttccccacctcgcgtctcgccagcttccctcatgtccttccttcccccgggcatcttcgttttctgcacagaaccacccccgccgcccgactttcttccccccagttactcatcgcgatatctatgttttaatgtctgtgttctctactaagattgttagctccataagacttgagactatgtctgttttggtctccatcatctaaccagcacagtacctggtacataattggcattcagatctgcagaaaaggctgtcttggaacaatttggattccctttaactggaacagaggtagattcttcaagtttacactcctag

SEQ ID NO: 9127 - DNA, 1218 bp, synthetic construct
  misc_feature 1..1218: note = Synthetic polypeptide
  source 1..1218: mol_type = other DNA
ggtttctgacctttattctcccggctcggcctcccttccccacctcgcgtctcgccagcttccctcatgtccttccttcccccgggcatcttcgttttctgcacagaaccacccccgccgcccgactttcttccccccagttactcatcgcgatatctatgttttaatgtctgtgttctctactaagattgttagctccataagacttgagactatgtctgttttggtctccatcatctaaccagcacagtacctggtacataattggcattcagatctgcagaaaaggctgtcttggaacaatttggattccctttaactggaacagaggcaaggtgttacactaatcacgctttgtcttatgatcaggcaaagcgggtgcctagatgggttcttgaacatatttccaaaagcaagataatgggtgatgcagacagaaagcattgtaaatttaagcctgatcccaatatccctccaaccttcagtgccttcaatgaagattatgttggaagtgggtggtcacgaggacacatggctccagcaggaaataacaaattttcaagtaaagccatggctgaaaccttttacctttctaacattgtgcctcaggattttgataataattctggatattggaacagaatagaaatgtactgtcgagagctgacagaaaggtttgaagatgtttgggtggtatctgggcctttgaccttacctcagactagaggcgatggaaagaaaatagttagttaccaggtgattggcgaggacaacgtggcagtcccctcacacctttataaggtaatcctggcccgcagaagctcagtatctaccgaaccactggcgctaggggcctttgtggtacccaatgaagccatcggcttccagccccagttaactgaattccaagtgagcctccaggacctagagaagttgtcaggactggtgttttttcctcatttggatagaactagtgatatccggaatatctgctctgtggacacctgtaagctcctggatttccaggagttcaccttgtacttgagtacaagaaagattgaaggagcccgatcagtgctcagactggaaaagatcatggaaaacttgaagaatgcagagattgaaccagatgattactttatgagtcgctatgagaagaagctagaagaactcaaagctaaggagcagtcaggaacccagataagaaagccatcctag

SEQ ID NO: 9128 - DNA, 435 bp, synthetic construct
  misc_feature 1..435: note = Synthetic polypeptide
  source 1..435: mol_type = other DNA
ggtttctgacctttattctcccggctcggcctcccttccccacctcgcgtctcgccagcttccctcatgtccttccttcccccgggcatcttcgttttctgcacagaaccacccccgccgcccgactttcttccccccagttactcatcgcgatatctatgttttaatgtctgtgttctctactaagattgttagctccataagacttgagactatgtctgttttggtctccatcatctaaccagcacagtacctggtacataattggcattcagatctgcagaaaaggctgtcttggaacaatttggattccctttaactggaacagaggcaaggtgttacactaatcacgctttgtcttatgatcaggcaaagcgggtgcctagatgggttcttgaacatatttccaaaagcaagataatgggctggtcttga

SEQ ID NO: 9129 - DNA, 552 bp, synthetic construct
  misc_feature 1..552: note = Synthetic polypeptide
  source 1..552: mol_type = other DNA
ggtttctgacctttattctcccggctcggcctcccttccccacctcgcgtctcgccagcttccctcatgtccttccttcccccgggcatcttcgttttctgcacagaaccacccccgccgcccgactttcttccccccagttactcatcgcgatatctatgttttaatgtctgtgttctctactaagattgttagctccataagacttgagactatgtctgttttggtctccatcatctaaccagcacagtacctggtacataattggcattcagatctgcagaaaaggctgtcttggaacaatttggattccctttaactggaacagaggtgatgcagacagaaagcattgtaaatttaagcctgatcccaatatccctccaaccttcagtgccttcaatgaagattatgttggaagtgggtggtcacgaggacacatggctccagcaggaaataacaaattttcaagtaaagccatggctgaaaccttttacctttctaacattgtgcctcaggattttgataataattctggatattggaacagaatag

SEQ ID NO: 9130 - DNA, 543 bp, synthetic construct
  misc_feature 1..543: note = Synthetic polypeptide
  source 1..543: mol_type = other DNA
ggtttctgacctttattctcccggctcggcctcccttccccacctcgcgtctcgccagcttccctcatgtccttccttcccccgggcatcttcgttttctgcacagaaccacccccgccgcccgactttcttccccccagttactcatcgcgatatctatgttttaatgtctgtgttctctactaagattgttagctccataagacttgagactatgtctgttttggtctccatcatctaaccagcacagtacctggtacataattggcattcagatctgcagaaaaggctgtcttggaacaatttggattccctttaactggaacagaggcaaggtgttacactaatcacgctttgtcttatgatcaggcaaagcgggtgcctagatgggttcttgaacatatttccaaaagcaagataatgggtagattcttcaagtttacactcctagcatcattgtttcttctctctctcaaccttcacctatggctggtcttgaatttctgggttcaagtgaccctcctgcctcagcctcctgagtag

SEQ ID NO: 9131 - DNA, 786 bp, synthetic construct
  misc_feature 1..786: note = Synthetic polypeptide
  source 1..786: mol_type = other DNA
ggtttctgacctttattctcccggctcggcctcccttccccacctcgcgtctcgccagcttccctcatgtccttccttcccccgggcatcttcgttttctgcacagaaccacccccgccgcccgactttcttccccccagttactcatcgcgatatctatgttttaatgtctgtgttctctactaagattgttagctccataagacttgagactatgtctgttttggtctccatcatctaaccagcacagtacctggtacataattggcattcagatctgcagaaaaggctgtcttggaacaatttggattccctttaactggaacagaggcaaggtgttacactaatcacgctttgtcttatgatcaggcaaagcgggtgcctagatgggttcttgaacatatttccaaaagcaagataatgggtgatgcagacagaaagcattgtaaatttaagcctgatcccaatatccctccaaccttcagtgccttcaatgaagattatgttggaagtgggtggtcacgaggacacatggctccagcaggaaataacaaattttcaagtaaagccatggctgaaaccttttacctttctaacattgtgcctcaggattttgataataattctggatattggaacagaatagaaatgtactgtcgagagctgacagaaaggtttgaagatgtttgggtggtatctgggcctttgaccttacctcagactagaggcgatggaaagaaaatagttagttaccagagctgggagtacccaagcctgcagttttga

SEQ ID NO: 9132 - DNA, 177 bp, synthetic construct
  misc_feature 1..177: note = Synthetic polypeptide
  source 1..177: mol_type = other DNA
cagtggttagcaagctgtggtcctatggaccatatcctctgctgcttgttttatgtacctgtgtggtctaagctggaatctggtcaccttccatccatgcaacaacttgttcaaattcttgacaatgaaatgaagctcaatgtgcatatggattcaatcccacaccatcgatcatag

SEQ ID NO: 9133 - DNA, 482 bp, synthetic construct
  misc_feature 1..482: note = Synthetic polypeptide
  source 1..482: mol_type = other DNA
tcattgtatatgctcatgacaacctgggtttttcttcatgacaactgtcattgcatatagttttgtgccagaataatatccataatcaggcccatatgaacagagtggtcacacacgagcttattcatgcatttgatcattgtcgtgcccatgtcgactggttcaccaacatcagacatttggcgtgctcagaggttcgagctgctaaccttagtggagactgctcacttgtcaatgaaatattcaggttacattttggattaaaacaacaccaccagacttgtgtgcgagacagagccactctttctatcctggctgttaggaatatcagcaaagaagtagctaaaaaggctgttgatgaagtttttgaatcttgtttcaatgaccatgaaccttttggaaggatcccacataacaagacttatgcaagatatgctcacagagactttgaaaaccgtgatcggtattattcaaatatatga

SEQ ID NO: 9134 - DNA, 76 bp, synthetic construct
  misc_feature 1..76: note = Synthetic polypeptide
  source 1..76: mol_type = other DNA
tcattgtatatgctcatgacaacctgggtttttcttcatgacaactgtcattgcatatagttttgtgccagaataa

SEQ ID NO: 9135 - DNA, 861 bp, synthetic construct; identical to SEQ ID NO: 604
  misc_feature 1..861: note = Synthetic polypeptide
  source 1..861: mol_type = other DNA

SEQ ID NO: 9136 - DNA, 1282 bp, synthetic construct
  misc_feature 1..1282: note = Synthetic polypeptide
  source 1..1282: mol_type = other DNA
aactcagtttgttatcttcccatccaatctgtttatctttctaaagtttctcttttagtgaatggtaccactcatttattcacccaagttggaatcttggaatcatcttaactcctttcttccttgccttctatatcaaataccagaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctag

SEQ ID NO: 9137 - DNA, 177 bp, synthetic construct
  misc_feature 1..177: note = Synthetic polypeptide
  source 1..177: mol_type = other DNA
aactcagtttgttatcttcccatccaatctgtttatctttctaaagtttctcttttagtgaatggtaccactcatttattcacccaagttggaatcttggaatcatcttaactcctttcttccttgccttctatatcaaataccagaatcatcggactcaggtacatctgtgagtga

SEQ ID NO: 9138 - DNA, 577 bp, synthetic construct
  misc_feature 1..577: note = Synthetic polypeptide
  source 1..577: mol_type = other DNA
aactcagtttgttatcttcccatccaatctgtttatctttctaaagtttctcttttagtgaatggtaccactcatttattcacccaagttggaatcttggaatcatcttaactcctttcttccttgccttctatatcaaataccagaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaa

SEQ ID NO: 9139 - DNA, 574 bp, synthetic construct
  misc_feature 1..574: note = Synthetic polypeptide
  source 1..574: mol_type = other DNA
aactcagtttgttatcttcccatccaatctgtttatctttctaaagtttctcttttagtgaatggtaccactcatttattcacccaagttggaatcttggaatcatcttaactcctttcttccttgccttctatatcaaataccagaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtatatcaagttactgtgtatcaggcaggggagagtgatacagattcatttgaagaagatcctgaaatttccttagctgactattgg

SEQ ID NO: 9140 - DNA, 400 bp, synthetic construct
  misc_feature 1..400: note = Synthetic polypeptide
  source 1..400: mol_type = other DNA
aactcagtttgttatcttcccatccaatctgtttatctttctaaagtttctcttttagtgaatggtaccactcatttattcacccaagttggaatcttggaatcatcttaactcctttcttccttgccttctatatcaaataccagaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggct

SEQ ID NO: 9141 - DNA, 173 bp, synthetic construct
  misc_feature 1..173: note = Synthetic polypeptide
  source 1..173: mol_type = other DNA
aactcagtttgttatcttcccatccaatctgtttatctttctaaagtttctcttttagtgaatggtaccactcatttattcacccaagttggaatcttggaatcatcttaactcctttcttccttgccttctatatcaaataccagaatcatcggactcaggtacatctgtga

SEQ ID NO: 9142 - DNA, 319 bp, synthetic construct
  misc_feature 1..319: note = Synthetic polypeptide
  source 1..319: mol_type = other DNA
aactcagtttgttatcttcccatccaatctgtttatctttctaaagtttctcttttagtgaatggtaccactcatttattcacccaagttggaatcttggaatcatcttaactcctttcttccttgccttctatatcaaataccagaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacaggatcttga

SEQ ID NO: 9143 - DNA, 805 bp, synthetic construct
  misc_feature 1..805: note = Synthetic polypeptide
  source 1..805: mol_type = other DNA
cgggagggcgagcgagagagcaagcaggcagcaggctgccggcgggcgggcggacggcacagagggagggagcgagcgagcagttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggaaccaaggtgtttgtgatgcccaatgggatgctgaaaagcaaccagcagctggtggacattattgagaaagtgaaacctgagatccggctgttgattgagaaatgtaacacggtcaaaatgtgggtacagctcctgattcccaggatagaagatggaaacaactttggggtgtccattcaggaggaaacagttgcagagctaagaactgttgagagtgaagctgcatcttatctggaccagatttctagatattatattacaagagccaaattggtttctaaaatagctaaatatccccatgtggaggactatcgccgcaccgtgacagagattgatgagaaagaatatatcagccttcggctcatcatatcagagctgaggaatcaatatgtcactctacatgacatgatcctgaaaaatatcgagaagatcaaacggccccggagcagcaatgcagagactctgtactga

SEQ ID NO: 9144 - DNA, 578 bp, synthetic construct
  misc_feature 1..578: note = Synthetic polypeptide
  source 1..578: mol_type = other DNA
cgggagggcgagcgagagagcaagcaggcagcaggctgccggcgggcgggcggacggcacagagggagggagcgagcgagcagttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggaaccaaggtgtttgtgatgcccaatgggatgctgaaaagcaaccagcagctggtggacattattgagaaagtgaaacctgagatccggctgttgattgagaaatgtaacacggaggaaacagttgcagagctaagaactgttgagagtgaagctgcatcttatctggaccagatttctagatattatattacaagagccaaattggtttctaaaatagctaaatatccccatgtggaggactatc

SEQ ID NO: 9145 - DNA, 433 bp, synthetic construct
  misc_feature 1..433: note = Synthetic polypeptide
  source 1..433: mol_type = other DNA
cgggagggcgagcgagagagcaagcaggcagcaggctgccggcgggcgggcggacggcacagagggagggagcgagcgagcagttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggtcaaaatgtgggtacagctcctgattcccaggatagaagatggaaacaactttggggtgtccattcaggaggaaacagttgcagagctaagaactgttga

SEQ ID NO: 9146 - DNA, 844 bp, synthetic construct
  misc_feature 1..844: note = Synthetic polypeptide
  source 1..844: mol_type = other DNA
cgggagggcgagcgagagagcaagcaggcagcaggctgccggcgggcgggcggacggcacagagggagggagcgagcgagcagttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggaaccaaggtgtttgtgatgcccaatgggatgctgaaaagcaaccagcagctggtggacattattgagaaagtgaaacctgagatccggctgttgattgagaaatgtaacacgccttcaggcaaaggtcctcatatatgttttgacctccaggtcaaaatgtgggtacagctcctgattcccaggatagaagatggaaacaactttggggtgtccattcaggaggaaacagttgcagagctaagaactgttgagagtgaagctgcatcttatctggaccagatttctagatattatattacaagagccaaattggtttctaaaatagctaaatatccccatgtggaggactatcgccgcaccgtgacagagattgatgagaaagaatatatcagccttcggctcatcatatcagagctgaggaatcaatatgtcactctacatgacatgatcctgaaaaatatcgagaagatcaaacggccccggagcagcaatgcagagactctgtactga

SEQ ID NO: 9147 - DNA, 637 bp, synthetic construct
  misc_feature 1..637: note = Synthetic polypeptide
  source 1..637: mol_type = other DNA
cgggagggcgagcgagagagcaagcaggcagcaggctgccggcgggcgggcggacggcacagagggagggagcgagcgagcagttgattctttcagggagcggatcacaagtgagcccacttataagaagcgaaggttggatgagtgtgaagaagccttccaaggaaccaaggtgtttgtgatgcccaatgggatgctgaaaagcaaccagcagctggtggacattattgagaaagtgaaacctgagatccggctgttgattgagaaatgtaacacggtcaaaatgtgggtacagctcctgattcccaggatagaagatggaaacaactttggggtgtccattcaggaggaaacagttgcagagctaagaactgttgagagtgaagctgcatcttatctggaccagatttctagatattatattacaagagccaaattggtttctaaaatagctaaatatccccatgtggaggactatcgccgcaccgtgacagagattgatgagaaagaatatatcagccttcggctcatcatatcagagctgaggaatcaatatgtcactctacatgacatgatcctgaaaaatatcgagaagatcaaacggccccggagcagcaatgcagagactctgtactga

SEQ ID NO: 9148 - DNA, 1166 bp, synthetic construct
  misc_feature 1..1166: note = Synthetic polypeptide
  source 1..1166: mol_type = other DNA
attaaaggcaaagaaaggctgtggaaacattccaaatgaaaggaggctattaagtaacagctttatgcaatttctagtcctacactgtatcctgtgctgcagggacaaaaatgctgtacggaacaagagatggagatggacacatggatcatttactgccaggctgtgaagataaaaattgccaaaagagtaccatctacttagtgagatctgggatgaagcagtgggttccagtcctacaagatttcagcaataagggcacactctggggctttgtgccatttgtggatgaacagcaaccaactgaaataccaattccaattacccttcatattggagactacaatatggatggctatccagacgctctggtcatactaaagaacacatctggaagcaaccagcaggcctttttactggagaacgtcccttgtaataatgcaagctgtgaagaggcgcgtcgaatgtttaaagtctactgggagctgacagacctaaatcaaattaaggatgccatggttgccaccttctttgacatttacgaagatggaatcttggacattgtagtgctaagtaaaggatatacaaagaatgattttgccattcatacactaaaaaataactttgaagcagatgcttattttgttaaagttattgttcttagtggtctgtgttctaatgactgtcctcgtaagataacaccctttggagtgaatcaacctggaccttatatcatgtatacaactgtagatgcaaatgggtatctgaaaaatggatcagctggccaactcagccaatccgcacatttagctctccaactaccatacaacgtgcttggtttaggtcggagcgcaaattttcttgaccatctctacgttggtattccccgtccatctggagaaaaatctatacgaaaacaagagtggactgcaatcattccaaattcccagctaattgtcattccataccctcacaatgtccctcgaagttggagtgccaaactgtatcttacaccaagtaatattgttctgcttactgctatagctctcatcggtgtctgtgttttcatcttggcaataattggcattttacattggcaggaaaagaaagcagatgatagagaaaaacgacaagaagcccaccggtttcattttgatgctatgtga

SEQ ID NO: 9149 - DNA, 1061 bp, synthetic construct
  misc_feature 1..1061: note = Synthetic polypeptide
  source 1..1061: mol_type = other DNA
attaaaggcaaagaaaggctgtggaaacattccaaatgaaaggaggctattaagtaacagctttatgcaatttctagtcctacactgtatcctgtgctgcagggacaaaaatgctgtacggaacaagagatggagatggacacatggatcatttactgccaggctgtgaagataaaaattgccaaaagagtaccatctacttagtgagatctgggatgaagcagtgggttccagtcctacaagatttcagcaataagggcacactctggggctttgtgccatttgtggatgaacagcaaccaactgaaataccaattccaattacccttcatattggagactacaatatggatggctatccagacgctctggtcatactaaagaacacatctggaagcaaccagcaggcctttttactggagaacgtcccttgtaataatgcaagctgtgaagaggcgcgtcgaatgtttaaagtctactgggagctgacagacctaaatcaaattaaggatgccatggttgccaccttctttgacatttacgaagatggaatcttggacattgtagtgctaagtaaaggatatacaaagaatgattttgccattcatacactaaaaaataactttgaagcagatgcttattttgttaaagttattgttcttagtggtctgtgttctaatgactgtcctcgtaagataacaccctttggagtgaatcaacctggaccttatatcatgtatacaactgtagatgcaaatgggtatctgaaaaatggatcagctggccaactcagccaatccgcacatttagctctccaactaccatacaacgtgcttggtttaggtcggagcgcaaattttcttgaccatctctacgttggtattccccgtccatctggagaaaaatctatacgaaaacaagagtggactgcaatcattccaaattcccagctaattgtcattccataccctcacaatgtccctcgaagctctcatcggtgtctgtgttttcatcttggcaataattggcattttacattggcaggaaaagaaagcagatga

SEQ ID NO: 9150 - DNA, 621 bp, synthetic construct
  misc_feature 1..621: note = Synthetic polypeptide
  source 1..621: mol_type = other DNA
aatcctttagtcccatcagatttacttttagacatatcccagatccagataatttgcaccatcttcactgcaactctcttccaggtcctggaaggtaacagtcttcttgttgatcctccagcctatgttcttgtgcctggaatctactctctgtgtggaagaactccgcaaaacagattttgtcatgcccccgttgtcaaccttccattggcttccaaccactacacaatgacacccaaactccttgtttgagtctggaatgccccgaatgatctgccttcctcatcttttccatgcctctctttattcacccaatagcagttacattgccctttttctattcttggacacgttaagcttgtttctgccttaggctgtctgtactggccacttcctctgcgtggaatggttcttcctggatctcacatggcttgctgtttctgcttattcatgactcagctcagattccccaccaaaccccagccaggctttccctgtcctctctgcaagtggcccttactccagctccagaaacatgacaaggaggactttcctgcctcttggagatcagaggaggaaatggcagcagaagccgcagctctgcgggtctactttcagtga

SEQ ID NO: 9151 - DNA, 152 bp, synthetic construct
  misc_feature 1..152: note = Synthetic polypeptide
  source 1..152: mol_type = other DNA
ttgctgggagtggtggcgtgcccctgtaatcccagctactctggaggctgaggtgggaggatccattgagccttggaggttgtgccacagctctagcctggaccacagagaagccactgaggaacggcctggtgaaggacaagcgcttctga

SEQ ID NO: 9152 - DNA, 1732 bp, synthetic construct
  misc_feature 1..1732: note = Synthetic polypeptide
  source 1..1732: mol_type = other DNA
cagtagttcctccttatccacagttttttgcctccacagttttggttacctgcagcaaactgtggtttgaaaatagacatctgagaaggaaataataagtaaagaacaaggtaatgtaaaggcagcaggagcctctgatgttgttctttacaaaattgacgtccctgccaatagatatgatctcctgtgtctggaaggattggttcgaggacttcaggtcttcaaagaaaggataaaggctccagtgtataaacgggtaatgcctgatggaaaaatccagaaattgattatcacagaagagacagctaagatacgtccttttgcggtagcagcagttctccgtaatataaagtttactaaagatcgatatgacagcttcattgaacttcaggagaaattacatcagaatatttgcaggaaaagagcactggttgccattggtacccatgatttggacactttgtcgggcccatttacttatactgcaaagcgtccttcagatatcaaattcaagcctctaaataagaccaaggagtatacagcctgtgaactgatgaacatatacaagactgacaatcacctgaaacattatttacatatcattgaaaacaaacccctgtatccagttatctatgatagcaatggtgtcgtcctttcaatgcctcccatcatcaatggggatcattccagaataacagtaaatactagaaatatttttattgaatgcacgggaactgactttactaaggcaaaaatagttcttgatattattgtcaccatgttcagtgaatattgtgagaatcaatttacggtcgaagctgctgaagtggtttttcctaatggaaaatcacatacctttccagaattagcttaccgaaaggagatggtgagagctgacctaattaacaaaaaagttggaatcagagaaactccagaaaatcttgccaaacttctgaccaggatgtatttaaaatcagaagtcataggtgatgggaatcagattgagattgaaatccctccaaccagagctgacattatccatgcatgtgatattgtagaagatgcagctattgcttatggatataacaacattcagatgactctcccgaaaacttacaccatagctaatcaatttcctcttaataagctcactgaacttctccgacatgacatggcagccgctggcttcactgaagcacttacctttgccctgtgctcccaagaagatattgctgataaactaggtgtggatatctctgcaacaaaggcagtccacataagtaatcctaaaacagctgaatttcaggtggcacgcactacccttcttcctggcctcctgaagaccatagcagcaaatcgtaagatgccccttccactgaaactgtttgaaatctctgacattgtaataaaagattctaatacagatgtaggtgcaaaaaactacagacatctctgtgctgtttattacaacaagaatcctgggtttgagatcattcatgggctgctggacagaattatgcagttgctcgatgtgcctcctggtgaagacaaggggggatatgtgatcaaagcatcagaagggcctgctttcttccccgggcgatgtgcagagatctttgccaggggtcaaagcgtcgggaagcttggggtccttcatcctgacgttatcaccaaatttgagctgaccatgccctgctcctccctagaaatcaatgttggaccctttttgtga

SEQ ID NO: 9153 - DNA, 1125 bp, synthetic construct
  misc_feature 1..1125: note = Synthetic polypeptide
  source 1..1125: mol_type = other DNA
cctgcttccagcacttctggctaagttgcgccgtgggaaaattgttttgtctgattcagttttctcatcttttaaactggaataatgctacctaatttacagggttgtttgaagaattaaatgaatgcatggagaaatcgacttaaagcctccagagaagtagaatctgtagaccttccacactgccacctgattaaaggaattgaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaa

SEQ ID NO: 9154 - DNA, 720 bp, synthetic construct
  misc_feature 1..720: note = Synthetic polypeptide
  source 1..720: mol_type = other DNA
cctgcttccagcacttctggctaagttgcgccgtgggaaaattgttttgtctgattcagttttctcatcttttaaactggaataatgctacctaatttacagggttgtttgaagaattaaatgaatgcatggagaaatcgacttaaagcctccagagaagtagaatctgtagaccttccacactgccacctgattaaaggaattgaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtatatctatgttgctga

SEQ ID NO: 9155 - DNA, 1089 bp, synthetic construct
  misc_feature 1..1089: note = Synthetic polypeptide
  source 1..1089: mol_type = other DNA
cctgcttccagcacttctggctaagttgcgccgtgggaaaattgttttgtctgattcagttttctcatcttttaaactggaataatgctacctaatttacagggttgtttgaagaattaaatgaatgcatggagaaatcgacttaaagcctccagagaagtagaatctgtagaccttccacactgccacctgattaaaggaattgaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaa

SEQ ID NO: 9156 - DNA, 213 bp, synthetic construct
  misc_feature 1..213: note = Synthetic polypeptide
  source 1..213: mol_type = other DNA
cctgcttccagcacttctggctaagttgcgccgtgggaaaattgttttgtctgattcagttttctcatcttttaaactggaataatgctacctaatttacagggttgtttgaagaattaaatgaatgcatggagaaatcgacttaaagcctccagagaagtagaatctgtagaccttccacactgccacctgattaaaggaattgtgtggtga

SEQ ID NO: 9157 - DNA, 1737 bp, synthetic construct; identical to SEQ ID NO: 905
  misc_feature 1..1737: note = Synthetic polypeptide
  source 1..1737: mol_type = other DNA

SEQ ID NO: 9158 - DNA, 284 bp, synthetic construct; identical to SEQ ID NO: 906
  misc_feature 1..284: note = Synthetic polypeptide
  source 1..284: mol_type = other DNA

SEQ ID NO: 9159 - DNA, 856 bp, synthetic construct; identical to SEQ ID NO: 907
  misc_feature 1..856: note = Synthetic polypeptide
  source 1..856: mol_type = other DNA

SEQ ID NO: 9160 - DNA, 802 bp, synthetic construct; identical to SEQ ID NO: 908
  misc_feature 1..802: note = Synthetic polypeptide
  source 1..802: mol_type = other DNA

SEQ ID NO: 9161 - DNA, 561 bp, synthetic construct; identical to SEQ ID NO: 909
  misc_feature 1..561: note = Synthetic polypeptide
  source 1..561: mol_type = other DNA

SEQ ID NO: 9162 - DNA, 582 bp, synthetic construct; identical to SEQ ID NO: 910
  misc_feature 1..582: note = Synthetic polypeptide
  source 1..582: mol_type = other DNA

SEQ ID NO: 9163 - DNA, 304 bp, synthetic construct; identical to SEQ ID NO: 7490
  misc_feature 1..304: note = Synthetic polypeptide
  source 1..304: mol_type = other DNA

SEQ ID NO: 9164 - DNA, 1148 bp, synthetic construct; identical to SEQ ID NO: 436
  misc_feature 1..1148: note = Synthetic polypeptide
  source 1..1148: mol_type = other DNA

SEQ ID NO: 9165 - DNA, 163 bp, synthetic construct; identical to SEQ ID NO: 480
  misc_feature 1..163: note = Synthetic polypeptide
  source 1..163: mol_type = other DNA

SEQ ID NO: 9166 - DNA, 104 bp, synthetic construct; identical to SEQ ID NO: 481
  misc_feature 1..104: note = Synthetic polypeptide
  source 1..104: mol_type = other DNA

SEQ ID NO: 9167 - DNA, 1854 bp, synthetic construct; identical to SEQ ID NO: 6613
  misc_feature 1..1854: note = Synthetic polypeptide
  source 1..1854: mol_type = other DNA

SEQ ID NO: 9168 - DNA, 2588 bp, synthetic construct; identical to SEQ ID NO: 6741
  misc_feature 1..2588: note = Synthetic polypeptide
  source 1..2588: mol_type = other DNA

SEQ ID NO: 9169 - DNA, 1964 bp, synthetic construct; identical to SEQ ID NO: 6742
  misc_feature 1..1964: note = Synthetic polypeptide
  source 1..1964: mol_type = other DNA

SEQ ID NO: 9170 - DNA, 382 bp, synthetic construct; identical to SEQ ID NO: 434
  misc_feature 1..382: note = Synthetic polypeptide
  source 1..382: mol_type = other DNA

SEQ ID NO: 9171 - DNA, 851 bp, synthetic construct; identical to SEQ ID NO: 8176
  misc_feature 1..851: note = Synthetic polypeptide
  source 1..851: mol_type = other DNA

SEQ ID NO: 9172 - DNA, 1385 bp, synthetic construct; identical to SEQ ID NO: 8177
  misc_feature 1..1385: note = Synthetic polypeptide
  source 1..1385: mol_type = other DNA

SEQ ID NO: 9173 - DNA, 2738 bp, synthetic construct; identical to SEQ ID NO: 8152
  misc_feature 1..2738: note = Synthetic polypeptide
  source 1..2738: mol_type = other DNA

SEQ ID NO: 9174 - DNA, 1331 bp, synthetic construct; identical to SEQ ID NO: 550
  misc_feature 1..1331: note = Synthetic polypeptide
  source 1..1331: mol_type = other DNA

SEQ ID NO: 9175 - DNA, 1028 bp, synthetic construct; identical to SEQ ID NO: 551
  misc_feature 1..1028: note = Synthetic polypeptide
  source 1..1028: mol_type = other DNA

SEQ ID NO: 9176 - DNA, 1295 bp, synthetic construct; identical to SEQ ID NO: 553
  misc_feature 1..1295: note = Synthetic polypeptide
  source 1..1295: mol_type = other DNA

SEQ ID NO: 9177 - DNA, 1322 bp, synthetic construct; identical to SEQ ID NO: 554
  misc_feature 1..1322: note = Synthetic polypeptide
  source 1..1322: mol_type = other DNA

SEQ ID NO: 9178 - DNA, 1013 bp, synthetic construct; identical to SEQ ID NO: 555
  misc_feature 1..1013: note = Synthetic polypeptide
  source 1..1013: mol_type = other DNA

SEQ ID NO: 9179 - DNA, 520 bp, synthetic construct; identical to SEQ ID NO: 6424
  misc_feature 1..520: note = Synthetic polypeptide
  source 1..520: mol_type = other DNA

SEQ ID NO: 9180 - DNA, 2537 bp, synthetic construct; identical to SEQ ID NO: 7357
  misc_feature 1..2537: note = Synthetic polypeptide
  source 1..2537: mol_type = other DNA

SEQ ID NO: 9181 - DNA, 1913 bp, synthetic construct; identical to SEQ ID NO: 7358
  misc_feature 1..1913: note = Synthetic polypeptide
  source 1..1913: mol_type = other DNA

SEQ ID NO: 9182 - DNA, 3021 bp, synthetic construct; identical to SEQ ID NO: 449
  misc_feature 1..3021: note = Synthetic polypeptide
  source 1..3021: mol_type = other DNA

SEQ ID NO: 9183 - DNA, 3075 bp, synthetic construct; identical to SEQ ID NO: 450
  misc_feature 1..3075: note = Synthetic polypeptide
  source 1..3075: mol_type = other DNA

SEQ ID NO: 9184 - DNA, 1143 bp, synthetic construct; identical to SEQ ID NO: 451
  misc_feature 1..1143: note = Synthetic polypeptide
  source 1..1143: mol_type = other DNA

SEQ ID NO: 9185 - DNA, 1629 bp, synthetic construct; identical to SEQ ID NO: 8070
  misc_feature 1..1629: note = Synthetic polypeptide
  source 1..1629: mol_type = other DNA

SEQ ID NO: 9186 - DNA, 1500 bp, synthetic construct; identical to SEQ ID NO: 8071
  misc_feature 1..1500: note = Synthetic polypeptide
  source 1..1500: mol_type = other DNA

SEQ ID NO: 9187 - DNA, 2448 bp, synthetic construct; identical to SEQ ID NO: 6618
  misc_feature 1..2448: note = Synthetic polypeptide
  source 1..2448: mol_type = other DNA

SEQ ID NO: 9188 - DNA, 1543 bp, synthetic construct; identical to SEQ ID NO: 6619
  misc_feature 1..1543: note = Synthetic polypeptide
  source 1..1543: mol_type = other DNA

SEQ ID NO: 9189 - DNA, 1468 bp, synthetic construct; identical to SEQ ID NO: 6620
  misc_feature 1..1468: note = Synthetic polypeptide
  source 1..1468: mol_type = other DNA

SEQ ID NO: 9190 - DNA, 2672 bp, synthetic construct; identical to SEQ ID NO: 6621
  misc_feature 1..2672: note = Synthetic polypeptide
  source 1..2672: mol_type = other DNA

SEQ ID NO: 9191 - DNA, 1767 bp, synthetic construct; identical to SEQ ID NO: 6622
  misc_feature 1..1767: note = Synthetic polypeptide
  source 1..1767: mol_type = other DNA

SEQ ID NO: 9192 - DNA, 1692 bp, synthetic construct; identical to SEQ ID NO: 6623
  misc_feature 1..1692: note = Synthetic polypeptide
  source 1..1692: mol_type = other DNA

SEQ ID NO: 9193 - DNA, 1931 bp, synthetic construct; identical to SEQ ID NO: 7491
  misc_feature 1..1931: note = Synthetic polypeptide
  source 1..1931: mol_type = other DNA

SEQ ID NO: 9194 - DNA, 161 bp, synthetic construct; identical to SEQ ID NO: 7668
  misc_feature 1..161: note = Synthetic polypeptide
  source 1..161: mol_type = other DNA

SEQ ID NO: 9195 - DNA, 178 bp, synthetic construct; identical to SEQ ID NO: 7669
  misc_feature 1..178: note = Synthetic polypeptide
  source 1..178: mol_type = other DNA

SEQ ID NO: 9196 - DNA, 486 bp, synthetic construct; identical to SEQ ID NO: 7296
  misc_feature 1..486: note = Synthetic polypeptide
  source 1..486: mol_type = other DNA

SEQ ID NO: 9197 - DNA, 742 bp, synthetic construct; identical to SEQ ID NO: 6357
  misc_feature 1..742: note = Synthetic polypeptide
  source 1..742: mol_type = other DNA

SEQ ID NO: 9198 - DNA, 590 bp, synthetic construct; identical to SEQ ID NO: 6358
  misc_feature 1..590: note = Synthetic polypeptide
  source 1..590: mol_type = other DNA

SEQ ID NO: 9199 - DNA, 577 bp, synthetic construct; identical to SEQ ID NO: 6359
  misc_feature 1..577: note = Synthetic polypeptide
  source 1..577: mol_type = other DNA

SEQ ID NO: 9200 - DNA, 430 bp, synthetic construct; identical to SEQ ID NO: 6360
  misc_feature 1..430: note = Synthetic polypeptide
  source 1..430: mol_type = other DNA

SEQ ID NO: 9201 - DNA, 670 bp, synthetic construct; identical to SEQ ID NO: 6361
  misc_feature 1..670: note = Synthetic polypeptide
  source 1..670: mol_type = other DNA

SEQ ID NO: 9202 - DNA, 1452 bp, synthetic construct; identical to SEQ ID NO: 7300
  misc_feature 1..1452: note = Synthetic polypeptide
  source 1..1452: mol_type = other DNA

SEQ ID NO: 9203 - DNA, 1149 bp, synthetic construct; identical to SEQ ID NO: 7301
  misc_feature 1..1149: note = Synthetic polypeptide
  source 1..1149: mol_type = other DNA

SEQ ID NO: 9204 - DNA, 1416 bp, synthetic construct; identical to SEQ ID NO: 7302
  misc_feature 1..1416: note = Synthetic polypeptide
  source 1..1416: mol_type = other DNA

SEQ ID NO: 9205 - DNA, 1443 bp, synthetic construct; identical to SEQ ID NO: 7303
  misc_feature 1..1443: note = Synthetic polypeptide
  source 1..1443: mol_type = other DNA

SEQ ID NO: 9206 - DNA, 1134 bp, synthetic construct; identical to SEQ ID NO: 7304
  misc_feature 1..1134: note = Synthetic polypeptide
  source 1..1134: mol_type = other DNA

SEQ ID NO: 9207 - DNA, 427 bp, synthetic construct; identical to SEQ ID NO: 573
  misc_feature 1..427: note = Synthetic polypeptide
  source 1..427: mol_type = other DNA

SEQ ID NO: 9208 - DNA, 1503 bp, synthetic construct; identical to SEQ ID NO: 8103
  misc_feature 1..1503: note = Synthetic polypeptide
  source 1..1503: mol_type = other DNA

SEQ ID NO: 9209 - DNA, 645 bp, synthetic construct; identical to SEQ ID NO: 8104
  misc_feature 1..645: note = Synthetic polypeptide
  source 1..645: mol_type = other DNA

SEQ ID NO: 9210 - DNA, 343 bp, synthetic construct; identical to SEQ ID NO: 8105
  misc_feature 1..343: note = Synthetic polypeptide
  source 1..343: mol_type = other DNA

SEQ ID NO: 9211 - DNA, 2120 bp, synthetic construct; identical to SEQ ID NO: 6752
  misc_feature 1..2120: note = Synthetic polypeptide
  source 1..2120: mol_type = other DNA

SEQ ID NO: 9212 - DNA, 1083 bp, synthetic construct
  misc_feature 1..1083: note = Synthetic polypeptide
  source 1..1083: mol_type = other DNA
tggaagccccagagagattcgccaccgggtgaagacctgactcattccgggcttccccagacagacagctggcttacagggccacctgaagacgttccagggctccacaggccactgtcttctggaggggaacggatcgactgccggtgcgcccagccaaattcaactcctgagtcctcagtctctagtcccgggaagtctcttctcggcaaagtgaaagaagcggtgaaggtggccattgatgcagaatatcgccacattgactgtgcctatttctatgagaatcaacatgaggtgggagaagccatccaagagaagatccaagagaaggctgtgatgcgggaggacctgttcatcgtcagcaaggtgtggcccactttctttgagagaccccttgtgaggaaagcctttgagaagaccctcaaggacctgaagctgagctatctggacgtctatcttattcactggccacagggattcaagactggggatgactttttccccaaagatgataaaggtaatatgatcagtggaaaaggaacgttcttggatgcctgggaggccatggaggagctggtggacgaggggctggtgaaagcccttggggtctcaaatttcaaccacttccagatcgagaggctcttgaacaaacctggactgaaatataaaccagtgactaaccaggttgagtgtcacccatacctcacgcaggagaaactgatccagtactgccactccaagggcatcaccgttacggcctacagccccctgggctctccggatagaccttgggccaaacctgaggacccttccctgctggaggatcccaagattaaggagattgctgcaaagcacaaaaaaaccacagcccaggttctgatccgtttccatatccagaggaatgtgacagtgatccccaagtctatgacaccagcacacattgttgagaacattcaggtctttgactttaaattgagtgatgaggagatggcaaccatactcagcttcaacagaaactggagggcctttgacttcaaggaattctctcatttggaggactttcccttcgatgcagaatattga

SEQ ID NO: 9213 - DNA, 632 bp, synthetic construct; identical to SEQ ID NO: 8284
  misc_feature 1..632: note = Synthetic polypeptide
  source 1..632: mol_type = other DNA

SEQ ID NO: 9214 - DNA, 416 bp, synthetic construct; identical to SEQ ID NO: 8285
  misc_feature 1..416: note = Synthetic polypeptide
  source 1..416: mol_type = other DNA

SEQ ID NO: 9215 - DNA, 962 bp, synthetic construct; identical to SEQ ID NO: 8286
  misc_feature 1..962: note = Synthetic polypeptide
  source 1..962: mol_type = other DNA

SEQ ID NO: 9216 - DNA, 863 bp, synthetic construct; identical to SEQ ID NO: 8287
  misc_feature 1..863: note = Synthetic polypeptide
  source 1..863: mol_type = other DNA

SEQ ID NO: 9217 - DNA, 596 bp, synthetic construct; identical to SEQ ID NO: 8288
  misc_feature 1..596: note = Synthetic polypeptide
  source 1..596: mol_type = other DNA

SEQ ID NO: 9218 - DNA, 962 bp, synthetic construct
  misc_feature 1..962: note = Synthetic polypeptide
  source 1..962: mol_type = other DNA
tgcagtcctaaaaaggaatgagatcatgtcctttacaggaacatggatggagctggaagccgttgcaggagcagaaaaccaaacaccgcaagttctcacttataagtaggagctgaacgatgagaacacatggacacaagtggggaaacaacacacactggggcctggtcggggacggagagcatcaggaagattagctaatggatgctgggcttgataccaaggtgatggtgaacgggagcctcttcgtgcagtacttccaccgcgtgcccttccaccgtgtggacaccatctccgtcaatggctctgtgcagctgtcctacatcagcttccagaatccccgcacagtccccgttcagcctgccttctccacggtgccgttctcccagcctgtctgtttcccacccaggcccagggggcgcagacaaaaacctcccagcgtgcggcctgccaacccagctcccattacccagacagtcatccacacggtgcagagcgcctctggacagatgttctctcagactcccgccatcccacctatgatgtacccccaccctgcctatccgatgcctttcatcaccaccattccgggagggctgtacccatccaagtccatcatcctgtcaggcactgtcctgcccagtgctcagaggttccacatcaacctgtgctctgggagccacatcgccttccacatgaacccccgttttgatgagaatgctgtggtccgtaacacccagatcaacaactcttgggggtctgaggagcgaagtctgccccgaaaaatgcccttcgtccgaggccagagcttctcggtgtggatcttgtgtgaagctcactgcctcaaggtggccgtggatggtcagcacgtgtttgaatactaccatcgcctgaggaacctgcccaccatcaacaaactggaagtgggtggcgacatccagctgacccacgtgcagacatag

SEQ ID NO: 9219 - DNA, 959 bp, synthetic construct
  misc_feature 1..959: note = Synthetic polypeptide
  source 1..959: mol_type = other DNA
tgcagtcctaaaaaggaatgagatcatgtcctttacaggaacatggatggagctggaagccgttgcaggagcagaaaaccaaacaccgcaagttctcacttataagtaggagctgaacgatgagaacacatggacacaagtggggaaacaacacacactggggcctggtcggggacggagagcatcaggaagattagctaatggatgctgggcttgataccaaggtgatggtgaacgggagcctcttcgtgcagtacttccaccgcgtgcccttccaccgtgtggacaccatctccgtcaatggctctgtgcagctgtcctacatcagcttccagaatccccgcacagtccccgttcagcctgccttctccacggtgccgttctcccagcctgtctgtttcccacccaggcccagggggcgcagacaaaaacctcccagcgtgcggcctgccaacccagctcccattacccagacagtcatccacacggtgcagagcgcctctggacagatgttctctactcccgccatcccacctatgatgtacccccaccctgcctatccgatgcctttcatcaccaccattccgggagggctgtacccatccaagtccatcatcctgtcaggcactgtcctgcccagtgctcagaggttccacatcaacctgtgctctgggagccacatcgccttccacatgaacccccgttttgatgagaatgctgtggtccgtaacacccagatcaacaactcttgggggtctgaggagcgaagtctgccccgaaaaatgcccttcgtccgaggccagagcttctcggtgtggatcttgtgtgaagctcactgcctcaaggtggccgtggatggtcagcacgtgtttgaatactaccatcgcctgaggaacctgcccaccatcaacaaactggaagtgggtggcgacatccagctgacccacgtgcagacatag

SEQ ID NO: 9220 - DNA, 543 bp, synthetic construct; identical to SEQ ID NO: 6496
  misc_feature 1..543: note = Synthetic polypeptide
  source 1..543: mol_type = other DNA

SEQ ID NO: 9221 - DNA, 378 bp, synthetic construct; identical to SEQ ID NO: 6497
  misc_feature 1..378: note = Synthetic polypeptide
  source 1..378: mol_type = other DNA

SEQ ID NO: 9222 - DNA, 267 bp, synthetic construct; identical to SEQ ID NO: 6498
  misc_feature 1..267: note = Synthetic polypeptide
  source 1..267: mol_type = other DNA

SEQ ID NO: 9223 - DNA, 416 bp, synthetic construct; identical to SEQ ID NO: 6499
  misc_feature 1..416: note = Synthetic polypeptide
  source 1..416: mol_type = other DNA

SEQ ID NO: 9224 - DNA, 162 bp, synthetic construct; identical to SEQ ID NO: 6500
  misc_feature 1..162: note = Synthetic polypeptide
  source 1..162: mol_type = other DNA

SEQ ID NO: 9225 - DNA, 80 bp, synthetic construct; identical to SEQ ID NO: 6364
  misc_feature 1..80: note = Synthetic polypeptide
  source 1..80: mol_type = other DNA

SEQ ID NO: 9226 - DNA, 217 bp, synthetic construct; identical to SEQ ID NO: 6365
  misc_feature 1..217: note = Synthetic polypeptide
  source 1..217: mol_type = other DNA

SEQ ID NO: 9227 - DNA, 1216 bp, synthetic construct; identical to SEQ ID NO: 6819
  misc_feature 1..1216: note = Synthetic polypeptide
  source 1..1216: mol_type = other DNA

SEQ ID NO: 9228 - DNA, 510 bp, synthetic construct; identical to SEQ ID NO: 6820
  misc_feature 1..510: note = Synthetic polypeptide
  source 1..510: mol_type = other DNA

SEQ ID NO: 9229 - DNA, 1029 bp, synthetic construct; identical to SEQ ID NO: 8732
  misc_feature 1..1029: note = Synthetic polypeptide
  source 1..1029: mol_type = other DNA

SEQ ID NO: 9230 - DNA, 1170 bp, synthetic construct; identical to SEQ ID NO: 8733
  misc_feature 1..1170: note = Synthetic polypeptide
  source 1..1170: mol_type = other DNA

SEQ ID NO: 9231 - DNA, 1062 bp, synthetic construct; identical to SEQ ID NO: 8734
  misc_feature 1..1062: note = Synthetic polypeptide
  source 1..1062: mol_type = other DNA

SEQ ID NO: 9232 - DNA, 573 bp, synthetic construct; identical to SEQ ID NO: 8735
  misc_feature 1..573: note = Synthetic polypeptide
  source 1..573: mol_type = other DNA

SEQ ID NO: 9233 - DNA, 299 bp, synthetic construct; identical to SEQ ID NO: 8736
  misc_feature 1..299: note = Synthetic polypeptide
  source 1..299: mol_type = other DNA

SEQ ID NO: 9234 - DNA, 337 bp, synthetic construct; identical to SEQ ID NO: 6393
  misc_feature 1..337: note = Synthetic polypeptide
  source 1..337: mol_type = other DNA

SEQ ID NO: 9235 - DNA, 603 bp, synthetic construct; identical to SEQ ID NO: 8872
  misc_feature 1..603: note = Synthetic polypeptide
  source 1..603: mol_type = other DNA

SEQ ID NO: 9236 - DNA, 369 bp, synthetic construct; identical to SEQ ID NO: 7297
  misc_feature 1..369: note = Synthetic polypeptide
  source 1..369: mol_type = other DNA

SEQ ID NO: 9237 - DNA, 1582 bp, synthetic construct; identical to SEQ ID NO: 7488
  misc_feature 1..1582: note = Synthetic polypeptide
  source 1..1582: mol_type = other DNA

SEQ ID NO: 9238 - DNA, 1376 bp, synthetic construct
  misc_feature 1..1376: note = Synthetic polypeptide
  source 1..1376: mol_type = other DNA
agtggtttaaagtgtggattcgggcgtcagacccatgttgaaatccctagctcagccacgtgactagcttagtcctcaggcaagttctttaacatatttgtgccttagtctcctcatttctaaagtgaggataacaggacctgcctcaggacaatgcttggcatatagcagaaatactcagtgtcctcagtcacagaaacatcatccagttttatggagtaattcttgaacctcccaactatggcattgtcacagaatatgcttctctgggatcactctatgattacattaacagtaacagaagtgaggagatggatatggatcacattatgacctgggccactgatgtagccaaaggaatgcattatttacatatggaggctcctgtcaaggtgattcacagagacctcaagtcaagaaacgttgttatagctgctgatggagtattgaagatctgtgactttggtgcctctcggttccataaccatacaacacacatgtccttggttggaactttcccatggatggctccagaagttatccagagtctccctgtgtcagaaacttgtgacacatattcctatggtgtggttctctgggagatgctaacaagggaggtcccctttaaaggtttggaaggattacaagtagcttggcttgtagtggaaaaaaacgagagattaaccattccaagcagttgccccagaagttttgctgaactgttacatcagtgttgggaagctgatgccaagaaacggccatcattcaagcaaatcatttcaatcctggagtccatgtcaaatgacacgagccttcctgacaagtgtaactcattcctacacaacaaggcggagtggaggtgcgaaattgaggcaactcttgagaggctaaagaaactagagcgtgatctcagctttaaggagcaggagcttaaagaacgagaaagacgtttaaagatgtgggagcaaaagctgacagagcagtccaacaccccgcttctcttgcctcttgctgcaagaatgtctgaggagtcttactttgaatctaaaacagaggagtcaaacagtgcagagatgtcatgtcagatcacagcaacaagtaacggggagggccatggcatgaacccaagtctgcaggccatgatgctgatgggctttggggatatcttctcaatgaacaaagcaggagctgtgatgcattctgggatgcagataaacatgcaagccaagcagaattcttccaaaaccacatctaagagaagggggaagaaagtcaacatggctctggggttcagtgattttgacttgtcagaaggtgacgatgatgatgatgatgacggtgaggaggaggataatgacatggataatagtgaatga

SEQ ID NO: 9239 - DNA, 2411 bp, synthetic construct
  misc_feature 1..2411: note = Synthetic polypeptide
  source 1..2411: mol_type = other DNA
agtggtttaaagtgtggattcgggcgtcagacccatgttgaaatccctagctcagccacgtgactagcttagtcctcaggcaagttctttaacatatttgtgccttagtctcctcatttctaaagtgaggataacaggacctgcctcaggacaatgcttggcatatagcagaaatactcagtgtcctcagtcacagaaacatcatccagttttatggagtaattcttgaacctcccaactatggcattgtcacagaatatgcttctctgggatcactctatgattacattaacagtaacagaagtgaggagatggatatggatcacattatgacctgggccactgatgtagccaaaggaatgcattatttacatatggaggctcctgtcaaggtgattcacagagacctcaagtcaagaaacgttgttatagctgctgatggagtattgaagatctgtgactttggtgcctctcggttccataaccatacaacacacatgtccttggttggaactttcccatggatggctccagaagttatccagagtctccctgtgtcagaaacttgtgacacatattcctatggtgtggttctctgggagatgctaacaagggaggtcccctttaaaggtttggaaggattacaagtagcttggcttgtagtggaaaaaaacgagagattaaccattccaagcagttgccccagaagttttgctgaactgttacatcagtgttgggaagctgatgccaagaaacggccatcattcaagcaaatcatttcaatcctggagtccatgtcaaatgacacgagccttcctgacaagtgtaactcattcctacacaacaaggcggagtggaggtgcgaaattgaggcaactcttgagaggctaaagaaactagagcgtgatctcagctttaaggagcaggagcttaaagaacgagaaagacgtttaaagatgtgggagcaaaagctgacagagcagtccaacaccccgctgctgccttcctttgagattggtgcatggacggaagacgatgtgtattgttgggttcagcagctcgtcagaaaaggtgactcttcagcagagatgagtgtatatgcaagcttgtttaaagaaaacaacattacagggaagcggctgctgctgctggaggaagaagacctgaaagacatgggcattgtctccaaggggcatatcattcacttcaagtcagccattgagaaattaacccatgattacataaatttgtttcacttcccaccactaattaaggactcaggaggtgaacctgaagaaaatgaggaaaaaatagtgaacctggaactggtttttggttttcacttgaaaccaggaactggcccacaggattgtaagtggaaaatgtatatggagatggatggggatgaaattgcaataacctacataaaagatgtgacattcaacactaacctacctgatgcggagattttaaagatgacaaagccaccatttgtaatggagaagtggattgtaggaatagcaaaaagtcagactgtggagtgcactgtcacatatgagagtgatgttagaactccaaaaagcactaaacatgtccattcgattcagtggagtagaacaaaacctcaggatgaagtgaaagcagtccaacttgccattcagacattattcaccaattcagatggcaaccctggaagcaggtccgactcaagtgctgattgccagtggttagatactctgaggatgcggcagattgcatccaacacttctttacagcgttcccagagcaatcctattctggggtcaccgttcttctcacactttgatggccaggattcctacgctgctgctgtgagacggccccaggtgcccattaagtatcaacagattacacctgtgaaccagtccagaagctcgtctcctactcagtatggactgaccaaaaacttctcttccctacatctcaactctagggacagtggcttttccagtggcaatactgacacctcttcagagaggggtcgatactcagacagaagcaggaacaaatatggacgtggtagtatatcactcaattcttctcctagaggaagatacagtggaaagagtcagcattccactccttcaagaggaagataccctggaaagttctacagggtttctcagtcagcactcaatcctcaccagtcgcctgacttcaagagaagccccagggacctccaccaacccaacaccataccagggatgcctttgcaccctgagactgactcaagagccagtgaagaggacagcaaagtcagcgaagggggctggacaaaagtggaataccggaaaaagccccacaggccatctcccgccaaaaccaataaagagagagccagaggggaccaccgtggatggagaaacttttga

SEQ ID NO: 9240 - DNA, 423 bp, synthetic construct
  misc_feature 1..423: note = Synthetic polypeptide
  source 1..423: mol_type = other DNA
agtggtttaaagtgtggattcgggcgtcagacccatgttgaaatccctagctcagccacgtgactagcttagtcctcaggcaagttctttaacatatttgtgccttagtctcctcatttctaaagtgaggataacaggacctgcctcaggacaatgcttggcatatagcagaaatactcagtgtcctcagtcacagaaacatcatccagttttatggagtaattcttgaacctcccaactatggcattgtcacagaatatgcttctctgggatcactctatgattacattaacagtaacagaagtgaggagatggatatggatcacattatgacctgggccactgatgtagccaaaggaatgcattatttacatatggaggctcctgtcaaggtgattcacagagacctcaagtcaagaaacg

SEQ ID NO: 9241 - DNA, 252 bp, synthetic construct; identical to SEQ ID NO: 7309
  misc_feature 1..252: note = Synthetic polypeptide
  source 1..252: mol_type = other DNA

SEQ ID NO: 9242 - DNA, 853 bp, synthetic construct; identical to SEQ ID NO: 8074
  misc_feature 1..853: note = Synthetic polypeptide
  source 1..853: mol_type = other DNA

SEQ ID NO: 9243 - DNA, 2698 bp, synthetic construct
  misc_feature 1..2698: note = Synthetic polypeptide
  source 1..2698: mol_type = other DNA
tttccacggtctccctctcatgccgagccgaagctggacggtactgctgccatctcggctcactgcaacctccctgcctgattctcctgcctcagcttgccgagtgcctgcgattgcaggtgcacgccgccacgcctgactggttttcgtattttcttggtggagactgggattcgctgtgttggccgggctggtctccagctcctaaccgcgagtgatccgacagcctcggcctcccgaggtgccgggattgcagacggagtctcgttcattcagtgctcaatggtgcccaggctggagtgcagtggcgtgatcttggctcgtgcaacctccacctcccagcagcctgccttggcctcccaaagtgccgagattgcagcctctgcccggccgccaccccgtctgggaagtgaggagcttctccgcctggccgcctatcgtctgggatgtgaggagcccctctgcctggctgcccagtctggaaagtgaggagcgtctctacccggccgccatcccatctaggaagtgaggagcgcctcttcccggccaccatcacatctgggaagtgaggagcgtctctgccctgccgcccatcgtctgagatgtggggagcacctctgccctgccgccccgtccgggatgtgaggagcgtctctgcccggacgccccgtctgagaagtgaggagaccctctgcctggcaaccgccccgtctgagaatgccctgaggagctgaaacccatgaaggatggctctggctgctacgaccactccaaaggcattgactgctctgatggctttaatggcggctgtgagcagctgtgcctgcagcagacgctgcccctgccctacgatgccacttcgagcaccatcttcatgttctgcggttgcgtggaggagtacaaactggctcctgatggaaaatcctgcttaatgctctcagatgtctgcgagggccccaagtgcctcaaacctgactccaaattcaatgataccctctttggagagatgctacatggttacaacaaccggacccagcatgtgaaccaaggccaagtcttccagatgacctttagggagaacaacttcatcaaggactttccccagctggccgatgggctgttggtgatcccgctgccggtggaggagcagtgccggggggtcctctccgagccccttccagacctccaactgctcactggagatatcaggtatgatgaggccatgggttaccccatggtgcagcagtggcgggtccggagcaacctctaccgtgtgaagctcagcaccatcaccctcgcagcaggcttcactaatgttctcaagatcctgaccaaggagagcagtcgggaggagctgctgtccttcatccagcactatggctcccactacatcgcagaggccctctatggctcagagctcacctgcatcatccactttcccagcaagaaggtccagcagcagctgtggctccagtatcagaaagagaccacagagctgggcagcaagaaggagctcaagtccatgcccttcatcacctacctctcaggtttgctgacagcccagatgctgtcagatgaccagctcatttcaggtgtggagattcgctgtgaggagaaggggcgctgtccatctacctgtcacctttgccgccggccaggcaaggagcagctgagccccacaccagtgctgctggaaatcaaccgtgtggtgccactttataccctcatccaagacaatggcacaaaggaggccttcaagagtgcactgatgagttcctactggtgctcagggaaaggggatgtgatcgatgactggtgcaggtgtgacctcagcgcctttgatgccaatgggctccccaactgcagcccccttctgcagccggtgctgcggctgtccccaacagtggagccctccagtactgtggtctccttggagtgggtggatgttcagccagctattgggaccaaggtctccgactatattctgcagcataagaaagtggatgaatacacagacactgacctgtacacaggagaattcctgagttttgctgatgacttactctctggcctgggcacatcttgtgtagcagctggtcgaagccatggagaggtccctgaagtcagtatctactcagtcatcttcaagtgtctggagcccgacggtctctacaagttcactctgtatgctgtggatacacgagggaggcactcagagctaagcacggtgaccctgaggacggcctgtccactggtagatgacaacaaggcagaagaaatagctgacaagatctacaatctgtacaatgggtacacaagtggaaaggagcagcagatggcctacaacacactgatggaggtctcagcctcgatgctgttccgagtccagcaccactacaactctcactatgaaaagtttggcgacttcgtctggagaagtgaggatgagctggggcccaggaaggcccacctgattctacggcgactggagagggtgagtagccactgctccagcctcctgcggagtgcctacatccagagccgcgtggaaacagtgccctatcttttctgccgcagcgaggaggtccggcctgcaggcatggtgtggtatagcatcctcaaggacaccaaaatcacgtgtgaggagaagatggtgtcaatggcccgaaacacgtacggggagtccaagggccggtga

SEQ ID NO: 9244 - DNA, 2766 bp, synthetic construct
  misc_feature 1..2766: note = Synthetic polypeptide
  source 1..2766: mol_type = other DNA
ggccaggtgcagtgactcatgcctgtaatcccagcactttgggaggccaaggcaggtggattgcttgagcccgggagtttgagaccagcctgggcaacatgacaaatggtggcccggagtttgctcgataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttgctggctctgttggagcaggagctcattgaacgatttgatgtggagaccaaagtgtgccctgtcctcatagagctgacagccccagatagcaatgatgatgtgaaaacagaagctgtggctataatgtgcaaaatggctcccatggttgggaaggatattacagagcgtcttatcctccctaggttttgtgagatgtgctgcgattgcagaatgtttcacgttcgaaaggtctgtgctgccaattttggagatatttgcagtgtagttggccagcaagctactgaagaaatgttgctgcccagatttttccagctttgttctgataatgtatggggagtccgaaaggcttgtgctgaatgcttcatggcggtttcatgtgcaacatgtcaagaaatccgacggaccaaattatcagcactttttattaatttgatcagtgatccttcacgttgggttcgccaagcagcttttcagtctctgggacctttcatatctacttttgctaatccatctagctcaggccagtattttaaagaagaaagcaaaagttcagaagagatgtcagtagaaaacaaaaataggaccagagatcaagaagccccagaggatgtacaagtcaggccagaggatactccttcagatctcagtgttagtaattccagtgtcatactggaaaacacgatggaagaccatgctgctgaggcatccgggaagcctctaggtgaaattagtgttccactggacagctctttactttgtactttgtcctcagaatctcaccaggaagcagctagtaatgagaatgataaaaaacctggtaactacaaatctatgttacgaccagaggttggcaccacttcacaagattcagctctcttagatcaggaattgtataactccttccatttctggaggactcctcttcctgaaatagatctagacatagagcttgaacagaactctgggggaaaacccagcccagagggaccagaggaagaatctgagggccctgtgcccagttctccaaacatcaccatggccaccagaaaggaactggaagaaatgatagaaaatctagagccccacattgatgatccagatgttaaagcacaagtggaagtgctgtccgctgcactacgtgcttccagcctggatgcacatgaagagaccatcagtatagaaaagagaagtgatttgcaagatgaactggatataaatgagctaccaaattgtaaaataaatcaagaagattctgtgcctttaatcagcgatgctgttgagaatatggactccactcttcactatattcacagcgattcagacttgagcaacaatagcagttttagccctgatgaggaaaggagaactaaagtacaagatgttgtacctcaggcgttgttagatcagtatttatctatgactgacccttctcgtgcacagacggttgacactgaaattgctaagcactgtgcatatagcctccctggtgtggccttgacactcggaagacagaattggcactgcctgagagagacgtatgagactctggcctcagacatgcagtggaaagttcgacgaactctagcattctccatccacgagcttgcagttattcttggagatcaattgacagctgcagatctggttccaatttttaatggatttttaaaagacctcgatgaagtcaggataggtgttcttaaacacttgcatgattttctgaagcttcttcatattgacaaaagaagagaatatctttatcaacttcaggagtttttggtgacagataatagtagaaattggcggtttcgagctgaactggctgaacagctgattttacttctagagttatatagtcccagagatgtttatgactatttacgtcccattgctctgaatctgtgtgcagacaaagtttcttctgttcgttggatttcctacaagttggtcagcgagatggtgaagaagctgcacgcggcaacaccaccaacgttcggagtggacctcatcaatgagcttgtggagaactttggcagatgtcccaagtggtctggtcggcaagcctttgtctttgtctgccagactgtcattgaggatgactgccttcccatggaccagtttgctgtgcatctcatgccgcatctgctaaccttagcaaatgacagggttcctaacgtgcgagtgctgcttgcaaagacattaagacaaactctactagaaaaagactatttcttggcctctgccagctgccaccaggaggctgtggagcagaccatcatggctcttcagatggaccgtgacagcgatgtcaagtattttgcaagcatccaccctgccagtaccaaaatctccgaagatgccatgagcacagcgtcctcaacctactag

SEQ ID NO: 9245 - DNA, 496 bp, synthetic construct
  misc_feature 1..496: note = Synthetic polypeptide
  source 1..496: mol_type = other DNA
ggccaggtgcagtgactcatgcctgtaatcccagcactttgggaggccaaggcaggtggattgcttgagcccgggagtttgagaccagcctgggcaacatgacaaatggtggcccggagtttgctcgataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttgctggctctgttggagcaggagctcattgaacgatttgatgtggagaccaaagtgtgccctgtcctcatagagctgacagccccagatagcaatgatgatgtgaaaacagaagctgtgg

SEQ ID NO: 9246 - DNA, 473 bp, synthetic construct
  misc_feature 1..473: note = Synthetic polypeptide
  source 1..473: mol_type = other DNA
ggccaggtgcagtgactcatgcctgtaatcccagcactttgggaggccaaggcaggtggattgcttgagcccgggagtttgagaccagcctgggcaacatgacaaatggtggcccggagtttgctcgataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttgctggctctgttggagcaggagctcattgaacgatttgatgtggagaccaaagtgtgccctgtcctcatagagctgacagccccagatagcaatga

SEQ ID NO: 9247 - DNA, 449 bp, synthetic construct
  misc_feature 1..449: note = Synthetic polypeptide
  source 1..449: mol_type = other DNA
ggccaggtgcagtgactcatgcctgtaatcccagcactttgggaggccaaggcaggtggattgcttgagcccgggagtttgagaccagcctgggcaacatgacaaatggtggcccggagtttgctcgataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttgctggctctgttggagcaggagctcattgaacgatttgatgtggagaccaaagtgtgccctgtcctcataga

SEQ ID NO: 9248 - DNA, 378 bp, synthetic construct
  misc_feature 1..378: note = Synthetic polypeptide
  source 1..378: mol_type = other DNA
ggccaggtgcagtgactcatgcctgtaatcccagcactttgggaggccaaggcaggtggattgcttgagcccgggagtttgagaccagcctgggcaacatgacaaatggtggcccggagtttgctcgataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttg

SEQ ID NO: 9249 - DNA, 333 bp, synthetic construct
  misc_feature 1..333: note = Synthetic polypeptide
  source 1..333: mol_type = other DNA
ggccaggtgcagtgactcatgcctgtaatcccagcactttgggaggccaaggcaggtggattgcttgagcccgggagtttgagaccagcctgggcaacatgacaaatggtggcccggagtttgctcgataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagatacctt

SEQ ID NO: 9250 - DNA, 136 bp, synthetic construct
  misc_feature 1..136: note = Synthetic polypeptide
  source 1..136: mol_type = other DNA
ggccaggtgcagtgactcatgcctgtaatcccagcactttgggaggccaaggcaggtggattgcttgagcccgggagtttgagaccagcctgggcaacatgacaaatggtggcccggagtttgctcgataccttga

SEQ ID NO: 9251 - DNA, 390 bp, synthetic construct
  misc_feature 1..390: note = Synthetic polypeptide
  source 1..390: mol_type = other DNA
ctcccactgattctacattatgcgtggggtagagcagcggctgccatgctcttctgtggcttcatcatcctggtgatctgtttcatcctctccttcttcgccctctgtggaccccagatgcttgtcttcctgagagtgattggaggtctccttgccttggctgctgtgttccagatcatctccctggtaatttaccccgtgaagtacacccagaccttcacccttcatgccaaccctgctgtcacttacatctataactgggcctacggctttgggtgggcagccacgattatcctgattggctgtgccttcttcttctgctgcctccccaactacgaagatgaccttctgggcaatgccaagcccaggtacttctacacatctgcctaa

SEQ ID NO: 9252 - DNA, 667 bp, synthetic construct
  misc_feature 1..667: note = Synthetic polypeptide
  source 1..667: mol_type = other DNA
gctgggtacagtggagatgaatgccctgagaggccaggtgggtggagatgtcaatgtggagatggacgctgcacctggcgtggacctgagccgcattctgaacgagatgcgtgaccagtatgagaagatggcagagaagaaccgcaaggatgccgaggaatggttcttcaccaagacagaggagctgaaccgcgaggtggccaccaacagcgagctggtgcagagcggcaagagcgagatctcggagctccggcgcaccatgcagaacctggagattgagctgcagtcccagctcagcatgaaagcatccctggagaacagcctggaggagaccaaaggtcgctactgcatgcagctggcccagatccaggagatgattggcagcgtggaggagcagctggcccagctccgctgcgagatggagcagcagaaccaggagtacaagatcctgctggacgtgaagacgcggctggagcaggagatcgccacctaccgccgcctgctggagggcgaggacgcccacctctcctcctcccagttctcctctggatcgcagtcatccagagatgtgacctcctccagccgccaaatccgcaccaaggtcatggatgtgcacgatggcaaggtggtgtccacccacgagcaggtccttcgcaccaagaactga

SEQ ID NO: 9253 - DNA, 4599 bp, synthetic construct; identical to SEQ ID NO: 8376
  misc_feature 1..4599: note = Synthetic polypeptide
  source 1..4599: mol_type = other DNA

SEQ ID NO: 9254 - DNA, 2243 bp, synthetic construct; identical to SEQ ID NO: 8048
  misc_feature 1..2243: note = Synthetic polypeptide
  source 1..2243: mol_type = other DNA

SEQ ID NO: 9255 - DNA, 1338 bp, synthetic construct; identical to SEQ ID NO: 8049
  misc_feature 1..1338: note = Synthetic polypeptide
  source 1..1338: mol_type = other DNA

SEQ ID NO: 9256 - DNA, 1263 bp, synthetic construct; identical to SEQ ID NO: 8050
  misc_feature 1..1263: note = Synthetic polypeptide
  source 1..1263: mol_type = other DNA

SEQ ID NO: 9257 - DNA, 2658 bp, synthetic construct
  misc_feature 1..2658: note = Synthetic polypeptide
  source 1..2658: mol_type = other DNA
tttccacggtctccctctcatgccgagccgaagctggacggtactgctgccatctcggctcactgcaacctccctgcctgattctcctgcctcagcttgccgagtgcctgcgattgcaggtgcacgccgccacgcctgactggttttcgtattttcttggtggagactgggattcgctgtgttggccgggctggtctccagctcctaaccgcgagtgatccgacagcctcggcctcccgaggtgccgggattgcagacggagtctcgttcattcagtgctcaatggtgcccaggctggagtgcagtggcgtgatcttggctcgtgcaacctccacctcccagcagcctgccttggcctcccaaagtgccgagattgcagcctctgcccggccgccaccccgtctgggaagtgaggagcttctccgcctggccgcctatcgtctgggatgtgaggagcccctctgcctggctgcccagtctggaaagtgaggagcgtctctacccggccgccatcccatctaggaagtgaggagcgcctcttcccggccaccatcacatctgggaagtgaggagcgtctctgccctgccgcccatcgtctgagatgtggggagcacctctgccctgccgccccgtccgggatgtgaggagcgtctctgcccggacgccccgtctgagaatgccctgaggagctgaaacccatgaaggatggctctggctgctacgaccactccaaaggcattgactgctctgatggctttaatggcggctgtgagcagctgtgcctgcagcagacgctgcccctgccctacgatgccacttcgagcaccatcttcatgttctgcggttgcgtggaggagtacaaactggctcctgatggaaaatcctgcttaatgctctcagatgtctgcgagggccccaagtgcctcaaacctgactccaaattcaatgataccctctttggagagatgctacatggttacaacaaccggacccagcatgtgaaccaaggccaagtcttccagatgacctttagggagaacaacttcatcaaggactttccccagctggccgatgggctgttggtgatcccgctgccggtggaggagcagtgccggggggtcctctccgagccccttccagacctccaactgctcactggagatatcaggtatgatgaggccatgggttaccccatggtgcagcagtggcgggtccggagcaacctctaccgtgtgaagctcagcaccatcaccctcgcagcaggcttcactaatgttctcaagatcctgaccaaggagagcagtcgggaggagctgctgtccttcatccagcactatggctcccactacatcgcagaggccctctatggctcagagctcacctgcatcatccactttcccagcaagaaggtccagcagcagctgtggctccagtatcagaaagagaccacagagctgggcagcaagaaggagctcaagtccatgcccttcatcacctacctctcaggtttgctgacagcccagatgctgtcagatgaccagctcatttcaggtgtggagattcgctgtgaggagaaggggcgctgtccatctacctgtcacctttgccgccggccaggcaaggagcagctgagccccacaccagtgctgctggaaatcaaccgtgtggtgccactttataccctcatccaagacaatggcacaaaggaggccttcaagagtgcactgatgagttcctactggtgctcagggaaaggggatgtgatcgatgactggtgcaggtgtgacctcagcgcctttgatgccaatgggctccccaactgcagcccccttctgcagccggtgctgcggctgtccccaacagtggagccctccagtactgtggtctccttggagtgggtggatgttcagccagctattgggaccaaggtctccgactatattctgcagcataagaaagtggatgaatacacagacactgacctgtacacaggagaattcctgagttttgctgatgacttactctctggcctgggcacatcttgtgtagcagctggtcgaagccatggagaggtccctgaagtcagtatctactcagtcatcttcaagtgtctggagcccgacggtctctacaagttcactctgtatgctgtggatacacgagggaggcactcagagctaagcacggtgaccctgaggacggcctgtccactggtagatgacaacaaggcagaagaaatagctgacaagatctacaatctgtacaatgggtacacaagtggaaaggagcagcagatggcctacaacacactgatggaggtctcagcctcgatgctgttccgagtccagcaccactacaactctcactatgaaaagtttggcgacttcgtctggagaagtgaggatgagctggggcccaggaaggcccacctgattctacggcgactggagagggtgagtagccactgctccagcctcctgcggagtgcctacatccagagccgcgtggaaacagtgccctatcttttctgccgcagcgaggaggtccggcctgcaggcatggtgtggtatagcatcctcaaggacaccaaaatcacgtgtgaggagaagatggtgtcaatggcccgaaacacgtacggggagtccaagggccggtga

SEQ ID NO: 9258 - DNA, 3055 bp, synthetic construct; identical to SEQ ID NO: 709
  misc_feature 1..3055: note = Synthetic polypeptide
  source 1..3055: mol_type = other DNA

SEQ ID NO: 9259 - DNA, 3058 bp, synthetic construct; identical to SEQ ID NO: 710
  misc_feature 1..3058: note = Synthetic polypeptide
  source 1..3058: mol_type = other DNA

SEQ ID NO: 9260 - DNA, 839 bp, synthetic construct; identical to SEQ ID NO: 9123
  misc_feature 1..839: note = Synthetic polypeptide
  source 1..839: mol_type = other DNA

SEQ ID NO: 9261 - DNA, 2578 bp, synthetic construct; identical to SEQ ID NO: 7194
  misc_feature 1..2578: note = Synthetic polypeptide
  source 1..2578: mol_type = other DNA

SEQ ID NO: 9262 - DNA, 2305 bp, synthetic construct; identical to SEQ ID NO: 7195
  misc_feature 1..2305: note = Synthetic polypeptide
  source 1..2305: mol_type = other DNA

SEQ ID NO: 9263 - DNA, 1759 bp, synthetic construct; identical to SEQ ID NO: 7196
  misc_feature 1..1759: note = Synthetic polypeptide
  source 1..1759: mol_type = other DNA

SEQ ID NO: 9264 - DNA, 238 bp, synthetic construct; identical to SEQ ID NO: 6628
  misc_feature 1..238: note = Synthetic polypeptide
  source 1..238: mol_type = other DNA

SEQ ID NO: 9265 - DNA, 1636 bp, synthetic construct; identical to SEQ ID NO: 531
  misc_feature 1..1636: note = Synthetic polypeptide
  source 1..1636: mol_type = other DNA

SEQ ID NO: 9266 - DNA, 1328 bp, synthetic construct; identical to SEQ ID NO: 532
  misc_feature 1..1328: note = Synthetic polypeptide
  source 1..1328: mol_type = other DNA

SEQ ID NO: 9267 - DNA, 1052 bp, synthetic construct; identical to SEQ ID NO: 447
  misc_feature 1..1052: note = Synthetic polypeptide
  source 1..1052: mol_type = other DNA

SEQ ID NO: 9268 - DNA, 1118 bp, synthetic construct; identical to SEQ ID NO: 448
  misc_feature 1..1118: note = Synthetic polypeptide
  source 1..1118: mol_type = other DNA

SEQ ID NO: 9269 - DNA, 2297 bp, synthetic construct; identical to SEQ ID NO: 7386
  misc_feature 1..2297: note = Synthetic polypeptide
  source 1..2297: mol_type = other DNA

SEQ ID NO: 9270 - DNA, 2447 bp, synthetic construct; identical to SEQ ID NO: 7387
  misc_feature 1..2447: note = Synthetic polypeptide
  source 1..2447: mol_type = other DNA

SEQ ID NO: 9271 - DNA, 2312 bp, synthetic construct; identical to SEQ ID NO: 7388
  misc_feature 1..2312: note = Synthetic polypeptide
  source 1..2312: mol_type = other DNA

SEQ ID NO: 9272 - DNA, 2375 bp, synthetic construct; identical to SEQ ID NO: 7389
  misc_feature 1..2375: note = Synthetic polypeptide
  source 1..2375: mol_type = other DNA

SEQ ID NO: 9273 - DNA, 2093 bp, synthetic construct; identical to SEQ ID NO: 7390
  misc_feature 1..2093: note = Synthetic polypeptide
  source 1..2093: mol_type = other DNA

SEQ ID NO: 9274 - DNA, 2090 bp, synthetic construct; identical to SEQ ID NO: 7391
  misc_feature 1..2090: note = Synthetic polypeptide
  source 1..2090: mol_type = other DNA

SEQ ID NO: 9275 - DNA, 3882 bp, synthetic construct; identical to SEQ ID NO: 8381
  misc_feature 1..3882: note = Synthetic polypeptide
  source 1..3882: mol_type = other DNA

SEQ ID NO: 9276 - DNA, 4011 bp, synthetic construct; identical to SEQ ID NO: 8382
  misc_feature 1..4011: note = Synthetic polypeptide
  source 1..4011: mol_type = other DNA

SEQ ID NO: 9277 - DNA, 1060 bp, synthetic construct; identical to SEQ ID NO: 8383
  misc_feature 1..1060: note = Synthetic polypeptide
  source 1..1060: mol_type = other DNA

SEQ ID NO: 9278 - DNA, 5464 bp, synthetic construct; identical to SEQ ID NO: 7409
  misc_feature 1..5464: note = Synthetic polypeptide
  source 1..5464: mol_type = other DNA

SEQ ID NO: 9279 - DNA, 4444 bp, synthetic construct; identical to SEQ ID NO: 7410
  misc_feature 1..4444: note = Synthetic polypeptide
  source 1..4444: mol_type = other DNA

SEQ ID NO: 9280 - DNA, 574 bp, synthetic construct; identical to SEQ ID NO: 7411
  misc_feature 1..574: note = Synthetic polypeptide
  source 1..574: mol_type = other DNA

SEQ ID NO: 9281 - DNA, 503 bp, synthetic construct; identical to SEQ ID NO: 493
  misc_feature 1..503: note = Synthetic polypeptide
  source 1..503: mol_type = other DNA

SEQ ID NO: 9282 - DNA, 476 bp, synthetic construct; identical to SEQ ID NO: 495
  misc_feature 1..476: note = Synthetic polypeptide
  source 1..476: mol_type = other DNA

SEQ ID NO: 9283 - DNA, 539 bp, synthetic construct; identical to SEQ ID NO: 496
  misc_feature 1..539: note = Synthetic polypeptide
  source 1..539: mol_type = other DNA

SEQ ID NO: 9284 - DNA, 1795 bp, synthetic construct; identical to SEQ ID NO: 879
  misc_feature 1..1795: note = Synthetic polypeptide
  source 1..1795: mol_type = other DNA

SEQ ID NO: 9285 - DNA, 1171 bp, synthetic construct; identical to SEQ ID NO: 880
  misc_feature 1..1171: note = Synthetic polypeptide
  source 1..1171: mol_type = other DNA

SEQ ID NO: 9286 - DNA, 445 bp, synthetic construct; identical to SEQ ID NO: 744
  misc_feature 1..445: note = Synthetic polypeptide
  source 1..445: mol_type = other DNA

SEQ ID NO: 9287 - DNA, 59 bp, synthetic construct; identical to SEQ ID NO: 742
  misc_feature 1..59: note = Synthetic polypeptide
  source 1..59: mol_type = other DNA

SEQ ID NO: 9288 - DNA, 123 bp, synthetic construct; identical to SEQ ID NO: 743
  misc_feature 1..123: note = Synthetic polypeptide
  source 1..123: mol_type = other DNA

SEQ ID NO: 9289 - DNA, 3551 bp, synthetic construct
  misc_feature 1..3551: note = Synthetic polypeptide
  source 1..3551: mol_type = other DNA
tccctctccctctccctctccctctccctctccctctccctcacggtctccctctgatgccgagccaaagctggatggtactgctgccatctcggctcactgcaacctccctgcctgattctcctgcctcagcctgccgagtgccgccacgcctgactggttttcgtttttttttggtggagacggggtttcgctgtgttggccgggctggtctccagctcctaaccgcgagtgatccgccagcctcggcctcccgaggtgccgggattgcagacggagtctcattcactcagtgctcaatggtgcccaggctggagtgcagtggcgtgatcttggctcgctacaacctccacctcccagccgcctgccttggcctcccaaagagccgagattgcagcctctgcccggccgccaccccgtctgggaagtgaggagcgtctctgcttggccacccatcgtctgggatatgaggagccccctctgcctggctgcccagtctggaaagtgaggagcgtctctgcccggccgccatcccatctaggaagcgaggagcgcctcttccccgccgccatcacatctaggaagtgaggagcgtctctgcccggccgcccatcgtctgagatgtggggagcacctctgccctgccgccctgtctgggatgtgaggagcgtctctgcccggccgctccgtctgagaagtgaggaaaccctctgcctggcaaccgccccgtctgagaagttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgtctggctctgggagaggagtggacagcagctggttgagatacatccccatctggagacaggactgccactgacagaagatgtgagctgtgtctaa

SEQ ID NO: 9290 - DNA, 3464 bp, synthetic construct
  misc_feature 1..3464: note = Synthetic polypeptide
  source 1..3464: mol_type = other DNA
tccctctccctctccctctccctctccctctccctctccctcacggtctccctctgatgccgagccaaagctggatggtactgctgccatctcggctcactgcaacctccctgcctgattctcctgcctcagcctgccgagtgccgccacgcctgactggttttcgtttttttttggtggagacggggtttcgctgtgttggccgggctggtctccagctcctaaccgcgagtgatccgccagcctcggcctcccgaggtgccgggattgcagacggagtctcattcactcagtgctcaatggtgcccaggctggagtgcagtggcgtgatcttggctcgctacaacctccacctcccagccgcctgccttggcctcccaaagagccgagattgcagcctctgcccggccgccaccccgtctgggaagtgaggagcgtctctgcttggccacccatcgtctgggatatgaggagccccctctgcctggctgcccagtctggaaagtgaggagcgtctctgcccggccgccatcccatctaggaagcgaggagcgcctcttccccgccgccatcacatctaggaagtgaggagcgtctctgcccggccgcccatcgtctgagatgtggggagcacctctgccctgccgccctgtctgggatgtgaggagcgtctctgcccggccgctccgtctgagaagtgaggaaaccctctgcctggcaaccgccccgtctgagaagttgcacgttttcaaaaaatacctaatggtgaaaatgagacaatgattcctgtattgacatcaaaaaaagcaagtgaattaccagtcagtgaagttgcaagcattctccaatttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtctggctctgggagaggagtggacagcagctggttgagatacatccccatctggagacaggactgccactgacagaagatgtgagctgtgtctaa

SEQ ID NO: 9291 - DNA, 3491 bp, synthetic construct
  misc_feature 1..3491: note = Synthetic polypeptide
  source 1..3491: mol_type = other DNA
tccctctccctctccctctccctctccctctccctctccctcacggtctccctctgatgccgagccaaagctggatggtactgctgccatctcggctcactgcaacctccctgcctgattctcctgcctcagcctgccgagtgccgccacgcctgactggttttcgtttttttttggtggagacggggtttcgctgtgttggccgggctggtctccagctcctaaccgcgagtgatccgccagcctcggcctcccgaggtgccgggattgcagacggagtctcattcactcagtgctcaatggtgcccaggctggagtgcagtggcgtgatcttggctcgctacaacctccacctcccagccgcctgccttggcctcccaaagagccgagattgcagcctctgcccggccgccaccccgtctgggaagtgaggagcgtctctgcttggccacccatcgtctgggatatgaggagccccctctgcctggctgcccagtctggaaagtgaggagcgtctctgcccggccgccatcccatctaggaagcgaggagcgcctcttccccgccgccatcacatctaggaagtgaggagcgtctctgcccggccgcccatcgtctgagatgtggggagcacctctgccctgccgccctgtctgggatgtgaggagcgtctctgcccggccgctccgtctgagaagtgaggaaaccctctgcctggcaaccgccccgtctgagaagttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtatga

SEQ ID NO: 9292 - DNA, 1092 bp, synthetic construct
  misc_feature 1..1092: note = Synthetic polypeptide
  source 1..1092: mol_type = other DNA
tccctctccctctccctctccctctccctctccctctccctcacggtctccctctgatgccgagccaaagctggatggtactgctgccatctcggctcactgcaacctccctgcctgattctcctgcctcagcctgccgagtgccgccacgcctgactggttttcgtttttttttggtggagacggggtttcgctgtgttggccgggctggtctccagctcctaaccgcgagtgatccgccagcctcggcctcccgaggtgccgggattgcagacggagtctcattcactcagtgctcaatggtgcccaggctggagtgcagtggcgtgatcttggctcgctacaacctccacctcccagccgcctgccttggcctcccaaagagccgagattgcagcctctgcccggccgccaccccgtctgggaagtgaggagcgtctctgcttggccacccatcgtctgggatatgaggagccccctctgcctggctgcccagtctggaaagtgaggagcgtctctgcccggccgccatcccatctaggaagcgaggagcgcctcttccccgccgccatcacatctaggaagtgaggagcgtctctgcccggccgcccatcgtctgagatgtggggagcacctctgccctgccgccctgtctgggatgtgaggagcgtctctgcccggccgctccgtctgagaagtgaggaaaccctctgcctggcaaccgccccgtctgagaagttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcagg

SEQ ID NO: 9293 - DNA, 1038 bp, synthetic construct
  misc_feature 1..1038: note = Synthetic polypeptide
  source 1..1038: mol_type = other DNA
tccctctccctctccctctccctctccctctccctctccctcacggtctccctctgatgccgagccaaagctggatggtactgctgccatctcggctcactgcaacctccctgcctgattctcctgcctcagcctgccgagtgccgccacgcctgactggttttcgtttttttttggtggagacggggtttcgctgtgttggccgggctggtctccagctcctaaccgcgagtgatccgccagcctcggcctcccgaggtgccgggattgcagacggagtctcattcactcagtgctcaatggtgcccaggctggagtgcagtggcgtgatcttggctcgctacaacctccacctcccagccgcctgccttggcctcccaaagagccgagattgcagcctctgcccggccgccaccccgtctgggaagtgaggagcgtctctgcttggccacccatcgtctgggatatgaggagccccctctgcctggctgcccagtctggaaagtgaggagcgtctctgcccggccgccatcccatctaggaagcgaggagcgcctcttccccgccgccatcacatctaggaagtgaggagcgtctctgcccggccgcccatcgtctgagatgtggggagcacctctgccctgccgccctgtctgggatgtgaggagcgtctctgcccggccgctccgtctgagaagtgaggaaaccctctgcctggcaaccgccccgtctgagaagttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatg

SEQ ID NO: 9294 - DNA, 3398 bp, synthetic construct
  misc_feature 1..3398: note = Synthetic polypeptide
  source 1..3398: mol_type = other DNA
tccctctccctctccctctccctctccctctccctctccctcacggtctccctctgatgccgagccaaagctggatggtactgctgccatctcggctcactgcaacctccctgcctgattctcctgcctcagcctgccgagtgccgccacgcctgactggttttcgtttttttttggtggagacggggtttcgctgtgttggccgggctggtctccagctcctaaccgcgagtgatccgccagcctcggcctcccgaggtgccgggattgcagacggagtctcattcactcagtgctcaatggtgcccaggctggagtgcagtggcgtgatcttggctcgctacaacctccacctcccagccgcctgccttggcctcccaaagagccgagattgcagcctctgcccggccgccaccccgtctgggaagtgaggagcgtctctgcttggccacccatcgtctgggatatgaggagccccctctgcctggctgcccagtctggaaagtgaggagcgtctctgcccggccgccatcccatctaggaagcgaggagcgcctcttccccgccgccatcacatctaggaagtgaggagcgtctctgcccggccgcccatcgtctgagatgtggggagcacctctgccctgccgccctgtctgggatgtgaggagcgtctctgcccggccgctccgtctgagaagtgaggaaaccctctgcctggcaaccgccccgtctgagaagttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactgggtctggctctgggagaggagtggacagcagctggttga

SEQ ID NO: 9295 - DNA, 3581 bp, synthetic construct
  misc_feature 1..3581: note = Synthetic polypeptide
  source 1..3581: mol_type = other DNA
tccctctccctctccctctccctctccctctccctctccctcacggtctccctctgatgccgagccaaagctggatggtactgctgccatctcggctcactgcaacctccctgcctgattctcctgcctcagcctgccgagtgccgccacgcctgactggttttcgtttttttttggtggagacggggtttcgctgtgttggccgggctggtctccagctcctaaccgcgagtgatccgccagcctcggcctcccgaggtgccgggattgcagacggagtctcattcactcagtgctcaatggtgcccaggctggagtgcagtggcgtgatcttggctcgctacaacctccacctcccagccgcctgccttggcctcccaaagagccgagattgcagcctctgcccggccgccaccccgtctgggaagtgaggagcgtctctgcttggccacccatcgtctgggatatgaggagccccctctgcctggctgcccagtctggaaagtgaggagcgtctctgcccggccgccatcccatctaggaagcgaggagcgcctcttccccgccgccatcacatctaggaagtgaggagcgtctctgcccggccgcccatcgtctgagatgtggggagcacctctgccctgccgccctgtctgggatgtgaggagcgtctctgcccggccgctccgtctgagaagtgaggaaaccctctgcctggcaaccgccccgtctgagaagttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtctggctctgggagaggagtggacagcagctggttgagatacatccccatctggagacaggactgccactgacagaagatgtgagctgtgtctaa

SEQ ID NO: 9296 - DNA, 1815 bp, synthetic construct; identical to SEQ ID NO: 581
  misc_feature 1..1815: note = Synthetic polypeptide
  source 1..1815: mol_type = other DNA

SEQ ID NO: 9297 - DNA, 463 bp, synthetic construct; identical to SEQ ID NO: 7109
  misc_feature 1..463: note = Synthetic polypeptide
  source 1..463: mol_type = other DNA

SEQ ID NO: 9298 - DNA, 394 bp, synthetic construct; identical to SEQ ID NO: 701
  misc_feature 1..394: note = Synthetic polypeptide
  source 1..394: mol_type = other DNA

SEQ ID NO: 9299 - DNA, 700 bp, synthetic construct; identical to SEQ ID NO: 702
  misc_feature 1..700: note = Synthetic polypeptide
  source 1..700: mol_type = other DNA

SEQ ID NO: 9300 - DNA, 568 bp, synthetic construct; identical to SEQ ID NO: 703
  misc_feature 1..568: note = Synthetic polypeptide
  source 1..568: mol_type = other DNA

SEQ ID NO: 9301 - DNA, 535 bp, synthetic construct; identical to SEQ ID NO: 704
  misc_feature 1..535: note = Synthetic polypeptide
  source 1..535: mol_type = other DNA

SEQ ID NO: 9302 - DNA, 129 bp, synthetic construct; identical to SEQ ID NO: 705
  misc_feature 1..129: note = Synthetic polypeptide
  source 1..129: mol_type = other DNA

SEQ ID NO: 9303 - DNA, 435 bp, synthetic construct; identical to SEQ ID NO: 706
  misc_feature 1..435: note = Synthetic polypeptide
  source 1..435: mol_type = other DNA

SEQ ID NO: 9304 - DNA, 303 bp, synthetic construct; identical to SEQ ID NO: 707
  misc_feature 1..303: note = Synthetic polypeptide
  source 1..303: mol_type = other DNA

SEQ ID NO: 9305 - DNA, 270 bp, synthetic construct; identical to SEQ ID NO: 708
  misc_feature 1..270: note = Synthetic polypeptide
  source 1..270: mol_type = other DNA

SEQ ID NO: 9306 - DNA, 1967 bp, synthetic construct; identical to SEQ ID NO: 7428
  misc_feature 1..1967: note = Synthetic polypeptide
  source 1..1967: mol_type = other DNA

SEQ ID NO: 9307 - DNA, 1142 bp, synthetic construct; identical to SEQ ID NO: 7429
  misc_feature 1..1142: note = Synthetic polypeptide
  source 1..1142: mol_type = other DNA

SEQ ID NO: 9308 - DNA, 1490 bp, synthetic construct; identical to SEQ ID NO: 7414
  misc_feature 1..1490: note = Synthetic polypeptide
  source 1..1490: mol_type = other DNA

SEQ ID NO: 9309 - DNA, 1031 bp, synthetic construct; identical to SEQ ID NO: 7415
  misc_feature 1..1031: note = Synthetic polypeptide
  source 1..1031: mol_type = other DNA

SEQ ID NO: 9310 - DNA, 1079 bp, synthetic construct; identical to SEQ ID NO: 7416
  misc_feature 1..1079: note = Synthetic polypeptide
  source 1..1079: mol_type = other DNA

SEQ ID NO: 9311 - DNA, 1443 bp, synthetic construct; identical to SEQ ID NO: 6760
  misc_feature 1..1443: note = Synthetic polypeptide
  source 1..1443: mol_type = other DNA

SEQ ID NO: 9312 - DNA, 984 bp, synthetic construct; identical to SEQ ID NO: 6761
  misc_feature 1..984: note = Synthetic polypeptide
  source 1..984: mol_type = other DNA

SEQ ID NO: 9313 - DNA, 1032 bp, synthetic construct; identical to SEQ ID NO: 6762
  misc_feature 1..1032: note = Synthetic polypeptide
  source 1..1032: mol_type = other DNA

SEQ ID NO: 9314 - DNA, 1392 bp, synthetic construct; identical to SEQ ID NO: 6782
  misc_feature 1..1392: note = Synthetic polypeptide
  source 1..1392: mol_type = other DNA

SEQ ID NO: 9315 - DNA, 933 bp, synthetic construct; identical to SEQ ID NO: 6783
  misc_feature 1..933: note = Synthetic polypeptide
  source 1..933: mol_type = other DNA

SEQ ID NO: 9316 - DNA, 981 bp, synthetic construct; identical to SEQ ID NO: 6784
  misc_feature 1..981: note = Synthetic polypeptide
  source 1..981: mol_type = other DNA

SEQ ID NO: 9317 - DNA, 3591 bp, synthetic construct; identical to SEQ ID NO: 8632
  misc_feature 1..3591: note = Synthetic polypeptide
  source 1..3591: mol_type = other DNA

SEQ ID NO: 9318 - DNA, 3504 bp, synthetic construct; identical to SEQ ID NO: 8633
  misc_feature 1..3504: note = Synthetic polypeptide
  source 1..3504: mol_type = other DNA

SEQ ID NO: 9319 - DNA, 3531 bp, synthetic construct; identical to SEQ ID NO: 8634
  misc_feature 1..3531: note = Synthetic polypeptide
  source 1..3531: mol_type = other DNA

SEQ ID NO: 9320 - DNA, 1132 bp, synthetic construct; identical to SEQ ID NO: 8635
  misc_feature 1..1132: note = Synthetic polypeptide
  source 1..1132: mol_type = other DNA

SEQ ID NO: 9321 - DNA, 1078 bp, synthetic construct; identical to SEQ ID NO: 8636
  misc_feature 1..1078: note = Synthetic polypeptide
  source 1..1078: mol_type = other DNA

SEQ ID NO: 9322 - DNA, 3438 bp, synthetic construct; identical to SEQ ID NO: 8637
  misc_feature 1..3438: note = Synthetic polypeptide
  source 1..3438: mol_type = other DNA

SEQ ID NO: 9323 - DNA, 3621 bp, synthetic construct; identical to SEQ ID NO: 8638
  misc_feature 1..3621: note = Synthetic polypeptide
  source 1..3621: mol_type = other DNA

SEQ ID NO: 9324 - DNA, 1498 bp, synthetic construct; identical to SEQ ID NO: 8305
  misc_feature 1..1498: note = Synthetic polypeptide
  source 1..1498: mol_type = other DNA

SEQ ID NO: 9325 - DNA, 1195 bp, synthetic construct; identical to SEQ ID NO: 8306
  misc_feature 1..1195: note = Synthetic polypeptide
  source 1..1195: mol_type = other DNA

SEQ ID NO: 9326 - DNA, 1462 bp, synthetic construct; identical to SEQ ID NO: 8307
  misc_feature 1..1462: note = Synthetic polypeptide
  source 1..1462: mol_type = other DNA

SEQ ID NO: 9327 - DNA, 1489 bp, synthetic construct; identical to SEQ ID NO: 8308
  misc_feature 1..1489: note = Synthetic polypeptide
  source 1..1489: mol_type = other DNA

SEQ ID NO: 9328 - DNA, 1180 bp, synthetic construct; identical to SEQ ID NO: 8309
  misc_feature 1..1180: note = Synthetic polypeptide
  source 1..1180: mol_type = other DNA

SEQ ID NO: 9329 - DNA, 1257 bp, synthetic construct; identical to SEQ ID NO: 625
  misc_feature 1..1257: note = Synthetic polypeptide
  source 1..1257: mol_type = other DNA

SEQ ID NO: 9330 - DNA, 1215 bp, synthetic construct; identical to SEQ ID NO: 626
  misc_feature 1..1215: note = Synthetic polypeptide
  source 1..1215: mol_type = other DNA

SEQ ID NO: 9331 - DNA, 507 bp, synthetic construct; identical to SEQ ID NO: 628
  misc_feature 1..507: note = Synthetic polypeptide
  source 1..507: mol_type = other DNA

SEQ ID NO: 9332 - DNA, 313 bp, synthetic construct; identical to SEQ ID NO: 629
  misc_feature 1..313: note = Synthetic polypeptide
  source 1..313: mol_type = other DNA

SEQ ID NO: 9333 - DNA, 291 bp, synthetic construct; identical to SEQ ID NO: 630
  misc_feature 1..291: note = Synthetic polypeptide
  source 1..291: mol_type = other DNA

SEQ ID NO: 9334 - DNA, 1239 bp, synthetic construct
  misc_feature 1..1239: note = Synthetic polypeptide
  source 1..1239: mol_type = other DNA
ctctccctctccctctccctctccctcgccctctcccctttccacggtctcccctctccctctctttccacggtctccctctcacgccgagccgaagctggactgtactgccgccatctcggctcactgcagcctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccacgagtgatccgccagcctcggcctcctgaggtgccgggattgcagacagagtctcgttaactcagtgctcaatggtgcccaggctggagtgcagtggcgtgatctcggctccctgcagcctccacctcccagccgcctgccttggccccccacagtgccgagattgcagcctctgcccggccgccactccgtctgggaagtgaggagcgtctctgcctggccgcccatcgtctgggatgtgaggagcccctctgcctggctgcccagtctggaaagtgaggagcctctctgcccggccgccatcccacctaggaagtgaggagcgcctcttcccggccgccatcccatctaggaagtgaggagcgtctctgcccggccgccccgtctgagaagtgaggagaccctccgcctggcaactgccccgtctgagaagtgaggagcccctccgcccggcagctgccccgtctgagaagtccacaatctgcaggagctccggcgaagtgcctcactggccaccaaggtctttatccagagagactacagcgatgggaccatctgtcagttccagaccaaattccccccagagctggacagccggatcgagcggcagctctttgaagagactgtgaagaccctcaacggattttacgcagaggctgagaagattgggggcagctcctacctcgagggctgcctggcctgcgccacggcctacttcatcttcctctgcatggagacccactatgagaaggttctcaagaagatttcccgctacatccaggagcagaatgagaagatctttgcacctcgaggcctcctacttacagaccctgtggagcgtgggatgagggttattgagatctccatctacgaggaccggtgcagcagtggcagctccagcagcggcagcagcagcggcagtggcagcagcagcggtgggggtggtggggcgggggcccggtga

SEQ ID NO: 9335 - DNA, 223 bp, synthetic construct; identical to SEQ ID NO: 8494
  misc_feature 1..223: note = Synthetic polypeptide
  source 1..223: mol_type = other DNA

SEQ ID NO: 9336 - DNA, 2725 bp, synthetic construct; identical to SEQ ID NO: 6753
  misc_feature 1..2725: note = Synthetic polypeptide
  source 1..2725: mol_type = other DNA

SEQ ID NO: 9337 - DNA, 365 bp, synthetic construct; identical to SEQ ID NO: 7364
  misc_feature 1..365: note = Synthetic polypeptide
  source 1..365: mol_type = other DNA

SEQ ID NO: 9338 - DNA, 1418 bp, synthetic construct; identical to SEQ ID NO: 8571
  misc_feature 1..1418: note = Synthetic polypeptide
  source 1..1418: mol_type = other DNA

SEQ ID NO: 9339 - DNA, 1043 bp, synthetic construct; identical to SEQ ID NO: 8639
  misc_feature 1..1043: note = Synthetic polypeptide
  source 1..1043: mol_type = other DNA

SEQ ID NO: 9340 - DNA, 366 bp, synthetic construct; identical to SEQ ID NO: 8640
  misc_feature 1..366: note = Synthetic polypeptide
  source 1..366: mol_type = other DNA

SEQ ID NO: 9341 - DNA, 1579 bp, synthetic construct; identical to SEQ ID NO: 7461
  misc_feature 1..1579: note = Synthetic polypeptide
  source 1..1579: mol_type = other DNA

SEQ ID NO: 9342 - DNA, 1504 bp, synthetic construct; identical to SEQ ID NO: 7462
  misc_feature 1..1504: note = Synthetic polypeptide
  source 1..1504: mol_type = other DNA

SEQ ID NO: 9343 - DNA, 1002 bp, synthetic construct; identical to SEQ ID NO: 872
  misc_feature 1..1002: note = Synthetic polypeptide
  source 1..1002: mol_type = other DNA

SEQ ID NO: 9344 - DNA, 897 bp, synthetic construct; identical to SEQ ID NO: 873
  misc_feature 1..897: note = Synthetic polypeptide
  source 1..897: mol_type = other DNA

SEQ ID NO: 9345 - DNA, 836 bp, synthetic construct; identical to SEQ ID NO: 874
  misc_feature 1..836: note = Synthetic polypeptide
  source 1..836: mol_type = other DNA

SEQ ID NO: 9346 - DNA, 528 bp, synthetic construct; identical to SEQ ID NO: 875
  misc_feature 1..528: note = Synthetic polypeptide
  source 1..528: mol_type = other DNA

SEQ ID NO: 9347 - DNA, 1232 bp, synthetic construct; identical to SEQ ID NO: 6566
  misc_feature 1..1232: note = Synthetic polypeptide
  source 1..1232: mol_type = other DNA

SEQ ID NO: 9348 - DNA, 497 bp, synthetic construct; identical to SEQ ID NO: 6567
  misc_feature 1..497: note = Synthetic polypeptide
  source 1..497: mol_type = other DNA

SEQ ID NO: 9349 - DNA, 575 bp, synthetic construct; identical to SEQ ID NO: 6568
  misc_feature 1..575: note = Synthetic polypeptide
  source 1..575: mol_type = other DNA

SEQ ID NO: 9350 - DNA, 4522 bp, synthetic construct; identical to SEQ ID NO: 8450
  misc_feature 1..4522: note = Synthetic polypeptide
  source 1..4522: mol_type = other DNA

SEQ ID NO: 9351 - DNA, 2322 bp, synthetic construct; identical to SEQ ID NO: 7493
  misc_feature 1..2322: note = Synthetic polypeptide
  source 1..2322: mol_type = other DNA

SEQ ID NO: 9352 - DNA, 1698 bp, synthetic construct; identical to SEQ ID NO: 7494
  misc_feature 1..1698: note = Synthetic polypeptide
  source 1..1698: mol_type = other DNA

SEQ ID NO: 9353 - DNA, 811 bp, synthetic construct; identical to SEQ ID NO: 7500
  misc_feature 1..811: note = Synthetic polypeptide
  source 1..811: mol_type = other DNA

SEQ ID NO: 9354 - DNA, 829 bp, synthetic construct; identical to SEQ ID NO: 624
  misc_feature 1..829: note = Synthetic polypeptide
  source 1..829: mol_type = other DNA

SEQ ID NO: 9355 - DNA, 882 bp, synthetic construct
  misc_feature 1..882: note = Synthetic polypeptide
  source 1..882: mol_type = other DNA
cacggtctccctctcatgcggagccgaagctggactgtactgctgccatctcggctcactgcaacctccctgcctgattctcctgcctcagcctgccgagtgcctgcgattgcaggcacgcgccgccacgcctgactggttttggtggagaccgggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcactacaacctacacctcccagccgcctgccttggcctcccaaagtgccgagattgcagcctctgcccggccgccaccccgtctgggaagtgaggagtgtctctgcctggccgcccatcgtcggggatgtgaggagcccctctgcctggctgcccagtctggaaagtgaggagcgtctccacccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagtgcctctgcccggccgagaccccgtctgggaggtgagcatatgacggaggaggagatgttggattgctttgcttcactgtttggcctgaatcccgagggatggaaatccgagcctgcaacctgctccgtcaaaggttcagaaatttgccttgaagaagaacttccagacgaaatcactgcagaaatattcgcgactgaaattcttggcttaaccatttcagaagattccggccaggatggtcagtga

SEQ ID NO: 9356 - DNA, 807 bp, synthetic construct; identical to SEQ ID NO: 7401
  misc_feature 1..807: note = Synthetic polypeptide
  source 1..807: mol_type = other DNA

SEQ ID NO: 9357 - DNA, 453 bp, synthetic construct; identical to SEQ ID NO: 7402
  misc_feature 1..453: note = Synthetic polypeptide
  source 1..453: mol_type = other DNA

SEQ ID NO: 9358 - DNA, 1062 bp, synthetic construct; identical to SEQ ID NO: 8340
  misc_feature 1..1062: note = Synthetic polypeptide
  source 1..1062: mol_type = other DNA

SEQ ID NO: 9359 - DNA, 1218 bp, synthetic construct; identical to SEQ ID NO: 8394
  misc_feature 1..1218: note = Synthetic polypeptide
  source 1..1218: mol_type = other DNA

SEQ ID NO: 9360 - DNA, 1053 bp, synthetic construct; identical to SEQ ID NO: 8395
  misc_feature 1..1053: note = Synthetic polypeptide
  source 1..1053: mol_type = other DNA

SEQ ID NO: 9361 - DNA, 942 bp, synthetic construct; identical to SEQ ID NO: 8396
  misc_feature 1..942: note = Synthetic polypeptide
  source 1..942: mol_type = other DNA

SEQ ID NO: 9362 - DNA, 1091 bp, synthetic construct; identical to SEQ ID NO: 8397
  misc_feature 1..1091: note = Synthetic polypeptide
  source 1..1091: mol_type = other DNA

SEQ ID NO: 9363 - DNA, 1291 bp, synthetic construct
  misc_feature 1..1291: note = Synthetic polypeptide
  source 1..1291: mol_type = other DNA
cagccgcctgccttggcctcccaaagtgccgagattgcagcctctgcccggccgccaccccgtctgggaagtgaggagtgtctctgcctggccgcccatcgtctgggatgtgaggagcccctctgcctggctgcccagtctgtaaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagcgcctctgcccggcggagaccccgtctgggaggtgaggagcgtctctgcccggccgccccgtctgagaagtgaggagaccctctgcctggcaaccaccccgtctgagaagtgaggagcccctccgcccggcagctgccccgtctgagaactgtccctacctggctcgcaagctgacccttgccatccccatcatcgctgccatcctcttcttcttcgtcatgagctgcctgctgcagacaagcttcaccgaccctgggatcctgccccgggccactgtctgtgaagcagccgccctggagaaacagatcgacaacacaggcagttctacataccggccaccccctcggacccgggaggtgctgatcaacgggcagatggtgaagctgaagtactgcttcacctgcaagatgttccggccaccccgaacctcacactgcagtgtctgcgacaactgtgtggaacgatttgaccatcactgcccctgggtgggcaactgtgtggggagacggaactatcgcttcttctacgcgtttattctctccctctcattcctgacggccttcatcttcgcctgtgtggtcacccacctgacgttgcgcgctcagggaagcaacttcctctccactctgaaggagacaccagcaagcgtgctggagttggtgatctgcttcttctccatctggtccattctgggcctctcagggtttcacacgtacctcgtcgcctccaacctgactactaatgaagacatcaaaggctcgtggtccagcaagaggggcggtgaggcctctgtcaacccctacagccataaaagtattatcaccaactgctgtgctgtgctctgtggccccctacctcccagcctaattgaccggaggggatttgtgcagtccgacaccgtgttgccctcacccatcagaagcgatgagccagcctgcagagccaagcctgatgccagcatggtaggaggccacccctga

SEQ ID NO: 9364 - DNA, 959 bp, synthetic construct; identical to SEQ ID NO: 8691
  misc_feature 1..959: note = Synthetic polypeptide
  source 1..959: mol_type = other DNA

SEQ ID NO: 9365 - DNA, 3401 bp, synthetic construct; identical to SEQ ID NO: 8199
  misc_feature 1..3401: note = Synthetic polypeptide
  source 1..3401: mol_type = other DNA

SEQ ID NO: 9366 - DNA, 3155 bp, synthetic construct; identical to SEQ ID NO: 8200
  misc_feature 1..3155: note = Synthetic polypeptide
  source 1..3155: mol_type = other DNA

SEQ ID NO: 9367 - DNA, 233 bp, synthetic construct; identical to SEQ ID NO: 856
  misc_feature 1..233: note = Synthetic polypeptide
  source 1..233: mol_type = other DNA

SEQ ID NO: 9368 - DNA, 2419 bp, synthetic construct; identical to SEQ ID NO: 7455
  misc_feature 1..2419: note = Synthetic polypeptide
  source 1..2419: mol_type = other DNA

SEQ ID NO: 9369 - DNA, 1222 bp, synthetic construct; identical to SEQ ID NO: 6653
  misc_feature 1..1222: note = Synthetic polypeptide
  source 1..1222: mol_type = other DNA

SEQ ID NO: 9370 - DNA, 451 bp, synthetic construct; identical to SEQ ID NO: 6654
  misc_feature 1..451: note = Synthetic polypeptide
  source 1..451: mol_type = other DNA

SEQ ID NO: 9371 - DNA, 292 bp, synthetic construct; identical to SEQ ID NO: 6655
  misc_feature 1..292: note = Synthetic polypeptide
  source 1..292: mol_type = other DNA

SEQ ID NO: 9372 - DNA, 504 bp, synthetic construct; identical to SEQ ID NO: 6656
  misc_feature 1..504: note = Synthetic polypeptide
  source 1..504: mol_type = other DNA

SEQ ID NO: 9373 - DNA, 449 bp, synthetic construct; identical to SEQ ID NO: 6657
  misc_feature 1..449: note = Synthetic polypeptide
  source 1..449: mol_type = other DNA

SEQ ID NO: 9374 - DNA, 454 bp, synthetic construct; identical to SEQ ID NO: 6658
  misc_feature 1..454: note = Synthetic polypeptide
  source 1..454: mol_type = other DNA

SEQ ID NO: 9375 - DNA, 287 bp, synthetic construct; identical to SEQ ID NO: 7101
  misc_feature 1..287: note = Synthetic polypeptide
  source 1..287: mol_type = other DNA

SEQ ID NO: 9376 - DNA, 281 bp, synthetic construct; identical to SEQ ID NO: 7102
  misc_feature 1..281: note = Synthetic polypeptide
  source 1..281: mol_type = other DNA

SEQ ID NO: 9377 - DNA, 74 bp, synthetic construct; identical to SEQ ID NO: 7010
  misc_feature 1..74: note = Synthetic polypeptide
  source 1..74: mol_type = other DNA

SEQ ID NO: 9378 - DNA, 1224 bp, synthetic construct; identical to SEQ ID NO: 6690
  misc_feature 1..1224: note = Synthetic polypeptide
  source 1..1224: mol_type = other DNA

SEQ ID NO: 9379 - DNA, 842 bp, synthetic construct; identical to SEQ ID NO: 6534
  misc_feature 1..842: note = Synthetic polypeptide
  source 1..842: mol_type = other DNA

SEQ ID NO: 9380 - DNA, 331 bp, synthetic construct; identical to SEQ ID NO: 8434
  misc_feature 1..331: note = Synthetic polypeptide
  source 1..331: mol_type = other DNA

SEQ ID NO: 9381 - DNA, 1538 bp, synthetic construct; identical to SEQ ID NO: 8435
  misc_feature 1..1538: note = Synthetic polypeptide
  source 1..1538: mol_type = other DNA

SEQ ID NO: 9382 - DNA, 884 bp, synthetic construct; identical to SEQ ID NO: 8436
  misc_feature 1..884: note = Synthetic polypeptide
  source 1..884: mol_type = other DNA

SEQ ID NO: 9383 - DNA, 343 bp, synthetic construct; identical to SEQ ID NO: 8437
  misc_feature 1..343: note = Synthetic polypeptide
  source 1..343: mol_type = other DNA

SEQ ID NO: 9384 - DNA, 401 bp, synthetic construct; identical to SEQ ID NO: 8438
  misc_feature 1..401: note = Synthetic polypeptide
  source 1..401: mol_type = other DNA

SEQ ID NO: 9385 - DNA, 1535 bp, synthetic construct; identical to SEQ ID NO: 8439
  misc_feature 1..1535: note = Synthetic polypeptide
  source 1..1535: mol_type = other DNA

SEQ ID NO: 9386 - DNA, 255 bp, synthetic construct; identical to SEQ ID NO: 8440
  misc_feature 1..255: note = Synthetic polypeptide
  source 1..255: mol_type = other DNA

SEQ ID NO: 9387 - DNA, 88 bp, synthetic construct; identical to SEQ ID NO: 8441
  misc_feature 1..88: note = Synthetic polypeptide
  source 1..88: mol_type = other DNA

SEQ ID NO: 9388 - DNA, 429 bp, synthetic construct; identical to SEQ ID NO: 8442
  misc_feature 1..429: note = Synthetic polypeptide
  source 1..429: mol_type = other DNA

SEQ ID NO: 9389 - DNA, 1022 bp, synthetic construct; identical to SEQ ID NO: 590
  misc_feature 1..1022: note = Synthetic polypeptide
  source 1..1022: mol_type = other DNA

SEQ ID NO: 9390 - DNA, 347 bp, synthetic construct; identical to SEQ ID NO: 591
  misc_feature 1..347: note = Synthetic polypeptide
  source 1..347: mol_type = other DNA

SEQ ID NO: 9391 - DNA, 1109 bp, synthetic construct; identical to SEQ ID NO: 592
  misc_feature 1..1109: note = Synthetic polypeptide
  source 1..1109: mol_type = other DNA

SEQ ID NO: 9392 - DNA, 85 bp, synthetic construct; identical to SEQ ID NO: 601
  misc_feature 1..85: note = Synthetic polypeptide
  source 1..85: mol_type = other DNA

SEQ ID NO: 9393 - DNA, 269 bp, synthetic construct; identical to SEQ ID NO: 600
  misc_feature 1..269: note = Synthetic polypeptide
  source 1..269: mol_type = other DNA

SEQ ID NO: 9394 - DNA, 1058 bp, synthetic construct; identical to SEQ ID NO: 7375
  misc_feature 1..1058: note = Synthetic polypeptide
  source 1..1058: mol_type = other DNA

SEQ ID NO: 9395 - DNA, 701 bp, synthetic construct; identical to SEQ ID NO: 658
  misc_feature 1..701: note = Synthetic polypeptide
  source 1..701: mol_type = other DNA

SEQ ID NO: 9396 - DNA, 423 bp, synthetic construct; identical to SEQ ID NO: 6550
  misc_feature 1..423: note = Synthetic polypeptide
  source 1..423: mol_type = other DNA

SEQ ID NO: 9397 - DNA, 1340 bp, synthetic construct; identical to SEQ ID NO: 7107
  misc_feature 1..1340: note = Synthetic polypeptide
  source 1..1340: mol_type = other DNA

SEQ ID NO: 9398 - DNA, 1506 bp, synthetic construct
  misc_feature 1..1506: note = Synthetic polypeptide
  source 1..1506: mol_type = other DNA
cctctctttccatggtctccctctcatgcggagccggactggactgtactgctgccatctcggctcactgcaacctccctgcctgattctcctgcctcagcctgccgagtgcctgcgattgcaggcacgcgccgccacgcctgactggttttggtggagacggggtttcgctgtgttggccgggccggtctccagcccctaaccgcgagtgatccgccagcctcggcctcccgaggtgccaggattgcagacggagtctcgttcactcagtgctcaatggtgcccaggctggagtgcagtggcgtgatctcggctcgctacaacctacacctcccagccgcctgccttggcctcctaaagtgccgagattgcagcctctgcccggccgccaccccgtctgggaagtgaggagtgtctctgcctggccgcccatcgtctgggatgtgaggagcccctctgcctggctgcccagtctggaaagtgaggagcgcctcttcccagccgccatcccatctaggaagtgaggagcgcctcttcccagccgccatcacatctaggaagtgaggagcgtctctgcccggccgcccatcgtctgagatgtggggagtgcctctgccccgcggccccatctgggatgtgaggagcacctctgcccggccgcgaccccgtctgggaggtgaggagcgtctctgcccggccaccccgtctgagaagtgaggagaccctctgcctggcaaccaccccgtctgagaagtgaggagcccctccgcccggcagctgccccgtctgagaagtgtccaggatgtggaggtgcacttggaggaccagatggtcttggtacacaccactctacccagccaggaggtgcaggctctcctggaaggcacggggcggcaggcggtactcaagggcatgggcagcggccagttgcagaatctgggggcagcagtggccatcctgggggggcctggcaccgtgcagggggtggtgcgcttcctacagctgacccctgagcgctgcctcatcgagggaactattgacggcctggagcctgggctgcatggactccacgtccatcagtacggggaccttacaaacaactgcaacagctgtgggaatcactttaaccctgatggagcatctcatgggggcccccaggactctgaccggcaccgcggagacctgggcaatgtccgtgctgatgctgacggccgcgccatcttcagaatggaggatgagcagctgaaggtgtgggatgtgattggccgcagcctgattattgatgagggagaagatgacctgggccggggaggccatcccttatccaagatcacagggaactccggggagaggttggcctgtggcatcattgcacgctccgctggccttttccagaaccccaagcagatctgctcttgcgatggcctcaccatctgggaggagcgaggccggcccatcgctggcaagggccgaaaggagtcagcgcagccccctgcccacctttga

SEQ ID NO: 9399 - DNA, 1431 bp, synthetic construct
  misc_feature 1..1431: note = Synthetic polypeptide
  source 1..1431: mol_type = other DNA
cctctctttccatggtctccctctcatgcggagccggactggactgtactgctgccatctcggctcactgcaacctccctgcctgattctcctgcctcagcctgccgagtgcctgcgattgcaggcacgcgccgccacgcctgactggttttggtggagacggggtttcgctgtgttggccgggccggtctccagcccctaaccgcgagtgatccgccagcctcggcctcccgaggtgccaggattgcagacggagtctcgttcactcagtgctcaatggtgcccaggctggagtgcagtggcgtgatctcggctcgctacaacctacacctcccagccgcctgccttggcctcctaaagtgccgagattgcagcctctgcccggccgccaccccgtctgggaagtgaggagtgtctctgcctggccgcccatcgtctgggatgtgaggagcccctctgcctggctgcccagtctggaaagtgaggagcgcctcttcccagccgccatcccatctaggaagtgaggagcgcctcttcccagccgccatcacatctaggaagtgaggagcgtctctgcccggccgcccatcgtctgagatgtggggagtgcctctgccccgcggccccatctgggatgtgaggagcacctctgcccggccgcgaccccgtctgggaggtgaggagcgtctctgcccggccaccccgtctgagaagtgaggagaccctctgcctggcaaccaccccgtctgagaagtgaggagcccctccgcccggcagctgccccgtctgagaagtgtccaggatgtggaggtgcacttggaggaccagatggtcttggtacacaccactctacccagccaggaggtgcaggctctcctggaaggcacggggcggcaggcggtactcaagggcatgggcagcggccagttgcagaatctgggggcagcagtggccatcctgggggggcctggcaccgtgcagggggtggtgcgcttcctacagctgacccctgagcgctgcctcatcgagggaactattgacggcctggagcctgggctgcatggactccacgtccatcagtacggggaccttacaaacaactgcaacagctgtgggaatcactttaaccctgatggagcatctcatgggggcccccaggactctgaccggacagggccaagaggaccttgcctgcccagtccttggggagctcagatcctacgagactggtacccacaggaggaaatgggtactttagggaagcaggaagaggcgtcggaatcaggaaatcagaagatagcagcttggcaccacgtggcacacatcccctatacacacactggatctcattccagcaccgcggagacctgggcaatgtccgtgctgatgctgacggccgcgccatcttcagaatggaggatgagcagctga

SEQ ID NO: 9400 - DNA, 1002 bp, synthetic construct; identical to SEQ ID NO: 7528
  misc_feature 1..1002: note = Synthetic polypeptide
  source 1..1002: mol_type = other DNA

SEQ ID NO: 9401 - DNA, 1757 bp, synthetic construct
  misc_feature 1..1757: note = Synthetic polypeptide
  source 1..1757: mol_type = other DNA
ctccctctccctctcggtctccctctccctctcggtctccctctccctctctttccacggtctccctctgatgccgagccaaagctggacggtactgctgccatctcggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctctctacaacctccaactcccagccgcctgccttggcctcccaaagtgccgagagtgcagcctctgcctggccgcccatcgtctgggacgtgaggagcccctctgcctggctgcccagtctggaaagtaaggagcgtctctgcctggccgccatcccatctgggaagtgaggagcgcctcttcccggccgccatcccatctaggaagtgaggagcgtctctgcccggccgcccatcgtctgcgatgtggggagcgcctctgccccaacgccccgtctgggatgtgaggagcgcctctgcccggccacgaccccgtctgggaggaatccttaacttctgtgccaacaactacctgggcctgagcagccaccctgaggtgatccaggcaggtctgcaggctctggaggagtttggagctggcctcagctctgtccgctttatctgtggaacccagagcatccacaagaatctagaagcaaaaatagcccgcttccaccagcgggaggatgccatcctctatcccagctgttatgacgccaacgccggcctctttgaggccctgctgaccccagaggacgcagtcctgtcggacgagctgaaccatgcctccatcatcgacggcatccggctgtgcaaggcccacaagtaccgctatcgccacctggacatggccgacctagaagccaagctgcaggaggcccagaagcatcggctgcgcctggtggccactgatggggccttttccatggatggcgacatcgcacccctgcaggagatctgctgcctcgcctctagatatggtgccctggtcttcatggatgaatgccatgccactggcttcctggggcccacaggacggggcacagatgagctgctgggtgtgatggaccaggtcaccatcatcaactccaccctggggaaggccctgggtggagcatcagggggctacacgacagggcctgggcccctggtgtccctgctgcggcagcgcgcccggccatacctcttctccaacagtctgccacctgctgtcgttggctgcgcctccaaggccctagatctgctgatggggagtaacaccattgtccagtctatggctgccaagacccagaggttccgtagtaagatggaagctgctggcttcactatctcgggagccagtcaccccatctgccctgtgatgctgggtgatgcccggctggcctctcgcatggcggatgacatgctgaagagaggcatctttgtcatcgggttcagctaccccgtggtccccaagggcaaggcccggatccgggtacagatctcagcagtgcatagcgaggaagacattgaccgctgcgtggaggccttcgtggaagtggggcgactgcacggggcactgccctga

SEQ ID NO: 9402 - DNA, 950 bp, synthetic construct
  misc_feature 1..950: note = Synthetic polypeptide
  source 1..950: mol_type = other DNA
ctccctctccctctcggtctccctctccctctcggtctccctctccctctctttccacggtctccctctgatgccgagccaaagctggacggtactgctgccatctcggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctctctacaacctccaactcccagccgcctgccttggcctcccaaagtgccgagagtgcagcctctgcctggccgcccatcgtctgggacgtgaggagcccctctgcctggctgcccagtctggaaagtaaggagcgtctctgcctggccgccatcccatctgggaagtgaggagcgcctcttcccggccgccatcccatctaggaagtgaggagcgtctctgcccggccgcccatcgtctgcgatgtggggagcgcctctgccccaacgccccgtctgggatgtgaggagcgcctctgcccggccacgaccccgtctgggaggaatccttaacttctgtgccaacaactacctgggcctgagcagccaccctgaggtgatccaggcaggtctgcaggctctggaggagtttggagctggcctcagctctgtccgctttatctgtggaacccagagcatccacaagaatctagaagcaaaaatagcccgcttccaccagcgggaggatgccatcctctatcccagctgttatgacgccaacgccggcctctttgagagcagggcgctggtccagcccggc

SEQ ID NO: 9403 - DNA, 1259 bp, synthetic construct
  misc_feature 1..1259: note = Synthetic polypeptide
  source 1..1259: mol_type = other DNA
ctccctctccctctcggtctccctctccctctcggtctccctctccctctctttccacggtctccctctgatgccgagccaaagctggacggtactgctgccatctcggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctctctacaacctccaactcccagccgcctgccttggcctcccaaagtgccgagagtgcagcctctgcctggccgcccatcgtctgggacgtgaggagcccctctgcctggctgcccagtctggaaagtaaggagcgtctctgcctggccgccatcccatctgggaagtgaggagcgcctcttcccggccgccatcccatctaggaagtgaggagcgtctctgcccggccgcccatcgtctgcgatgtggggagcgcctctgccccaacgccccgtctgggatgtgaggagcgcctctgcccggccacgaccccgtctgggaggaatccttaacttctgtgccaacaactacctgggcctgagcagccaccctgaggtgatccaggcaggtctgcaggctctggaggagtttggagctggcctcagctctgtccgctttatctgtggaacccagagcatccacaagaatctagaagcaaaaatagcccgcttccaccagcgggaggatgccatcctctatcccagctgttatgacgccaacgccggcctctttgagagcagggcgctggtccagcccggcactgagacacgggggccccagagagaagcacagaacaccttgcctctctacccagaggagcgccctggctggcagtacagttttttgatttgctggagtcccggtcaagggagaagcccagggtggttaaatgatggctctacgctcactgcctccctccaggccctgctgaccccagaggacgcagtcctgtcggacgagctgaaccatgcctccatcatcgacggcatccggctgtgcaaggcccacaagtaccgctatcgccacctggacatggccgacctagaagccaagctgcaggaggcccag

SEQ ID NO: 9404 - DNA, 2208 bp, synthetic construct; identical to SEQ ID NO: 8588
  misc_feature 1..2208: note = Synthetic polypeptide
  source 1..2208: mol_type = other DNA

SEQ ID NO: 9405 - DNA, 2358 bp, synthetic construct; identical to SEQ ID NO: 8589
  misc_feature 1..2358: note = Synthetic polypeptide
  source 1..2358: mol_type = other DNA

SEQ ID NO: 9406 - DNA, 2223 bp, synthetic construct; identical to SEQ ID NO: 8590
  misc_feature 1..2223: note = Synthetic polypeptide
  source 1..2223: mol_type = other DNA

SEQ ID NO: 9407 - DNA, 2286 bp, synthetic construct; identical to SEQ ID NO: 8591
  misc_feature 1..2286: note = Synthetic polypeptide
  source 1..2286: mol_type = other DNA

SEQ ID NO: 9408 - DNA, 2004 bp, synthetic construct; identical to SEQ ID NO: 8592
  misc_feature 1..2004: note = Synthetic polypeptide
  source 1..2004: mol_type = other DNA

SEQ ID NO: 9409 - DNA, 2001 bp, synthetic construct; identical to SEQ ID NO: 8593
  misc_feature 1..2001: note = Synthetic polypeptide
  source 1..2001: mol_type = other DNA

SEQ ID NO: 9410 - DNA, 673 bp, synthetic construct
  misc_feature 1..673: note = Synthetic polypeptide
  source 1..673: mol_type = other DNA
gccgccccgtccgggaggcaaaatgaagctgaatctggtgcagatctttttcatgttgctgatgctgctgctgggcctggggatgggcctggggttgggacttcatatggctacagcagtcttggaggagagtgatcaaccgctcaatgaattttggtccagtgactcacaggacaaagctgaggccactgaggagggagacggcacccaaaccacagaaacgctggtgcttagcaacaaagaagtggtgcaacctggctggccagaagatcccatcctcggtgaagatgaggttgggggtaacaagatgctcagagcctcagctctctttcagagcaacaaagactatcttaggcttgaccagacagatagagaatgcaatgatatgatggcacacaagatgaaggagcccagtcagagttgcatagcccagtatgcattcatccatgaggatctaaacacagtcaaagctgtctgtaacagtcctgtcattgcctgtgagctcaaggggggaaaatgtcacaaaagctcccgaccttttgatttgacattgtgcgagctgtcccaaccagaccaggtcactcctaactgcaattacctaacttctgttataaaaaagcacattattataacctgtaatgacatgaagcgccagttaccaactggacaatga

SEQ ID NO: 9411 - DNA, 704 bp, synthetic construct
  misc_feature 1..704: note = Synthetic polypeptide
  source 1..704: mol_type = other DNA
tttcctgcatgaaagcagcacatgttgttctctcggcctggtataaaagtttggtcacggggacccgagcaagaggggtcattgctgtcctctgggtccttgcctttggcatcggattgactccattcctggggtggaacagtaaagacagtgccaccaacaactgcacagaaccctgggatggaaccacgaatgaaagctgctgccttgtgaagtgtctctttgagaatgtggtccccatgagctacatggtatatttcaatttctttgggtgtgttctgcccccactgcttataatgctggtgatctacattaagatcttcctggtggcctgcaggcagcttcagcgcactgagctgatggaccactcgaggaccaccctccagcgggagatccatgcagccaagtcactggccatgattgtggggatttttgccctgtgctggttacctgtgcatgctgttaactgtgtcactcttttccagccagctcagggtaaaaataagcccaagtgggcaatgaatatggccattcttctgtcacatgccaattcagttgtcaatcccattgtctatgcttaccggaaccgagacttccgctacacttttcacaaaattatctccaggtatcttctctgccaagcagatgtcaagagtgggaatggtcaggctggggtacagcctgctctcggtgtgggcctatga

SEQ ID NO: 9412 - DNA, 3959 bp, synthetic construct
  misc_feature 1..3959: note = Synthetic polypeptide
  source 1..3959: mol_type = other DNA
ctctccctctccctctccctctttctccctctccctctccccatggtctccctctccctctctttccacggtctccctctgatgccgagccaaagctggactgtactgccgccatctcggctcactgcaacctccctgcctgattctcctgcctcagcctgcccagtgcctgcgattgcaggcgcgcgccgccacgcctgactggttttcgtatttttttggtggagacggggtttcgctgtgttggccgggctggtctccagctcctagccgcgagtgatctgccagcctcggcatcctgaggtgccgggattgcagacggagtctggttcactcagtgctcaatggtgcccaggctggagtgcagtggcgtgatctcggctcgctacaacatccacctcccagccgcctgccttggcctcccaaagtgccgagattgcagcctctgcccggccaccaccccgtctgggaagtgaggagcgtctctgcctggccgcccatcgtctgggacatgaggagcccctctgcctggctgcccagtctggaaagtgaggagcgtctctgcccggccgccatcccatctaggaagtgaggagcgcctcttcccggccgccatcccatctaggaagtgaggagcgtctctgcccggccacccatcgtctgagatgtggggagcgcctctgccccgccgccccatctgggatgtgaggagcgcctctgcccagccgcgaccccgtctgggaggtgaggagcgtctctgcccggccgccccgtctgagaagtgaggagaccctccgcccggcagccgccccgtctgagaagaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagggggaaggttcctcctcattcttgtcggaaacttgccatgaggatccctctgtttcccccaactttactccccccaaccctcaagctctcaagtggtga

SEQ ID NO: 9413 - DNA, 4088 bp, synthetic construct
  misc_feature 1..4088: note = Synthetic polypeptide
  source 1..4088: mol_type = other DNA
ctctccctctccctctccctctttctccctctccctctccccatggtctccctctccctctctttccacggtctccctctgatgccgagccaaagctggactgtactgccgccatctcggctcactgcaacctccctgcctgattctcctgcctcagcctgcccagtgcctgcgattgcaggcgcgcgccgccacgcctgactggttttcgtatttttttggtggagacggggtttcgctgtgttggccgggctggtctccagctcctagccgcgagtgatctgccagcctcggcatcctgaggtgccgggattgcagacggagtctggttcactcagtgctcaatggtgcccaggctggagtgcagtggcgtgatctcggctcgctacaacatccacctcccagccgcctgccttggcctcccaaagtgccgagattgcagcctctgcccggccaccaccccgtctgggaagtgaggagcgtctctgcctggccgcccatcgtctgggacatgaggagcccctctgcctggctgcccagtctggaaagtgaggagcgtctctgcccggccgccatcccatctaggaagtgaggagcgcctcttcccggccgccatcccatctaggaagtgaggagcgtctctgcccggccacccatcgtctgagatgtggggagcgcctctgccccgccgccccatctgggatgtgaggagcgcctctgcccagccgcgaccccgtctgggaggtgaggagcgtctctgcccggccgccccgtctgagaagtgaggagaccctccgcccggcagccgccccgtctgagaagaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagctgcaggtggagctggagcaagaataccaagacaaattcaaaagactgcccctcgagattttggaattcgtgcaggaagccatgaaaggaaagatcagtgaagacagcaatcacggttctgcccctctctccctgtcctcagaccctggaaaagtgaaccacaagactccctccagtgaggagctgggaggagacatcccaggaaaagaatttgatactcctctgtga

SEQ ID NO: 9414 - DNA, 1137 bp, synthetic construct
  misc_feature 1..1137: note = Synthetic polypeptide
  source 1..1137: mol_type = other DNA
ctctccctctccctctccctctttctccctctccctctccccatggtctccctctccctctctttccacggtctccctctgatgccgagccaaagctggactgtactgccgccatctcggctcactgcaacctccctgcctgattctcctgcctcagcctgcccagtgcctgcgattgcaggcgcgcgccgccacgcctgactggttttcgtatttttttggtggagacggggtttcgctgtgttggccgggctggtctccagctcctagccgcgagtgatctgccagcctcggcatcctgaggtgccgggattgcagacggagtctggttcactcagtgctcaatggtgcccaggctggagtgcagtggcgtgatctcggctcgctacaacatccacctcccagccgcctgccttggcctcccaaagtgccgagattgcagcctctgcccggccaccaccccgtctgggaagtgaggagcgtctctgcctggccgcccatcgtctgggacatgaggagcccctctgcctggctgcccagtctggaaagtgaggagcgtctctgcccggccgccatcccatctaggaagtgaggagcgcctcttcccggccgccatcccatctaggaagtgaggagcgtctctgcccggccacccatcgtctgagatgtggggagcgcctctgccccgccgccccatctgggatgtgaggagcgcctctgcccagccgcgaccccgtctgggaggtgaggagcgtctctgcccggccgccccgtctgagaagtgaggagaccctccgcccggcagccgccccgtctgagaagaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaagggtggaaaaagctaatgaggctgcgaaaagtgagcagagctgtggaaaggctcccccaaaacattttcaccttcattttataaagcaaaataaaatgcttgaacctg

SEQ ID NO: 9415 - DNA, 943 bp, synthetic construct; identical to SEQ ID NO: 6540
  misc_feature 1..943: note = Synthetic polypeptide
  source 1..943: mol_type = other DNA

SEQ ID NO: 9416 - DNA, 1007 bp, synthetic construct; identical to SEQ ID NO: 7489
  misc_feature 1..1007: note = Synthetic polypeptide
  source 1..1007: mol_type = other DNA

SEQ ID NO: 9417 - DNA, 806 bp, synthetic construct; identical to SEQ ID NO: 8266
  misc_feature 1..806: note = Synthetic polypeptide
  source 1..806: mol_type = other DNA

SEQ ID NO: 9418 - DNA, 1376 bp, synthetic construct
  misc_feature 1..1376: note = Synthetic polypeptide
  source 1..1376: mol_type = other DNA
ctctccctctccccctccccctccccctctccccacggtctccctctccctctcttgccacggtctccctctgatgccgagccgaagctggactgtgctgctgccatcttggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctcgctacaacctccacctcccagctgcctgccttggccccccaaagtgccgagattgcagcctctgcccggccaccaccccgtctgggaagtgaggagcgtctctgcctggccgcccgtcgtctgggatgtgaggagcctctctgcctggctgcccagtctggaaagtgaggagcgtctctgcccggccgccatcccatctaggaagtgaggagcgtctctgcccggccgcccatcatctgagatgtggggagcgcctctgccctgccgccccgtctgggatgtgaggagcgtctctgcccggccgccccgtctgagaagtgaggagaccctctgcctggcaaccgccccgtctgagaagtgagaagcccctccgcccggcagccaccccgtctgggaagtgaggagcgtctccacccggcagccaccccgtccgggagggaggtgggggtcagccgccccgtctgggagggaggtgggggggtcagccccccgcccggccagccgccccttccgggaggtgaggggcgcctctgcccggccgcccctactgggaagtgaggagcccctctgcccggacagccgccccgtccgggagggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctag

SEQ ID NO: 9419 - DNA, 1211 bp, synthetic construct
  misc_feature 1..1211: note = Synthetic polypeptide
  source 1..1211: mol_type = other DNA
ctctccctctccccctccccctccccctctccccacggtctccctctccctctcttgccacggtctccctctgatgccgagccgaagctggactgtgctgctgccatcttggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctcgctacaacctccacctcccagctgcctgccttggccccccaaagtgccgagattgcagcctctgcccggccaccaccccgtctgggaagtgaggagcgtctctgcctggccgcccgtcgtctgggatgtgaggagcctctctgcctggctgcccagtctggaaagtgaggagcgtctctgcccggccgccatcccatctaggaagtgaggagcgtctctgcccggccgcccatcatctgagatgtggggagcgcctctgccctgccgccccgtctgggatgtgaggagcgtctctgcccggccgccccgtctgagaagtgaggagaccctctgcctggcaaccgccccgtctgagaagtgagaagcccctccgcccggcagccaccccgtctgggaagtgaggagcgtctccacccggcagccaccccgtccgggagggaggtgggggtcagccgccccgtctgggagggaggtgggggggtcagccccccgcccggccagccgccccttccgggaggtgaggggcgcctctgcccggccgcccctactgggaagtgaggagcccctctgcccggacagccgccccgtccgggagggaggtgtgaccatgaagctcatggatgaggtcgccgggatcgtggctgcacgccactgcaagaccaacatcgtcacagcttccgtggacgccattaattttcatgacaagatcagaaaagctcacgtaatgcctgctggcgctgaccacacagctccttcctcctctcccagcactggcacgaagtgctccctgctgcgtcatcaccatctcgggacgcatgaccttcacgagcaataa

SEQ ID NO: 9420 - DNA, 1100 bp, synthetic construct
  misc_feature 1..1100: note = Synthetic polypeptide
  source 1..1100: mol_type = other DNA
ctctccctctccccctccccctccccctctccccacggtctccctctccctctcttgccacggtctccctctgatgccgagccgaagctggactgtgctgctgccatcttggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctcgctacaacctccacctcccagctgcctgccttggccccccaaagtgccgagattgcagcctctgcccggccaccaccccgtctgggaagtgaggagcgtctctgcctggccgcccgtcgtctgggatgtgaggagcctctctgcctggctgcccagtctggaaagtgaggagcgtctctgcccggccgccatcccatctaggaagtgaggagcgtctctgcccggccgcccatcatctgagatgtggggagcgcctctgccctgccgccccgtctgggatgtgaggagcgtctctgcccggccgccccgtctgagaagtgaggagaccctctgcctggcaaccgccccgtctgagaagtgagaagcccctccgcccggcagccaccccgtctgggaagtgaggagcgtctccacccggcagccaccccgtccgggagggaggtgggggtcagccgccccgtctgggagggaggtgggggggtcagccccccgcccggccagccgccccttccgggaggtgaggggcgcctctgcccggccgcccctactgggaagtgaggagcccctctgcccggacagccgccccgtccgggagggaggtgtgaccatgaagctcatggatgaggtcgccgggatcgtggctgcacgccactgcaagaccaacatcgtcacagcttccgtggacgccattaattttcatgacaagatcagaaaagctccttag

SEQ ID NO: 9421 - DNA, 1249 bp, synthetic construct
  misc_feature 1..1249: note = Synthetic polypeptide
  source 1..1249: mol_type = other DNA
ctctccctctccccctccccctccccctctccccacggtctccctctccctctcttgccacggtctccctctgatgccgagccgaagctggactgtgctgctgccatcttggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctcgctacaacctccacctcccagctgcctgccttggccccccaaagtgccgagattgcagcctctgcccggccaccaccccgtctgggaagtgaggagcgtctctgcctggccgcccgtcgtctgggatgtgaggagcctctctgcctggctgcccagtctggaaagtgaggagcgtctctgcccggccgccatcccatctaggaagtgaggagcgtctctgcccggccgcccatcatctgagatgtggggagcgcctctgccctgccgccccgtctgggatgtgaggagcgtctctgcccggccgccccgtctgagaagtgaggagaccctctgcctggcaaccgccccgtctgagaagtgagaagcccctccgcccggcagccaccccgtctgggaagtgaggagcgtctccacccggcagccaccccgtccgggagggaggtgggggtcagccgccccgtctgggagggaggtgggggggtcagccccccgcccggccagccgccccttccgggaggtgaggggcgcctctgcccggccgcccctactgggaagtgaggagcccctctgcccggacagccgccccgtccgggagggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaagg

SEQ ID NO: 9422 - DNA, 809 bp, synthetic construct; identical to SEQ ID NO: 8505
  misc_feature 1..809: note = Synthetic polypeptide
  source 1..809: mol_type = other DNA

SEQ ID NO: 9423 - DNA, 809 bp, synthetic construct; identical to SEQ ID NO: 8506
  misc_feature 1..809: note = Synthetic polypeptide
  source 1..809: mol_type = other DNA

SEQ ID NO: 9424 - DNA, 1927 bp, synthetic construct; identical to SEQ ID NO: 8368
  misc_feature 1..1927: note = Synthetic polypeptide
  source 1..1927: mol_type = other DNA

SEQ ID NO: 9425 - DNA, 1458 bp, synthetic construct
  misc_feature 1..1458: note = Synthetic polypeptide
  source 1..1458: mol_type = other DNA
ctccttccacggtctccctctgatgccgagccaaagctggacggtactgctgccatctcggctcactgcaacctccctgcctgattctcctgcctcagcctgccgagggcctgcgattgcaggcgcgcgccaccacgcctgactggttttcgtacttttttggtggagacggggtttcactgtgttggccgggctggtctccagctcctaaccgcgagtgatccgccagccttggcctcccaaggtgccgggattgcagacggagtctggttcactcagtgctcaatggtgcccaggctggagtgcagtggcgtgatctcagctcgctacaacctccatctcccagccgcctgccttggcctcccaaagtgccgagattgcagcctctgcctggccgccaccccgtctgggaagtgaggagcgtctctgcctggccgcccatcgtctgggatacgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctgggccgcaaccctgtctgggaggtgaggagcgtctctgcccggccgccccgtctgagaagtgaggaaaccctctgcctggcaaccgccccgtctgagaagtgaggagcccctccgtccggcagccaccccgtctgggaagcaaaatgaagctgaatctggtgcagatctttttcatgttgctgatgctgctgctgggcctggggatgggcctggggttgggacttcatatggctacagcagtcttggaggagagtgatcaaccgctcaatgaattttggtccagtgactcacaggacaaagctgaggccactgaggagggagacggcacccaaaccacagaaacgctggtgcttagcaacaaagaagtggtgcaacctggctggccagaagatcccatcctcggtgaagatgaggttgggggtaacaagatgctcagagcctcagctctctttcagagcaacaaagactatcttaggcttgaccagacagatagagaatgcaatgatatgatggcacacaagatgaaggagcccagtcagagttgcatagcccagtatgcattcatccatgaggatctaaacacagtcaaagctgtctgtaacagtcctgtcattgcctgtgagctcaaggggggaaaatgtcacaaaagctcccgaccttttgatttgacattgtgcgagctgtcccaaccagaccaggtcactcctaactgcaattacctaacttctgttataaaaaagcacattattataacctgtaatgacatgaagcgccagttaccaactggacaatga

SEQ ID NO: 9426 - DNA, 771 bp, synthetic construct
  misc_feature 1..771: note = Synthetic polypeptide
  source 1..771: mol_type = other DNA
cagccgcctgccttggcctcccaaagtgccgagattgcagcctctgcccggctgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccgtctgagaagatggggacccagacacgccaaagcctgtgagcttcacagtgaaggagacagtgtgccccaggacgacacagcagtcaccagaggattgtgacttcaagaaggacgggctggtgaagcggtgtatggggacagtgaccctcaaccaggccaggggctcctttgacatcagttgtgataaggataacaagagatttgccctgctgggtgatttcttccggaaatctaaagagaagattggcaaagagtttaaaagaattgtccagagaatcaaggattttttgcggaatcttgtacccaggacagagtcctag

SEQ ID NO: 9427 - DNA, 814 bp, synthetic construct; identical to SEQ ID NO: 8476
  misc_feature 1..814: note = Synthetic polypeptide
  source 1..814: mol_type = other DNA

SEQ ID NO: 9428 - DNA, 1348 bp, synthetic construct; identical to SEQ ID NO: 8477
  misc_feature 1..1348: note = Synthetic polypeptide
  source 1..1348: mol_type = other DNA

SEQ ID NO: 9429 - DNA, 1084 bp, synthetic construct; identical to SEQ ID NO: 580
  misc_feature 1..1084: note = Synthetic polypeptide
  source 1..1084: mol_type = other DNA

SEQ ID NO: 9430 - DNA, 2636 bp, synthetic construct; identical to SEQ ID NO: 8432
  misc_feature 1..2636: note = Synthetic polypeptide
  source 1..2636: mol_type = other DNA

SEQ ID NO: 9431 - DNA, 3776 bp, synthetic construct; identical to SEQ ID NO: 8433
  misc_feature 1..3776: note = Synthetic polypeptide
  source 1..3776: mol_type = other DNA

SEQ ID NO: 9432 - DNA, 2471 bp, synthetic construct; identical to SEQ ID NO: 576
  misc_feature 1..2471: note = Synthetic polypeptide
  source 1..2471: mol_type = other DNA

SEQ ID NO: 9433 - DNA, 2822 bp, synthetic construct
  misc_feature 1..2822: note = Synthetic polypeptide
  source 1..2822: mol_type = other DNA
aaagctgtgtggatggagcccttagagagagcaggctgtcttgcagagccctagaacctgccattccgtggacctggaaggcagagcatcaaaccaaacagagctattctcaagccttataagccttaagatgtgacagaatttaccttaataagttttggatttgcttgggacccatcacccttgctttctttcctatatctcctttttggaataagacgtccatcctatgcctgtcccaccattgtattatggaaaagaaacatgtagctcaactggtttcacaagttcacagctggtgatgaatttgccttatcatgaatcacacctctagtctcatctacgtctgatttggacaatgtttagagattgagaatttatcacaagttgatggtcctcaagtggaagagcaacttctttcaaccacagttcagccaaatctggagaaggaggtctggggcatggagaataactcatcagaatcatcttttgcagattcttctgtagtttcagaatcagacacaagtttggcagaaggaagtgtcagctgcttagatgaaagtcttggacataacagcaacatgggcagtgattcaggcaccatgggaagtgattcagatgaagagaatgtggcagcaagagcatccccggagccagaactccagctcaggccttaccaaatggaagttgcccagccagccttggaagggaagaatatcatcatctgcctccctacagggagtggaaaaaccagagtggctgtttacattgccaaggatcacttagacaagaagaaaaaagcatctgagcctggaaaagttatagttcttgtcaataaggtactgctagttgaacagctcttccgcaaggagttccaaccatttttgaagaaatggtatcgtgttattggattaagtggtgatacccaactgaaaatatcatttccagaagttgtcaagtcctgtgatattattatcagtacagctcaaatccttgaaaactccctcttaaacttggaaaatggagaagatgctggtgttcaattgtcagacttttccctcattatcattgatgaatgtcatcacaccaacaaagaagcagtgtataataacatcatgaggcattatttgatgcagaagttgaaaaacaatagactcaagaaagaaaacaaaccagtgattccccttcctcagatactgggactaacagcttcacctggtgttggaggggccacgaagcaagccaaagctgaagaacacattttaaaactatgtgccaatcttgatgcatttactattaaaactgttaaagaaaaccttgatcaactgaaaaaccaaatacaggagccatgcaagaagtttgccattgcagatgcaaccagagaagatccatttaaagagaaacttctagaaataatgacaaggattcaaacttattgtcaaatgagtccaatgtcagattttggaactcaaccctatgaacaatgggccattcaaatggaaaaaaaagctgcaaaagaaggaaatcgcaaagaacgtgtttgtgcagaacatttgaggaagtacaatgaggccctacaaattaatgacacaattcgaatgatagatgcgtatactcatcttgaaactttctataatgaagagaaagataagaagtttgcagtcatagaagatgatagtgatgagggtggtgatgatgagtattgtgatggtgatgaagatgaggatgatttaaagaaacctttgaaactggatgaaacagatagatttctcatgactttattttttgaaaacaataaaatgttgaaaaggctggctgaaaacccagaatatgaaaatgaaaagctgaccaaattaagaaataccataatggagcaatatactaggactgaggaatcagcacgaggaataatctttacaaaaacacgacagagtgcatatgcgctttcccagtggattactgaaaatgaaaaatttgctgaagtaggagtcaaagcccaccatctgattggagctggacacagcagtgagttcaaacccatgacacagaatgaacaaaaagaagtcattagtaaatttcgcactggaaaaataaatctgcttatcgctaccacagtggcagaagaaggtctggatattaaagaatgtaacattgttatccgttatggtctcgtcaccaatgaaatagccatggtccaggcccgtggtcgagccagagctgatgagagcacctacgtcctggttgctcacagtggttcaggagttatcgaacatgagacagttaatgatttccgagagaagatgatgtataaagctatacattgtgttcaaaatatgaaaccagaggagtatgctcataagattttggaattacagatgcaaagtataatggaaaagaaaatgaaaaccaagagaaatattgccaagcattacaagaataacccatcactaataactttcctttgcaaaaactgcagtgtgctagcctgttctggggaagatatccatgtaattgagaaaatgcatcacgtcaatatgaccccagaattcaaggaactttacattgtaagagaaaacaaagcactgcaaaagaagtgtgccgactatcaaataaatggtgaaatcatctgcaaatgtggccaggcttggggaacaatgatggtgcacaaaggcttagatttgccttgtctcaaaataaggaattttgtagtggttttcaaaaataattcaacaaagaaacaatacaaaaagtgggtagaattacctatcacatttcccaatcttgactattcagaatgctgtttatttagtgatgaggattag

SEQ ID NO: 9434 - DNA, 639 bp, synthetic construct
  misc_feature 1..639: note = Synthetic polypeptide
  source 1..639: mol_type = other DNA
gcctggtgtggtggtgcatgtctgtagtatcagctacttgggaggctgagattgcaagatctcttgagcccaggagttggaggccagcctgggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccg

SEQ ID NO: 9435 - DNA, 547 bp, synthetic construct
  misc_feature 1..547: note = Synthetic polypeptide
  source 1..547: mol_type = other DNA
gcctggtgtggtggtgcatgtctgtagtatcagctacttgggaggctgagattgcaagatctcttgagcccaggagttggaggccagcctgggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcct

SEQ ID NO: 9436 - DNA, 449 bp, synthetic construct
  misc_feature 1..449: note = Synthetic polypeptide
  source 1..449: mol_type = other DNA
gcctggtgtggtggtgcatgtctgtagtatcagctacttgggaggctgagattgcaagatctcttgagcccaggagttggaggccagcctgggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccc

SEQ ID NO: 9437 - DNA, 809 bp, synthetic construct; identical to SEQ ID NO: 8586
  misc_feature 1..809: note = Synthetic polypeptide
  source 1..809: mol_type = other DNA

SEQ ID NO: 9438 - DNA, 809 bp, synthetic construct; identical to SEQ ID NO: 8587
  misc_feature 1..809: note = Synthetic polypeptide
  source 1..809: mol_type = other DNA

SEQ ID NO: 9439 - DNA, 809 bp, synthetic construct; identical to SEQ ID NO: 8613
  misc_feature 1..809: note = Synthetic polypeptide
  source 1..809: mol_type = other DNA

SEQ ID NO: 9440 - DNA, 7177 bp, synthetic construct; identical to SEQ ID NO: 574
  misc_feature 1..7177: note = Synthetic polypeptide
  source 1..7177: mol_type = other DNA

SEQ ID NO: 9441 - DNA, 7195 bp, synthetic construct; identical to SEQ ID NO: 575
  misc_feature 1..7195: note = Synthetic polypeptide
  source 1..7195: mol_type = other DNA

SEQ ID NO: 9442 - DNA, 175 bp, synthetic construct
  misc_feature 1..175: note = Synthetic polypeptide
  source 1..175: mol_type = other DNA
gaaaagagactggaaggaaacagcacaacagaagcagcatttgtctccggggtgtggaggctggtggcccctgcccacacccccacacctgcaggcggagccagagaaccaccagtaccaggacctgctaaaccccgaccctgccccctactgccagctggtgccaacttcctga

SEQ ID NO: 9443 - DNA, 178 bp, synthetic construct
  misc_feature 1..178: note = Synthetic polypeptide
  source 1..178: mol_type = other DNA
gaaaagagactggaaggaaacagcacaacagaagcagcatttgtctccggggtgtggaggctggtggcccctgcccacacccccacacctgcaggcggagccagagaaccaccagtaccagcaggacctgctaaaccccgaccctgccccctactgccagctggtgccaacttcctga

SEQ ID NO: 9444 - DNA, 921 bp, synthetic construct; identical to SEQ ID NO: 8811
  misc_feature 1..921: note = Synthetic polypeptide
  source 1..921: mol_type = other DNA

SEQ ID NO: 9445 - DNA, 809 bp, synthetic construct; identical to SEQ ID NO: 8505
  misc_feature 1..809: note = Synthetic polypeptide
  source 1..809: mol_type = other DNA

SEQ ID NO: 9446 - DNA, 852 bp, synthetic construct; identical to SEQ ID NO: 753
  misc_feature 1..852: note = Synthetic polypeptide
  source 1..852: mol_type = other DNA

SEQ ID NO: 9447 - DNA, 281 bp, synthetic construct
  misc_feature 1..281: note = Synthetic polypeptide
  source 1..281: mol_type = other DNA
cattgtgaatcactgtacactcaggaaccagactgagttgaaatcctgtctttgccacctattgacagcacgatcttaagtggattttagcctctgcctgtttctcagctgaatatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacct

SEQ ID NO: 9448 - DNA, 990 bp, synthetic construct
  misc_feature 1..990: note = Synthetic polypeptide
  source 1..990: mol_type = other DNA
cattgtgaatcactgtacactcaggaaccagactgagttgaaatcctgtctttgccacctattgacagcacgatcttaagtggattttagcctctgcctgtttctcagctgaatatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatattccaaaagctcaacagcaacacccaggtagttttgctgtcagccacaatgccttctgatgtgcttgaggtgaccaagaagttcatgagggaccccattcggattcttgtcaagaaggaagagttgaccctggagggtatccgccagttctacatcaacgtggaacgagaggagtggaagctggacacactatgtgacttgtatgaaaccctgaccatcacccaggcagtcatcttcatcaacacccggaggaaggtggactggctcaccgagaagatgcatgctcgagatttcactgtatccgccatgcatggagatatggaccaaaaggaacgagacgtgattatgagggagtttcgttctggctctagcagagttttgattaccactgacctgctggccagaggcattgatgtgcagcaggtttctttagtcatcaactatgaccttcccaccaacagggaaaactatatccacagaatcggtcgaggtggacggtttggccgtaaaggtgtggctattaacatggtgacagaagaagacaagaggactcttcgagacattgagaccttctacaacacctccattgaggaaatgcccctcaatgttgctgacctcatctga

SEQ ID NO: 9449 - DNA, 338 bp, synthetic construct
  misc_feature 1..338: note = Synthetic polypeptide
  source 1..338: mol_type = other DNA
cattgtgaatcactgtacactcaggaaccagactgagttgaaatcctgtctttgccacctattgacagcacgatcttaagtggattttagcctctgcctgtttctcagctgaatatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccg

SEQ ID NO: 9450 - DNA, 367 bp, synthetic construct
  misc_feature 1..367: note = Synthetic polypeptide
  source 1..367: mol_type = other DNA
cattgtgaatcactgtacactcaggaaccagactgagttgaaatcctgtctttgccacctattgacagcacgatcttaagtggattttagcctctgcctgtttctcagctgaatatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatat

SEQ ID NO: 9451 - DNA, 197 bp, synthetic construct
  misc_feature 1..197: note = Synthetic polypeptide
  source 1..197: mol_type = other DNA
cattgtgaatcactgtacactcaggaaccagactgagttgaaatcctgtctttgccacctattgacagcacgatcttaagtggattttagcctctgcctgtttctcagctgaatatacagaaggtggtcatggcactaggagactacatgggcgcctcctgtcacgcctgtatcgggggcaccaacgtgcgtgctga

SEQ ID NO: 9452 - DNA, 813 bp, synthetic construct
  misc_feature 1..813: note = Synthetic polypeptide
  source 1..813: mol_type = other DNA
cattgtgaatcactgtacactcaggaaccagactgagttgaaatcctgtctttgccacctattgacagcacgatcttaagtggattttagcctctgcctgtttctcagctgaatatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatattccaaaagctcaacagcaacacccaggtagttttgctgtcagccacaatgccttctgatgtgcttgaggtgaccaagaagttcatgagggaccccattcggattcttgtcaagaaggaagagttgaccctggagggtatccgccagttctacatcaacgtggaacgagaggagtggaagctggacacactatgtgacttgtatgaaaccctgaccatcacccaggcagtcatcttcatcaacacccggaggaaggtggactggctcaccgagaagatgcatgctcgagatttcactgtatccgccatgcatggagatatggaccaaaaggaacgagacgtgattatgagggagtttcgttctggctctagcagagttttgattaccactgacctgctgggaaaactatatccacagaatcggtcgaggtggacggtttggccgtaa

SEQ ID NO: 9453 - DNA, 583 bp, synthetic construct
  misc_feature 1..583: note = Synthetic polypeptide
  source 1..583: mol_type = other DNA
cattgtgaatcactgtacactcaggaaccagactgagttgaaatcctgtctttgccacctattgacagcacgatcttaagtggattttagcctctgcctgtttctcagctgaatatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatattccaaaagctcaacagcaacacccaggaagagttgaccctggagggtatccgccagttctacatcaacgtggaacgagaggagtggaagctggacacactatgtgacttgtatgaaaccctgaccatcacccaggcagtcatcttcatcaacacccggaggaaggtggactggctcaccgagaagatgcatgctcgagatttcactgtatccgcca

SEQ ID NO: 9454 - DNA, 795 bp, synthetic construct
  misc_feature 1..795: note = Synthetic polypeptide
  source 1..795: mol_type = other DNA
cattgtgaatcactgtacactcaggaaccagactgagttgaaatcctgtctttgccacctattgacagcacgatcttaagtggattttagcctctgcctgtttctcagctgaatatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatattccaaaagctcaacagcaacacccaggtagttttgctgtcagccacaatgccttctgatgtgcttgaggtgaccaagaagttcatgagggaccccattcggattcttgtcaagaaggaagagttgaccctggagggtatccgccagttctacatcaacgtggaacgagaggagtggaagctggacacactatgtgacttgtatgaaaccctgaccatcacccaggcagtcatcttcatcaacacccggaggaaggtggactggctcaccgagaagatgcatgctcgagatttcactgtatccgccatgcatggagatatggaccaaaaggaacgagacgtgattatgagggagtttcgttctggctctagcagagttttgattaccactgacctgctgaatcggtcgaggtggacggtttggccgtaa

SEQ ID NO: 9455 - DNA, 588 bp, synthetic construct
  misc_feature 1..588: note = Synthetic polypeptide
  source 1..588: mol_type = other DNA
cattgtgaatcactgtacactcaggaaccagactgagttgaaatcctgtctttgccacctattgacagcacgatcttaagtggattttagcctctgcctgtttctcagctgaatatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatattccaaaagctcaacagcaacacccaggtagttttgctgtcagccacaatgccttctgatgtgcttgaggtgaccaagaagttcatgagggaccccattcggattcttgtcaagaaggaagagttgaccctggagggtatccgccagttctacatcaacgtggaacgagaggagtggaagctggacacactatgtgacttgtatgaaaccctgaccatcacc

SEQ ID NO: 9456 - DNA, 379 bp, synthetic construct
  misc_feature 1..379: note = Synthetic polypeptide
  source 1..379: mol_type = other DNA
cattgtgaatcactgtacactcaggaaccagactgagttgaaatcctgtctttgccacctattgacagcacgatcttaagtggattttagcctctgcctgtttctcagctgaatatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatattccaaaagctca

SEQ ID NO: 9457 - DNA, 1334 bp, synthetic construct
  misc_feature 1..1334: note = Synthetic polypeptide
  source 1..1334: mol_type = other DNA
aaagagcccctaaatgcagcgcctctgccctgtctgggaagtgaggagcgcctctgcccagtcgtcaactgtctgggaagtggggagcacttctgcctggccactgccccatctgggaatgtaaagaactggccaagtccaaggcagaagtggcctgcatcgcagtgtacgaaacagacgtgtttgtcgtcggaaccgagagaggatgcgcttttgttaatgccaggacggattttcagaaagattttgcaaaatactgcgttgcagagggactgtgtgaggtgaaacctccctgccctgtgaacgggatgcaggtccactcgggcgaaacggaaatactcaggaaggcagtggaggactatttctgcttttgttatggtaaagccttagggacaacagtgatggtgcctgttccctatgagaagatgctgcgagaccagtcggctgtggtagtgcaggggcttccggaaggcgttgcctttcaacaccctgagaattacgaccttgcaaccctgaaatggattttggagaacaaagcagggatttcattcatcataaatagacccttcctaggaccagagagtcagctgggtggccctgggatggtaacagatgcggagagatccatagtatcaccaagtgaaagctgcggccccatcaatgtgaaaactgaacccatggaagattctggcatttcactgaaagcagaagctgtctcagtcaagaaagaatcagaagatcctaattactatcaatataatatgcaaggaagccacccttcttccacaagcaatgaagtaatagaaatggaattaccaatggaagattccactccgctggtcccttcagaagaaccaaatgaggaccctgaagccgaggtgaaaatcgaaggaaacacaaattcatccagtgttacaaattctgcagcaggtgttgaagatcttaacatcgttcaagtgactgttccagataatgagaaggaaagattatcaagcattgaaaagattaaacagctaagagaacaagttaatgacctctttagccgaaaatttggtgaagcaattggcgtggatttccctgtgaaagttccctacaggaagatcacattcaaccctggctgtgtggtgattgatggcatgcccccgggggtggtattcaaggcccccggctatctggaaatcagttccatgaggaggatcttggaggcagctgagtttatcaaattcacagtcatcaggccgcttccagggcttgagctcagtaatggacttttggaggccaaggcaagaggattgcttgaggccaggagtttgagaccagcctgggcaacatag

SEQ ID NO: 9458 - DNA, 701 bp, synthetic construct
  misc_feature 1..701: note = Synthetic polypeptide
  source 1..701: mol_type = other DNA
aaagagcccctaaatgcagcgcctctgccctgtctgggaagtgaggagcgcctctgcccagtcgtcaactgtctgggaagtggggagcacttctgcctggccactgccccatctgggaatgtaaagaactggccaagtccaaggcagaagtggcctgcatcgcagtgtacgaaacagacgtgtttgtcgtcggaaccgagagaggatgcgcttttgttaatgccaggacggattttcagaaagattttgcaaaatactgcgttgcagagggactgtgtgaggtgaaacctccctgccctgtgaacgggatgcaggtccactcgggcgaaacggaaatactcaggaaggcagtggaggactatttctgcttttgttatggtaaagccttagggacaacagtgatggtgcctgttccctatgagaagatgctgcgagaccagtcggctgtggtagtgcaggggcttccggaaggcgttgcctttcaacaccctgagaattacgaccttgcaaccctgaaatggattttggagaacaaagcagggatttcattcatcataaatagacccttcctaggaccagagagtcagctgggtggccctgggatggtaacagatgcggagagatccatagtatcaccaagtgaaaggcatttcactgaaagcagaagctgtctcagtcaagaaagaatcagaagatcctaa

SEQ ID NO: 9459 - DNA, 2870 bp, synthetic construct
  misc_feature 1..2870: note = Synthetic polypeptide
  source 1..2870: mol_type = other DNA
aaagagcccctaaatgcagcgcctctgccctgtctgggaagtgaggagcgcctctgcccagtcgtcaactgtctgggaagtggggagcacttctgcctggccactgccccatctgggaatgtaaagaactggccaagtccaaggcagaagtggcctgcatcgcagtgtacgaaacagacgtgtttgtcgtcggaaccgagagaggatgcgcttttgttaatgccaggacggattttcagaaagattttgcaaaatactgcgttgcagagggactgtgtgaggtgaaacctccctgccctgtgaacgggatgcaggtccactcgggcgaaacggaaatactcaggaaggcagtggaggactatttctgcttttgttatggtaaagccttagggacaacagtgatggtgcctgttccctatgagaagatgctgcgagaccagtcggctgtggtagtgcaggggcttccggaaggcgttgcctttcaacaccctgagaattacgaccttgcaaccctgaaatggattttggagaacaaagcagggatttcattcatcataaatagacccttcctaggaccagagagtcagctgggtggccctgggatggtaacagatgcggagagatccatagtatcaccaagtgaaagctgcggccccatcaatgtgaaaactgaacccatggaagattctggcatttcactgaaagcagaagctgtctcagtcaagaaagaatcagaagatcctaattactatcaatataatatgcaaggaagccacccttcttccacaagcaatgaagtaatagaaatggaattaccaatggaagattccactccgctggtcccttcagaagaaccaaatgaggaccctgaagccgaggtgaaaatcgaaggaaacacaaattcatccagtgttacaaattctgcagcaggtgttgaagatcttaacatcgttcaagtgactgttccagataatgagaaggaaagattatcaagcattgaaaagattaaacagctaagagaacaagttaatgacctctttagccgaaaatttggtgaagcaattggcgtggatttccctgtgaaagttccctacaggaagatcacattcaaccctggctgtgtggtgattgatggcatgcccccgggggtggtattcaaggcccccggctatctggaaatcagttccatgaggaggatcttggaggcagctgagtttatcaaattcacagtcatcaggccgcttccagggcttgagctcagtaatgtgggaaaacgcaagatagaccaggagggccgtgtgtttcaagaaaagtgggagagagcgtatttcttcgtggaagtacagaatattccaacatgtctcatatgcaaacaaagcatgtctgtgtccaaagaatataacctaagacgccactatcaaaccaatcacagcaagcattatgaccagtatacggaaagaatgcgtgacgagaagcttcacgagctgaaaaaagggctcaggaagtatctcttaggctcgtcagacaccgagtgtcccgagcaaaaacaagtgtttgcaaacccaagtccaacccagaaatcccccgtgcagcctgtagaggacctagctgggaacttatgggagaagttacgtgaaaaaatcaggtcttttgtggcatattctatcgcaatcgatgagatcacggatataaataataccacccagttggccatattcatccgtggtgtcgatgagaatttcgatgtgtccgaagaacttctggacacggtgcccatgacgggtacaaaatctggcaacgagatctttttgcgtgttgagaagagcctgaaaaagttctgtatcaactggtcgagattagtaagcgtggcctccactggcaccccagcgatggtggatgccaataacgggcttgtcacaaaactgaagtccagggtggcgacgttctgcaagggtgcggaactgaagtccatctgttgtataattcatccggaatcactctgtgctcagaagttgaagatggaccacgtcatggacgtggtagtgaagtccgtgaactggatatgctcccggggactgaaccacagcgagttcacaaccttgctctatgagctggacagccagtatggtagcctcctgtactacacggagattaagtggctcagtcgcgggctcgtgctaaagagatttttcgaatccttggaagaaatcgactccttcatgtcatccagagggaaacccctgcctcaactgagctccatagattggatccgagacctggccttcttggttgacatgacgatgcatctgaacgctttgaacatctctctccaaggacactcccaaatcgtcacgcagatgtatgacctgatccgggcgttcctagcaaaactgtgcctctgggagactcatttgacgaggaataatctggcccactttcccaccctgaaattggtttccagaaatgaaagcgatggcctgaactacattcccaaaatcgcggaactcaagaccgaattccagaaaaggctgtctgatttcaaactctacgaaagcgaactgactctgttcagctccccgttctccacgaagatcgacagtgtgcacgaggagctccagatggaggttatcgacctgcaatgcaacacggtcctgaagacgaaatacgacaaggtgggaataccagaattctacaagtacctctggggtagctacccgaaatacaagcaccattgcgcaaagattctttccatgttcgggagcacctacatctgcgaacagctgttctccattatgaaactgagcaaaacaaaatactgctcccagttaaaggattcccagtgggattctgtactccacatcgcaacgtga

SEQ ID NO: 9460 - DNA, 809 bp, synthetic construct; identical to SEQ ID NO: 8643
  misc_feature 1..809: note = Synthetic polypeptide
  source 1..809: mol_type = other DNA

SEQ ID NO: 9461 - DNA, 117 bp, synthetic construct
  misc_feature 1..117: note = Synthetic polypeptide
  source 1..117: mol_type = other DNA
ccttcctctttcccttccaagggctggtgtgagttgcagtttcttctccttgcaaaacatctgaagaaaatctcagtgttcctggtacatggtaggatcaacttcctgaccttgtga

SEQ ID NO: 9462 - DNA, 809 bp, synthetic construct; identical to SEQ ID NO: 8699
  misc_feature 1..809: note = Synthetic polypeptide
  source 1..809: mol_type = other DNA

SEQ ID NO: 9463 - DNA, 127 bp, synthetic construct; identical to SEQ ID NO: 8697
  misc_feature 1..127: note = Synthetic polypeptide
  source 1..127: mol_type = other DNA

SEQ ID NO: 9464 - DNA, 333 bp, synthetic construct; identical to SEQ ID NO: 6583
  misc_feature 1..333: note = Synthetic polypeptide
  source 1..333: mol_type = other DNA

SEQ ID NO: 9465 - DNA, 809 bp, synthetic construct; identical to SEQ ID NO: 8699
  misc_feature 1..809: note = Synthetic polypeptide
  source 1..809: mol_type = other DNA

SEQ ID NO: 9466 - DNA, 463 bp, synthetic construct; identical to SEQ ID NO: 524
  misc_feature 1..463: note = Synthetic polypeptide
  source 1..463: mol_type = other DNA

SEQ ID NO: 9467 - DNA, 1093 bp, synthetic construct; identical to SEQ ID NO: 7796
  misc_feature 1..1093: note = Synthetic polypeptide
  source 1..1093: mol_type = other DNA

SEQ ID NO: 9468 - DNA, 771 bp, synthetic construct; identical to SEQ ID NO: 8620
  misc_feature 1..771: note = Synthetic polypeptide
  source 1..771: mol_type = other DNA

SEQ ID NO: 9469 - DNA, 720 bp, synthetic construct; identical to SEQ ID NO: 8621
  misc_feature 1..720: note = Synthetic polypeptide
  source 1..720: mol_type = other DNA

SEQ ID NO: 9470 - DNA, 464 bp, synthetic construct; identical to SEQ ID NO: 8622
  misc_feature 1..464: note = Synthetic polypeptide
  source 1..464: mol_type = other DNA

SEQ ID NO: 9471 - DNA, 112 bp, synthetic construct; identical to SEQ ID NO: 7120
  misc_feature 1..112: note = Synthetic polypeptide
  source 1..112: mol_type = other DNA

SEQ ID NO: 9472 - DNA, 509 bp, synthetic construct; identical to SEQ ID NO: 7445
  misc_feature 1..509: note = Synthetic polypeptide
  source 1..509: mol_type = other DNA

SEQ ID NO: 9473 - DNA, 285 bp, synthetic construct; identical to SEQ ID NO: 6932
  misc_feature 1..285: note = Synthetic polypeptide
  source 1..285: mol_type = other DNA

SEQ ID NO: 9474 - DNA, 333 bp, synthetic construct; identical to SEQ ID NO: 6933
  misc_feature 1..333: note = Synthetic polypeptide
  source 1..333: mol_type = other DNA

SEQ ID NO: 9475 - DNA, 207 bp, synthetic construct; identical to SEQ ID NO: 6934
  misc_feature 1..207: note = Synthetic polypeptide
  source 1..207: mol_type = other DNA

SEQ ID NO: 9476 - DNA, 555 bp, synthetic construct; identical to SEQ ID NO: 6935
  misc_feature 1..555: note = Synthetic polypeptide
  source 1..555: mol_type = other DNA

SEQ ID NO: 9477 - DNA, 225 bp, synthetic construct; identical to SEQ ID NO: 6936
  misc_feature 1..225: note = Synthetic polypeptide
  source 1..225: mol_type = other DNA

SEQ ID NO: 9478 - DNA, 2747 bp, synthetic construct; identical to SEQ ID NO: 8475
  misc_feature 1..2747: note = Synthetic polypeptide
  source 1..2747: mol_type = other DNA

SEQ ID NO: 9479 - DNA, 809 bp, synthetic construct; identical to SEQ ID NO: 8643
  misc_feature 1..809: note = Synthetic polypeptide
  source 1..809: mol_type = other DNA

SEQ ID NO: 9480 - DNA, 1346 bp, synthetic construct; identical to SEQ ID NO: 7758
  misc_feature 1..1346: note = Synthetic polypeptide
  source 1..1346: mol_type = other DNA

SEQ ID NO: 9481 - DNA, 369 bp, synthetic construct; identical to SEQ ID NO: 6492
  misc_feature 1..369: note = Synthetic polypeptide
  source 1..369: mol_type = other DNA

SEQ ID NO: 9482 - DNA, 1671 bp, synthetic construct
  misc_feature 1..1671: note = Synthetic polypeptide
  source 1..1671: mol_type = other DNA
gcaggggttccagggccaggccatttccgctggcgcaggactctgctagcagcaacctgcctgaagtcttcctttggcctggctgagagtttctgagacctgcgctggagcggagacggaggcagcctggtggaggtgtatctcctagacaccagcatacagagtgaccaccgggaaatcgagggcagggtcatggtcaccgacttcgagaatgtgcccgaggaggacgggacccgcttccacagacaggccagcaagtgtgacagtcatggcacccacctggcaggggtggtcagcggccgggatgccggcgtggccaagggtgccagcatgcgcagcctgcgcgtgctcaactgccaagggaagggcacggttagcggcaccctcataggcctggagtttattcggaaaagccagctggtccagcctgtggggccactggtggtgctgctgcccctggcgggtgggtacagccgcgtcctcaacgccgcctgccagcgcctggcgagggctggggtcgtgctggtcaccgctgccggcaacttccgggacgatgcctgcctctactccccagcctcagctcccgaggtcatcacagttggggccaccaatgcccaagaccagccggtgaccctggggactttggggaccaactttggccgctgtgtggacctctttgccccaggggaggacatcattggtgcctccagcgactgcagcacctgctttgtgtcacagagtgggacatcacaggctgctgcccacgtggctggcattgcagccatgatgctgtctgccgagccggagctcaccctggccgagttgaggcagagactgatccacttctctgccaaagatgtcatcaatgaggcctggttccctgaggaccagcgggtactgacccccaacctggtggccgccctgccccccagcacccatggggcaggttggcagctgttttgcaggactgtatggtcagcacactcggggcctacacggatggccacagccgtcgcccgctgcgccccagatgaggagctgctgagctgctccagtttctccaggagtgggaagcggcggggcgagcgcatggaggcccaagggggcaagctggtctgccgggcccacaacgcttttgggggtgagggtgtctacgccattgccaggtgctgcctgctaccccaggccaactgcagcgtccacacagctccaccagctgaggccagcatggggacccgtgtccactgccaccaacagggccacgtcctcacaggctgcagctcccactgggaggtggaggaccttggcacccacaagccgcctgtgctgaggccacgaggtcagcccaaccagtgcgtgggccacagggaggccagcatccacgcttcctgctgccatgccccaggtctggaatgcaaagtcaaggagcatggaatcccggcccctcaggagcaggtgaccgtggcctgcgaggagggctggaccctgactggctgcagtgccctccctgggacctcccacgtcctgggggcctacgccgtagacaacacgtgtgtagtcaggagccgggacgtcagcactacaggcagcaccagcgaaggggccgtgacagccgttgccatctgctgccggagccggcacctggcgcaggcctcccaggagctccagtga

SEQ ID NO: 9483 - DNA, 1642 bp, synthetic construct
  misc_feature 1..1642: note = Synthetic polypeptide
  source 1..1642: mol_type = other DNA
cacggtctccctctcatgtggagccgaagctggactgtactgctgccatctcggctcactgcaacctccctgcctgattctcctgcctcagcctgccgagtgcctgcgattgcaggcacgcaccaccacgcctgactggttttggtggagacggggtttcgctgtgttggccgggccggtctccagcccctaaccgcgagtgatccgccagccttggcctcccgaggtgccgggattgcagacggagtctcgttcactcagtgctcaatggtgcccaggctggagtgcagtggcgtgatctcggctcactacaacctacacctcccagcaacctgccttggcctcccaaagtgccgagattgcagcctctgcccggccgccaccccgtctgggaagtgaggagtgtctccgcctggccacccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagccgccccgtctgagaagtgaggagcctctccgcccggcagccaccccatctgggaaatttctttacatattcatcaatgtctgaagaagttacttatgcagatcttcaattccagaactccagtgagatggaaaaaatcccagaaattggcaaatttggggaaaaagcacctccagctccctctcatgtatggcgtccagcagccttgtttctgactcttctgtgccttctgttgctcattggattgggagtcttggcaagcatgtttcacgtaactttgaagatagaaatgaaaaaaatgaacaaactacaaaacatcagtgaagagctccagagaaatatttctctacaactgatgagtaacatgaatatctccaacaagatcaggaacctctccaccacactgcaaacaatagccaccaaattatgtcgtgagctatatagcaaagaacaagagcacaaatgtaagccttgtccaaggagatggatttggcataaggacagctgttatttcctaagtgatgatgtccaaacatggcaggagagtaaaatggcctgtgctgctcagaatgccagcctgttgaagataaacaacaaaaatgcattggaatttataaaatcccagagtagatcatatgactattggctgggattatctcctgaagaagattccactcgtggtatgagagtggataatataatcaactcctctgcctgggttataagaaacgcacctgacttaaataacatgtattgtggatatataaatagactatatgttcaatattatcactgcacttataaaaaaagaatgatatgtgagaagatggccaatccagtgcagcttggttctacatattttagggaggcatga

SEQ ID NO: 9484 - DNA, 809 bp, synthetic construct; identical to SEQ ID NO: 8613
  misc_feature 1..809: note = Synthetic polypeptide
  source 1..809: mol_type = other DNA

SEQ ID NO: 9485 - DNA, 278 bp, synthetic construct; identical to SEQ ID NO: 8451
  misc_feature 1..278: note = Synthetic polypeptide
  source 1..278: mol_type = other DNA

SEQ ID NO: 9486 - DNA, 136 bp, synthetic construct; identical to SEQ ID NO: 8452
  misc_feature 1..136: note = Synthetic polypeptide
  source 1..136: mol_type = other DNA

SEQ ID NO: 9487 - DNA, 1327 bp, synthetic construct; identical to SEQ ID NO: 6801
  misc_feature 1..1327: note = Synthetic polypeptide
  source 1..1327: mol_type = other DNA

SEQ ID NO: 9488 - DNA, 1505 bp, synthetic construct
  misc_feature 1..1505: note = Synthetic polypeptide
  source 1..1505: mol_type = other DNA
cccctgccaggctagccgccccgtccgggagggaggtgggggggtcagccccccgcccggccagccgccccgtccgggagggaggtgggggggtcagcccccaacccggccagccgccccgtccgggaggaaacttcatggtgttatggtcaacttgccgcacaaccgtgttcaaatctgtcaccaacaggttcattaaaaacctggcctgctcggggatttgtgccagcctggtctgtgtgcccttcgacatcatcctcagcaccagtcctcactgttgctggtggatctacaccatgctcttctgcaaggtcgtcaaatttttgcacaaagtattctgctctgtgaccatcctcagcttccctgctattgctttggacaggtactactcagtcctctatccactggagaggaaaatatctgatgccaagtcccgtgaactggtgatgtacatctgggcccatgcagtggtggccagtgtccctgtgtttgcagtaaccaatgtggctgacatctatgccacgtccacctgcacggaagtctggagcaactccttgggccacctggtgtacgttctggtgtataacatcaccacggtcattgtgcctgtggtggtggtgttcctcttcttgatactgatccgacgggccctgagtgccagccagaagaagaaggtcatcatagcagcgctccggaccccacagaacaccatctctattccctatgcctcccagcgggaggccgagctgcacgccaccctgctctccatggtgatggtcttcatcttgtgtagcgtgccctatgccaccctggtcgtctaccagactgtgctcaatgtccctgacacttccgtcttcttgctgctcactgctgtttggctgcccaaagtctccctgctggcaaaccctgttctctttcttactgtgaacaaatctgtccgcaagtgcttgatagggaccctggtgcaactacaccaccggtacagtcgccgtaatgtggtcagtacagggagtggcatggctgaggccagcctggaacccagcatacgctcgggtagccagctcctggagatgttccacattgggcagcagcagatctttaagcccacagaggatgaggaagagagtgaggccaagtacattggctcagctgacttccaggccaaggagatatttagcacctgcctggagggagagcaggggccacagtttgcgccctctgccccacccctgagcacagtggactctgtatcccaggtggcaccggcagcccctgtggaacctgaaacattccctgataagtattccctgcagtttggctttgggccttttgagttgcctcctcagtggctctcagagacccgaaacagcaagaagcggctgcttccccccttgggcaacaccccagaagagctgatccagacaaaggtgcccaaggtaggcagggtggagcggaagatgagcagaaacaataaagtgagcatttttccaaaggtggattcctag

SEQ ID NO: 9489 - DNA, 1023 bp, synthetic construct; identical to SEQ ID NO: 611
  misc_feature 1..1023: note = Synthetic polypeptide
  source 1..1023: mol_type = other DNA

SEQ ID NO: 9490 - DNA, 2003 bp, synthetic construct; identical to SEQ ID NO: 8385
  misc_feature 1..2003: note = Synthetic polypeptide
  source 1..2003: mol_type = other DNA

SEQ ID NO: 9491 - DNA, 2293 bp, synthetic construct
  misc_feature 1..2293: note = Synthetic polypeptide
  source 1..2293: mol_type = other DNA
tctccctctttccacggtctccctctgaagctggactgtactgctgccatctcagctcactgcaacctccctgcctgattctcctgcctcagcctgccgagtgcctgcgattgcaggcgcgcgccgccacgcctgactggttttcctattttttgggtggagacggggtttcgctgtgttggccgggctggtctccagctcctaaccgcgagtgatccgccagcctcggcctcccgaggtgccgggattgcagacggagtctccttcactcagtgctcaatggtgcccaggctggagtgcagtggcgtgatctcggctccctacaacatccacctcccggcagcctgccttggcctcccaaagtgccgagattgcagcctctgcccagccgccaccccatctgggaaggccgccaccccgtctgggaagtgaggagcgtctctgcctggccgcccatcgtctgggatgtgaggagcccctctgcctggctgcccagtctggaaagtgaggagcatctctgcccagccgccatcccatctaggaagtgagaagcgcctcttcccggccgccatcccatctaggaagtgaggagcgtctctgcccggccacccatcgtctgagatgtggggagcgcctctgccctgtcgccccgtccgggatgtgaggagcgtctctgcctggccacctcgtctgagaagtgaggagaccctctgcctggcaaccgccctgtctgagaagtgaggagcccctccgcccagcagccgccccgtctgagaagtgaggagcccctctgcccggcagccaccccgtctgggaagtgaggagcgtctccgcccggcagccacccgtccgggagggaggtgggggtgtcagtcccccgcctggccagccgcctcgtccgggaggttccgacacaaaaaggactgtccatgaatttattaatgaccagagagacaggtttctgctcgagtatgctttgtcaaccaaaagaaacacaatcaaaaagtttgaaaaagacatagcaatgagggaacggcaactaaaaaaagcagagaaaaagctccaagatgatgcactggcctttgaagagttccttcgagaaaatgaccagagatctgtagacgctctgaaaatggcagcacaggaaacaataaacaaactccaaatgacagcagagctgaagaaagcaagcatggaggtacaagcagtgaaaagtgaaatagcaaaaacagaattcctcctcagggagtatatgaaatatggtttttttctgctgcaaatgtctccaaaacattggcaaatccagcaagcactaaaaagagcacaggcatcaaaaagtaaagcaaatatcatccttccaaaaatattagcaaaattatcattacattcaagtaacaaggaaggcatccttgaggagtccgggaggacagctgtcctttcagaagatgcttctcagggaagagacagccaaggaaagccaagcagaagcctgactcgcactccagagaaaaagaaatcaaacctggctgaaagtttcggttcagaagacagtttggaattccttttagatgatgaaatggacgttgatttggagccagcactttatttcaaggaaccagaggagttacttcaagtcctcagagagctggaagagcagaatcttactttgtttcaatattcccaagatgtagatgaaaatcttgaagaggtaaacaaaagagaaaaagttatacaggataaaacaaatagcaacatagagtttcttttggagcaagaaaaaatgcttaaagctaactgtgtgagagaagaagagaaagcagcagaattgcaattaaagtccaagctctttagctttggagaatttaattcagatgctcaggaaatactgatagactcacttagtaaaaagattactcaagtatacaaagtctgcattggagatgctgaggatgacggcctcaacccaattcaaaagctggtaaaagtagaatctcgcctggtagaactgtgtgacctcatcgaatccattcccaaagaaaatgtggaggcaattgagaggatgaaacagaaagaatggcggcaaaagtttcgtgatgagaaaatgaaagaaaaacaaagacaccaacaggaaaggctaaaagctgctctggaaaaagcagtagcacaaccaaagaaaaagttgggaagacgacttgtctttcattcaaaacctccatctggtaacaaacagcagctacctttagtcaatgaaacaaaaacaaaatcacaagaggaagaatatttttttacttga

SEQ ID NO: 9492 - DNA, 956 bp, synthetic construct; identical to SEQ ID NO: 7135
  misc_feature 1..956: note = Synthetic polypeptide
  source 1..956: mol_type = other DNA

SEQ ID NO: 9493 - DNA, 570 bp, synthetic construct
  misc_feature 1..570: note = Synthetic polypeptide
  source 1..570: mol_type = other DNA
gaagaggcaggcatggaggggcagcttggatggcaacttccagattgccttgggtccccagtgtttactcccatcaaggcagacataagcggcaacatcacgaaaatcaaagctgtgtacgacaccaacccagccaagttccggaccctgcagaacatcctggaggtggagaaagaaatgtatggagcagagtggcccaaagtaggggccacactggcgctgatgtggctgaaaagaggcctccgcttcatccaggtcttcctccagagcatctgcgacggggagcgggacgagaaccaccccaacctcatccgtgtcaacgccaccaaggcctacgagatggccctcaagaagtaccatggctggatcgtgcagaagatcttccaggcagcactgtacgcagcaccctataagtctgacttcctgaaagcgctctccaaggggcagaatgttacggaggaggagtgcctggagaagatccgcctcttcctagtcaactacacggcgaccatcgatgtcatctacgagatgtacacccagatgaacgctgagcttaactacaaggtgtag

SEQ ID NO: 9494 - DNA, 513 bp, synthetic construct
  misc_feature 1..513: note = Synthetic polypeptide
  source 1..513: mol_type = other DNA
gaagaggcaggcatggaggggcagcttggatggcaacttccagattgccttgggtccccagtgtttactcccatcaaggcagacataagcggcaacatcacgaaaatcaaagctgtgtacgacaccaacccagccaagttccggaccctgcagaacatcctggaggtggagaaagaaataggcctccgcttcatccaggtcttcctccagagcatctgcgacggggagcgggacgagaaccaccccaacctcatccgtgtcaacgccaccaaggcctacgagatggccctcaagaagtaccatggctggatcgtgcagaagatcttccaggcagcactgtacgcagcaccctataagtctgacttcctgaaagcgctctccaaggggcagaatgttacggaggaggagtgcctggagaagatccgcctcttcctagtcaactacacggcgaccatcgatgtcatctacgagatgtacacccagatgaacgctgagcttaactacaaggtgtag

SEQ ID NO: 9495 - DNA, 539 bp, synthetic construct
  misc_feature 1..539: note = Synthetic polypeptide
  source 1..539: mol_type = other DNA
gaagaggcaggcatggaggggcagcttggatggcaacttccagattgccttgggtccccagtgtttactcccatcaaggcagacataagcggcaacatcacgaaaatcaaagctgtgtacgacaccaacccagccaagttccggaccctgcagaacatcctggaggtggagaaagaaatgtatggagcagagtggcccaaagtaggggccacactggcgctgatgtggctgaaaagagcatctgcgacggggagcgggacgagaaccaccccaacctcatccgtgtcaacgccaccaaggcctacgagatggccctcaagaagtaccatggctggatcgtgcagaagatcttccaggcagcactgtacgcagcaccctataagtctgacttcctgaaagcgctctccaaggggcagaatgttacggaggaggagtgcctggagaagatccgcctcttcctagtcaactacacggcgaccatcgatgtcatctacgagatgtacacccagatgaacgctgagcttaactacaaggtgtag

SEQ ID NO: 9496 - DNA, 144 bp, synthetic construct
  misc_feature 1..144: note = Synthetic polypeptide
  source 1..144: mol_type = other DNA
gaagaggcaggcatggaggggcagcttggatggcaacttccagattgccttgggtccccagtgtttactcccatcaaggcagacataagcggcaacatcacgatgaggaagctgagactcagaggggttgaaggactcgcttaa

SEQ ID NO: 9497 - DNA, 1585 bp, synthetic construct
  misc_feature 1..1585: note = Synthetic polypeptide
  source 1..1585: mol_type = other DNA
cccccgcctggccagccgccccgtccgggaggtgaggggcgcctctgcctggccgcccctactgggaagtgaggagcccctctgccaggccagccgccccatccgggagggaggtgggggggtcagccccccgcccggccagccgccccgtccgggagggaggttggggggggtcagcccccaacccggccagccgccccgtccgggaggaaacttcatggtgttatggtcaacttgccgcacaaccgtgttcaaatctgtcaccaacaggttcattaaaaacctggcctgctcggggatttgtgccagcctggtctgtgtgcccttcgacatcatcctcagcaccagtcctcactgttgctggtggatctacaccatgctcttctgcaaggtcgtcaaatttttgcacaaagtattctgctctgtgaccatcctcagcttccctgctattgctttggacaggtactactcagtcctctatccactggagaggaaaatatctgatgccaagtcccgtgaactggtgatgtacatctgggcccatgcagtggtggccagtgtccctgtgtttgcagtaaccaatgtggctgacatctatgccacgtccacctgcacggaagtctggagcaactccttgggccacctggtgtacgttctggtgtataacatcaccacggtcattgtgcctgtggtggtggtgttcctcttcttgatactgatccgacgggccctgagtgccagccagaagaagaaggtcatcatagcagcgctccggaccccacagaacaccatctctattccctatgcctcccagcgggaggccgagctgcacgccaccctgctctccatggtgatggtcttcatcttgtgtagcgtgccctatgccaccctggtcgtctaccagactgtgctcaatgtccctgacacttccgtcttcttgctgctcactgctgtttggctgcccaaagtctccctgctggcaaaccctgttctctttcttactgtgaacaaatctgtccgcaagtgcttgatagggaccctggtgcaactacaccaccggtacagtcgccgtaatgtggtcagtacagggagtggcatggctgaggccagcctggaacccagcatacgctcgggtagccagctcctggagatgttccacattgggcagcagcagatctttaagcccacagaggatgaggaagagagtgaggccaagtacattggctcagctgacttccaggccaaggagatatttagcacctgcctggagggagagcaggggccacagtttgcgccctctgccccacccctgagcacagtggactctgtatcccaggtggcaccggcagcccctgtggaacctgaaacattccctgataagtattccctgcagtttggctttgggccttttgagttgcctcctcagtggctctcagagacccgaaacagcaagaagcggctgcttccccccttgggcaacaccccagaagagctgatccagacaaaggtgcccaaggtaggcagggtggagcggaagatgagcagaaacaataaagtgagcatttttccaaaggtggattcctag

SEQ ID NO: 9498 - DNA, 1562 bp, synthetic construct
  misc_feature 1..1562: note = Synthetic polypeptide
  source 1..1562: mol_type = other DNA
ggccgggtgtgggggctcacacctgtaatcccagcactttgggaggctgaagcaggtggatcatctaaggtcaggagttggagaccagcctgaccaacatggtgaaaccccgtctctactaaaaatacaaaaatcatccaggcatccatgcctgtaatcccagctactccagaggctgaggcaggagaatcgctagaacccgcgaggcaggtgttgagcgtgaatgcatctcagtccacgtggggcaggcaggtgtccagatgggcaatgcctgctgggagctctattgcttggaacatgggattcagcctgatgggcagatgcccagtgacaagaccattggtggaggggacgactccttcaccaccttcttctgtgaaactggtgctggaaaacacgtaccccgggcagtttttgtggatctggagcctacggtcattgatgagatccgaaatggcccataccgacagctcttccacccagagcagctcatcactgggaaagaggatgctgccaacaactatgcccgtggtcactataccattggcaaggagatcattgacccagtgctggatcggatccgcaagctgtctgaccagtgcacaggacttcagggcttcctggtgttccacagctttggtgggggcactggctctggcttcacctcactcctgatggagcggctctctgttgactatggcaagaaatccaagctggaattctccatctacccagccccccaggtgtctacagccgtggtcgagccctacaactctatcctgaccacccacaccaccctggagcactcagactgtgccttcatggtggacaacgaagcaatctatgacatctgccgccgcaacctagacatcgagcgcccaacctacaccaacctcaatcgcctcattagccaaattgtctcctccatcacagcttctctgcgctttgacggggccctcaatgtggacctgacagagttccagaccaacctggtgccctaccctcgcatccacttccccctggccacctatgcaccagtcatctctgcagaaaaggcataccacgagcagctgtcggtggcagagatcaccaatgcctgctttgagcctgccaaccagatggtaaagtgtgatccccggcacggcaagtacatggcctgctgcctgctgtaccgtggagatgtggtgcccaaggatgtcaacgctgccattgccgccatcaagaccaagcgcagcattcagtttgtggactggtgccccacaggcttcaaggttggtatcaactaccagcctcccactgtggtgcctgggggtgacctggccaaggtgcagcgtgccgtgtgcatgctgagcaacacgaccgccatcgccgaggcctgggcccgcctggaccacaagttcgacctgatgtatgccaagagggcgtttgtgcactggtatgtgggtgagggcatggaggagggtgagttctccgaggcccgtgaggatatggctgccctggagaaggattatgaggaggtgggcatcgactcctatgaggacgaggatgagggagaagaataa

SEQ ID NO: 9499 - DNA, 741 bp, synthetic construct
  misc_feature 1..741: note = Synthetic polypeptide
  source 1..741: mol_type = other DNA
ggccgggtgtgggggctcacacctgtaatcccagcactttgggaggctgaagcaggtggatcatctaaggtcaggagttggagaccagcctgaccaacatggtgaaaccccgtctctactaaaaatacaaaaatcatccaggcatccatgcctgtaatcccagctactccagaggctgaggcaggagaatcgctagaacccgcgaggcaggtgttgagcgtgaatgcatctcagtccacgtggggcaggcaggtgtccagatgggcaatgcctgctgggagctctattgcttggaacatgggattcagcctgatgggcagatgcccagtgacaagaccattggtggaggggacgactccttcaccaccttcttctgtgaaactggtgctggaaaacacgtaccccgggcagtttttgtggatctggagcctacggtcattgatgagatccgaaatggcccataccgacagctcttccacccagagcagctcatcactgggaaagaggatgctgccaacaactatgcccgtggtcactataccattggcaaggagatcattgacccagtgctggatcggatccgcaagctgtctgaccagtgcacaggacttcagggcttcctggtgttccacagctttggtgggggcactggctctggcttcacctcactcctgatggagcggctctctgttgactatggcaagaaatccaagctggaattctccatctacccagcccccc

SEQ ID NO: 9500 - DNA, 568 bp, synthetic construct
  misc_feature 1..568: note = Synthetic polypeptide
  source 1..568: mol_type = other DNA
ggccgggtgtgggggctcacacctgtaatcccagcactttgggaggctgaagcaggtggatcatctaaggtcaggagttggagaccagcctgaccaacatggtgaaaccccgtctctactaaaaatacaaaaatcatccaggcatccatgcctgtaatcccagctactccagaggctgaggcaggagaatcgctagaacccgcgaggcaggtgttgagcgtgaatgcatctcagtccacgtggggcaggcaggtgtccagatgggcaatgcctgctgggagctctattgcttggaacatgggattcagcctgatgggcagatgcccagtgacaagaccattggtggaggggacgactccttcaccaccttcttctgtgaaactggtgctggaaaacacgtaccccgggcagtttttgtggatctggagcctacggtcattgatgagatccgaaatggcccataccgacagctcttccacccagagcagctcatcactgggaaagaggatgctgccaacaactatgcccgtggtcactataccattggcaaggagatcattgacccagt

SEQ ID NO: 9501 - DNA, 973 bp, synthetic construct
  misc_feature 1..973: note = Synthetic polypeptide
  source 1..973: mol_type = other DNA
tgtgctgggttagtaaagttaagcttggaactgttttccagaatccccttccttgtatggctctgagtaagatttggccaagaggaatttgcacaagattttagaaggcaggaacaatgcaacagacgtgactcaatgaagatttcaggattaggatagtgatggacactcacaaagccgtgtggttttgccatgttctgttcaggagtatcaggttgggcagctttactctgttgcagaagctagtaagaatgagactggtggtggagaaggaattgaagtcttaaagaatgaaccttatgagaaggatggagaaaagggacagtatacgcacaaaatttatcacctaaagagcaaagtgcctgcattcgtgaggatgattgctcccgagggctccttggtgtttcatgagaaagcctggaatgcgtacccctactgtagaacaattgtaacgaatgaatatatgaaagatgatttcttcattaaaatcgaaacatggcacaaaccagacttgggaacattagaaaatgtacatggtttagatccaaacacatggaaaactgttgaaattgtccatatagatattgcagatagaagtcaagttgaaccagcagactacaaagctgatgaagacccagcattattccagtcagtcaagaccaagagaggccctttgggacccaactggaagaaggagctggcaaacagccctgactgtccccagatgtgtgcctataagctggtgaccatcaaattcaagtggtggggactgcaaagcaaagtagaaaacttcattcaaaagcaagaaaaacggatatttacaaacttccatcgccagcttttttgttggattgacaagtggatcgatctcacgatggaagacattaggagaatggaagacgagactcagaaagaactagaaacaatgcgtaagaggggttccgttcgaggcacgtcggctgctgatgtctag

SEQ ID NO: 9502 - DNA, 976 bp, synthetic construct
  misc_feature 1..976: note = Synthetic polypeptide
  source 1..976: mol_type = other DNA
tgtgctgggttagtaaagttaagcttggaactgttttccagaatccccttccttgtatggctctgagtaagatttggccaagaggaatttgcacaagattttagaaggcaggaacaatgcaacagacgtgactcaatgaagatttcaggattaggatagtgatggacactcacaaagccgtgtggttttgccatgttctgttcaggagtatcaggttgggcagctttactctgttgcagaagctagtaagaatgagactggtggtggagaaggaattgaagtcttaaagaatgaaccttatgagaaggatggagaaaagggacagtatacgcacaaaatttatcacctaaagagcaaagtgcctgcattcgtgaggatgattgctcccgagggctccttggtgtttcatgagaaagcctggaatgcgtacccctactgtagaacaattgtaacgaatgaatatatgaaagatgatttcttcattaaaatcgaaacatggcacaaaccagacttgggaacattagaaaatgtacatggtttagatccaaacacatggaaaactgttgaaattgtccatatagatattgcagatagaagtcaagttgaaccagcagactacaaagctgatgaagacccagcattattccagtcagtcaagaccaagagaggccctttgggacccaactggaagaaggagctggcaaacagccctgactgtccccagatgtgtgcctataagctggtgaccatcaaattcaagtggtggggactgcaaagcaaagtagaaaacttcattcaaaagcaagaaaaacggatatttacaaacttccatcgccagcttttttgttggattgacaagtggatcgatctcacgatggaagacattaggagaatggaagacgagactcagaaagaactagaaacattacgtaatcaaggtcaagtgaggggaacaagcgcagccagtgatgagtga

SEQ ID NO: 9503 - DNA, 654 bp, synthetic construct
  misc_feature 1..654: note = Synthetic polypeptide
  source 1..654: mol_type = other DNA
tgtgctgggttagtaaagttaagcttggaactgttttccagaatccccttccttgtatggctctgagtaagatttggccaagaggaatttgcacaagattttagaaggcaggaacaatgcaacagacgtgactcaatgaagatttcaggattaggatagtgatggacactcacaaagccgtgtggttttgccatgttctgttcaggagtatcaggttgggcagctttactctgttgcagaagctagtaagaatgagactggtggtggagaaggaattgaagtcttaaagaatgaaccttatgagaaggatggagaaaagggacagtatacgcacaaaatttatcacctaaagagcaaagtgcctgcattcgtgaggatgattgctcccgagggctccttggtgtttcatgagaaagcctggaatgcgtacccctactgtagaacaattgtaacgaatgaatatatgaaagatgatttcttcattaaaatcgaaacatggcacaaaccagacttgggaacattagaaaatgtacatggtttagatccaaacacatggaaaactgttgaaattgtccatatagatattgcagatagaagtcaagttgaaccagcagactacaaagctgatgaagacccagcattattccagtcagt

SEQ ID NO: 9504 - DNA, 902 bp, synthetic construct; identical to SEQ ID NO: 7370
  misc_feature 1..902: note = Synthetic polypeptide
  source 1..902: mol_type = other DNA

SEQ ID NO: 9505 - DNA, 455 bp, synthetic construct
  misc_feature 1..455: note = Synthetic polypeptide
  source 1..455: mol_type = other DNA
gggcgcagtggctcacgcctgtaatcccagcactttgggaggccgaggcgggcgaatcacctgagcggccaagaaggcagtgtggctggagaaggaggagaaggccaaggcgctgcgggagaagcagctccaggagcgccggcgccggctggaggagcaacgtcttaaagccgagcaacgccgtgcagccctggaggaacggcagcggcagaagctcgagaaaaacaaggagcgctatgaagcagccatccaacggtcagtgaagaagacgtgggccgaaatccggcagcagcgctggtcctgggcaggggccctgcaccacagctctccaggacataagaccagtgggagcaggtgctccgtgtcggcagttaacctgcccaaacacgtggactctataatcaacaagcggctctcaaagtcctctgccacgctctggaactcccccagtagaa

SEQ ID NO: 9506 - DNA, 2017 bp, synthetic construct
  misc_feature 1..2017: note = Synthetic polypeptide
  source 1..2017: mol_type = other DNA
gggcgcagtggctcacgcctgtaatcccagcactttgggaggccgaggcgggcgaatcacctgagcggccaagaaggcagtgtggctggagaaggaggagaaggccaaggcgctgcgggagaagcagctccaggagcgccggcgccggctggaggagcaacgtcttaaagccgagcaacgccgtgcagccctggaggaacggcagcggcagaagctcgagaaaaacaaggagcgctatgaagcagccatccaacggtcagtgaagaagacgtgggccgaaatccggcagcagcgctggtcctgggcaggggccctgcaccacagctctccaggacataagaccaatcgcagcctgcagctgagcgcatgggagagcagcatcgtggatcgtctgatgacgcccactctctccttccttgctcggagtcgcagcgcggtcacactgccccgcaacggccgggaccagggtaggggctgcgaccctgggagaggccccacgtggggccgggcaggggccagcctggcgcgcgggccgcaacccgaccgcactcatccctctgcagccgtgccggtgtgcccgcgctcggcctccgccagccccctgacgccgtgcagcgtcacccgaagcgtgcaccgctgcgcccccgccggtgagcgcggggagcgccgcaagcccaacgccgggggcagccccgctccggtgcgccgccggccggaggcctcgccggtgcagaaaaaggagaagaaggacaaggagcgggaaaacgagaaggagaagagtgccctagcccgggagcgcagcctcaagaagcgccagtcgctgcccgcctccccacgtgcccgcctctctgccagcaccgcctctgagctcagccccaaatccaaggccaggccatcctctccctccacatcctggcacaggcctgcctccccctgccccagcccagggccaggccacactctgcctccaaagccaccgtccccccgaggcaccactgcatcccccaaggggcgggttcggaggaaggaggaggcaaaggagagccccagcgccgcagggcccgaggacaagagccagagcaagcgcagggccagtaacgagaaggagtcagcagccccagcctcaccggcaccttcgccggcgccctcgcccaccccagccccgccccagaaggagcagccccccgcggagacccctacagacgctgctgtcttgacctcacccccagcccctgctcccccggtgacccctagcaaaccaatggccggcaccacagaccgagaagaagccactcggctcttggctgagaagcggcgccaggcccgggagcagcgggagcgcgaggagcaggagcggaggctgcaggcagaaagggacaagcgaatgcgagaggagcagctggcacgggaggccgaggcccgggcggagcgggaggcggaggcccggaggcgggaggagcaggaggcacgagagaaggcgcaggccgagcaggaggagcaggagcggctgcagaagcagaaagaggaggccgaagctcggtcgcgggaagaggcggagcggcagcgtctggagcgggaaaagcacttccagcagcaggagcaagagcggcaagagcgcagaaagcgtctggaggagatcatgaagaggactcggaagtcagaagtttctgaaaccaagaagcaggacagcaaggaggccaacgccaacggttccagcccagagcctgtgaaagctgtggaggctcggtccccagggctgcagaaggaggctgtgcagaaagaggagcccatcccacaggagcctcagtggagtctcccaagcaaggagttgccagcgtccctggtgaatggcctgcagcctctcccagcacaccaggagaatggcttctccaccaacggaccctctggggacaagagtctgagccgaacaccagagacactcctgccctttgcagaggcagaagccttcctcaagaaagctgtggtgcagtccccgcaggtcacagaagtcctttaa

SEQ ID NO: 9507 - DNA, 2032 bp, synthetic construct
  misc_feature 1..2032: note = Synthetic polypeptide
  source 1..2032: mol_type = other DNA
gggcgcagtggctcacgcctgtaatcccagcactttgggaggccgaggcgggcgaatcacctgagcggccaagaaggcagtgtggctggagaaggaggagaaggccaaggcgctgcgggagaagcagctccaggagcgccggcgccggctggaggagcaacgtcttaaagccgagcaacgccgtgcagccctggaggaacggcagcggcagaagctcgagaaaaacaaggagcgctatgaagcagccatccaacggtcagtgaagaagacgtgggccgaaatccggcagcagcgctggtcctgggcaggggccctgcaccacagctctccaggacataagaccagtgggagcaggtgctccgtgtcggcagttaacctgcccaaacacgtggactctataatcaacaagcggctctcaaagtcctctgccacgctctggaactcccccagtagaaatcgcagcctgcagctgagcgcatgggagagcagcatcgtggatcgtctgatgacgcccactctctccttccttgctcggagtcgcagcgcggtcacactgccccgcaacggccgggaccaggccgtgccggtgtgcccgcgctcggcctccgccagccccctgacgccgtgcagcgtcacccgaagcgtgcaccgctgcgcccccgccggtgagcgcggggagcgccgcaagcccaacgccgggggcagccccgctccggtgcgccgccggccggaggcctcgccggtgcagaaaaaggagaagaaggacaaggagcgggaaaacgagaaggagaagagtgccctagcccgggagcgcagcctcaagaagcgccagtcgctgcccgcctccccacgtgcccgcctctctgccagcaccgcctctgagctcagccccaaatccaaggccaggccatcctctccctccacatcctggcacaggcctgcctccccctgccccagcccagggccaggccacactctgcctccaaagccaccgtccccccgaggcaccactgcatcccccaaggggcgggttcggaggaaggaggaggcaaaggagagccccagcgccgcagggcccgaggacaagagccagagcaagcgcagggccagtaacgagaaggagtcagcagccccagcctcaccggcaccttcgccggcgccctcgcccaccccagccccgccccagaaggagcagccccccgcggagacccctacagacgctgctgtcttgacctcacccccagcccctgctcccccggtgacccctagcaaaccaatggccggcaccacagaccgagaagaagccactcggctcttggctgagaagcggcgccaggcccgggagcagcgggagcgcgaggagcaggagcggaggctgcaggcagaaagggacaagcgaatgcgagaggagcagctggcacgggaggccgaggcccgggcggagcgggaggcggaggcccggaggcgggaggagcaggaggcacgagagaaggcgcaggccgagcaggaggagcaggagcggctgcagaagcagaaagaggaggccgaagctcggtcgcgggaagaggcggagcggcagcgtctggagcgggaaaagcacttccagcagcaggagcaagagcggcaagagcgcagaaagcgtctggaggagatcatgaagaggactcggaagtcagaagtttctgaaaccaagaagcaggacagcaaggaggccaacgccaacggttccagcccagagcctgtgaaagctgtggaggctcggtccccagggctgcagaaggaggctgtgcagaaagaggagcccatcccacaggagcctcagtggagtctcccaagcaaggagttgccagcgtccctggtgaatggcctgcagcctctcccagcacaccaggagaatggcttctccaccaacggaccctctggggacaagagtctgagccgaacaccagagacactcctgccctttgcagaggcagaagccttcctcaagaaagctgtggtgcagtccccgcaggtcacagaagtcctttaa

SEQ ID NO: 9508 - DNA, 2131 bp, synthetic construct
  misc_feature 1..2131: note = Synthetic polypeptide
  source 1..2131: mol_type = other DNA
gggcgcagtggctcacgcctgtaatcccagcactttgggaggccgaggcgggcgaatcacctgagcggccaagaaggcagtgtggctggagaaggaggagaaggccaaggcgctgcgggagaagcagctccaggagcgccggcgccggctggaggagcaacgtcttaaagccgagcaacgccgtgcagccctggaggaacggcagcggcagaagctcgagaaaaacaaggagcgctatgaagcagccatccaacggtcagtgaagaagacgtgggccgaaatccggcagcagcgctggtcctgggcaggggccctgcaccacagctctccaggacataagaccagtgggagcaggtgctccgtgtcggcagttaacctgcccaaacacgtggactctataatcaacaagcggctctcaaagtcctctgccacgctctggaactcccccagtagaaatcgcagcctgcagctgagcgcatgggagagcagcatcgtggatcgtctgatgacgcccactctctccttccttgctcggagtcgcagcgcggtcacactgccccgcaacggccgggaccagggtaggggctgcgaccctgggagaggccccacgtggggccgggcaggggccagcctggcgcgcgggccgcaacccgaccgcactcatccctctgcagccgtgccggtgtgcccgcgctcggcctccgccagccccctgacgccgtgcagcgtcacccgaagcgtgcaccgctgcgcccccgccggtgagcgcggggagcgccgcaagcccaacgccgggggcagccccgctccggtgcgccgccggccggaggcctcgccggtgcagaaaaaggagaagaaggacaaggagcgggaaaacgagaaggagaagagtgccctagcccgggagcgcagcctcaagaagcgccagtcgctgcccgcctccccacgtgcccgcctctctgccagcaccgcctctgagctcagccccaaatccaaggccaggccatcctctccctccacatcctggcacaggcctgcctccccctgccccagcccagggccaggccacactctgcctccaaagccaccgtccccccgaggcaccactgcatcccccaaggggcgggttcggaggaaggaggaggcaaaggagagccccagcgccgcagggcccgaggacaagagccagagcaagcgcagggccagtaacgagaaggagtcagcagccccagcctcaccggcaccttcgccggcgccctcgcccaccccagccccgccccagaaggagcagccccccgcggagacccctacagacgctgctgtcttgacctcacccccagcccctgctcccccggtgacccctagcaaaccaatggccggcaccacagaccgagaagaagccactcggctcttggctgagaagcggcgccaggcccgggagcagcgggagcgcgaggagcaggagcggaggctgcaggcagaaagggacaagcgaatgcgagaggagcagctggcacgggaggccgaggcccgggcggagcgggaggcggaggcccggaggcgggaggagcaggaggcacgagagaaggcgcaggccgagcaggaggagcaggagcggctgcagaagcagaaagaggaggccgaagctcggtcgcgggaagaggcggagcggcagcgtctggagcgggaaaagcacttccagcagcaggagcaagagcggcaagagcgcagaaagcgtctggaggagatcatgaagaggactcggaagtcagaagtttctgaaaccaagcagaagcaggacagcaaggaggccaacgccaacggttccagcccagagcctgtgaaagctgtggaggctcggtccccagggctgcagaaggaggctgtgcagaaagaggagcccatcccacaggagcctcagtggagtctcccaagcaaggagttgccagcgtccctggtgaatggcctgcagcctctcccagcacaccaggagaatggcttctccaccaacggaccctctggggacaagagtctgagccgaacaccagagacactcctgccctttgcagaggcagaagccttcctcaagaaagctgtggtgcagtccccgcaggtcacagaagtcctttaa

SEQ ID NO: 9509 - DNA, 142 bp, synthetic construct
  misc_feature 1..142: note = Synthetic polypeptide
  source 1..142: mol_type = other DNA
gggcgcagtggctcacgcctgtaatcccagcactttgggaggccgaggcgggcgaatcacctgagcggccaagaaggcagtgtggctggagaaggaggagaaggccaaggcgctgcgggagaagcagctccaggagcgccgg

SEQ ID NO: 9510 - DNA, 2053 bp, synthetic construct; identical to SEQ ID NO: 7369
  misc_feature 1..2053: note = Synthetic polypeptide
  source 1..2053: mol_type = other DNA

SEQ ID NO: 9511 - DNA, 167 bp, synthetic construct
  misc_feature 1..167: note = Synthetic polypeptide
  source 1..167: mol_type = other DNA
cgacaccagcacatagtaggttcgctaagctcttgctccgcctgccggctctgcgctccatcgggctcaaatgcctggaacatctcttcttcttcaagctcatcggggacacacccattgacaccttccttatggagatgctggaggcgccgcaccaaatgacttag

SEQ ID NO: 9512 - DNA, 780 bp, synthetic construct
  misc_feature 1..780: note = Synthetic polypeptide
  source 1..780: mol_type = other DNA
tccatctctttattcttgagacctggctgtcccctaagcactgcctgctcctgcagcccccagacgggggctccttcctttctccctgcccttgtgcagtagggtgtggaatgggttaagagtcctctttgtgtagttgttgatgcttctagactcctcttcttccttcctccctgaaacgccagctttgaagcccacaccatagactgtgcctgacaagcccttcactctgctatggtgccatcaccacatccagtgtctgctgagaaatcttcctctccgtcaacctgtgggcagtatttggcacctttgaagctgaccatgccactgcctcggtacggctccgggcagcagccactgatcctgccccagtctattcagctgccacctgggcagagcctctccgttggggccccccgaaggattcctccgcccgggtcccagccgccagtcctgaacaccagcagagagccctctcagatggagatgaaaggcttccactttgccgacagtaaacagaatgtcccttcaggaggccccgtgccatcgccacagacctacaggcctagctctgctagccccagtgggaagccctctggatcagcagttaacatgggctctgtgcagggacactacgtgcaacaggcaaaacaacgagtggatgagaaacccagcctgggagccgtgaagctgcaggaggccccctcggctgcctcccagatgaagcgaaccggagcgatcaagcctcgggctgtcaaagtggaggagagtaaggcctga

SEQ ID NO: 9513 - DNA, 606 bp, synthetic construct
  misc_feature 1..606: note = Synthetic polypeptide
  source 1..606: mol_type = other DNA
tccatctctttattcttgagacctggctgtcccctaagcactgcctgctcctgcagcccccagacgggggctccttcctttctccctgcccttgtgcagtagggtgtggaatgggttaagagtcctctttgtgtagttgttgatgcttctagactcctcttcttccttcctccctgaaacgccagctttgaagcccacaccatagactgtgcctgacaagcccttcactctgctatggtgccatcaccacatccagtgtctgctgagaaatcttcctctccgtcaacctgtgggcagtatttggcacctttgaagctgaccatgccactgcctcggtacggctccgggcagcagccactgatcctgccccagtctattcagctgccacctgggcagagcctctccgttggggccccccgaaggattcctccgcccgggtcccagccgccagtcctgaacaccagcagagagccctctcagatggagatgaaaggcttccactttgccgacagtaaacagaatgtcccttcaggaggccccgtgccatcgccacagacctacaggcaaaacaacgagtggatgagaaacccagcctgggagccgtga

SEQ ID NO: 9514 - DNA, 665 bp, synthetic construct; identical to SEQ ID NO: 6745
  misc_feature 1..665: note = Synthetic polypeptide
  source 1..665: mol_type = other DNA

SEQ ID NO: 9515 - DNA, 1446 bp, synthetic construct; identical to SEQ ID NO: 8572
  misc_feature 1..1446: note = Synthetic polypeptide
  source 1..1446: mol_type = other DNA

SEQ ID NO: 9516 - DNA, 104 bp, synthetic construct; identical to SEQ ID NO: 8573
  misc_feature 1..104: note = Synthetic polypeptide
  source 1..104: mol_type = other DNA

SEQ ID NO: 9517 - DNA, 489 bp, synthetic construct; identical to SEQ ID NO: 8574
  misc_feature 1..489: note = Synthetic polypeptide
  source 1..489: mol_type = other DNA

SEQ ID NO: 9518 - DNA, 1087 bp, synthetic construct
  misc_feature 1..1087: note = Synthetic polypeptide
  source 1..1087: mol_type = other DNA
caagaactcaggaaacattttatgagttccagtcctggctctccctcttgatagctgcatgacaaagatgtccttgggtttcagtttcctcatctgtgaaatgaaaacatagtaggcctccctggatggagtttgtctgaggatttgaagatccagtgcagatgtggtgctggaaaaagccatgcacaagtgcatcttgaagcccctcaaggggcacgtggaggccatgctgaaggactttcacatggccgatggctcatggaagcaactcaaggagaacctgcagcttgtgcggcagaggaatccgcaggagctgggggtcttcgccccgacccctgattttgtggatgtggagaaaatcaaagtcaagttcatgaccatgcagaagatgtattcgccggaaaagaaggtcatgctgctgctgcgggtctgcaagctcatttacacggtcatggagaacaactcagggaggatgtatggcgctgatgacttcttgccagtcctgacctatgtcatagcccagtgtgacatgcttgaattggacactgaaatcgagtacatgatggagctcctagacccatcgctgttacatggagaaggaggctattacttgacaagcgcatatggagcactttctctgataaagaatttccaagaagaacaagcagcgcgactgctcagctcagaaaccagagacaccctgaggcagtggcacaaacggagaaccaccaaccggaccatcccctctgtggacgacttccagaattacctccgagttgcatttcaggaggtcaacagtggttgcacaggaaagaccctccttgtgagaccttacatcaccactgaggatgtgtgtcagatctgcgctgagaagttcaaggtgggggaccctgaggagtacagcctctttctcttcgttgacgagacatggcagcagctggcagaggacacttaccctcaaaaaatcaaggcggagctgcacagccgaccacagccccacatcttccactttgtctacaaacgcatcaagaacgatccttatggcatcattttccagaacggggaagaagacctcaccacctcctag

SEQ ID NO: 9519 - DNA, 784 bp, synthetic construct; identical to SEQ ID NO: 6798
  misc_feature 1..784: note = Synthetic polypeptide
  source 1..784: mol_type = other DNA

SEQ ID NO: 9520 - DNA, 1072 bp, synthetic construct
  misc_feature 1..1072: note = Synthetic polypeptide
  source 1..1072: mol_type = other DNA
tgtcaggcctctgagcccaagccaagccatcacatcccctgtgacttgcacgtatacacccagatggcctgaagtaactggagaatcacaaaagaagtgaaaaggccctgccccgccttaactgatgacattccaccattgtgatttgttcctgccccaccttaactgagtgattaaccctgtgaatttccttgtcctggctcagagtctcccccactgagcaccttgtgacccccgcccctgcccaccagagaacaaccccctttgactgtaattttccatttcctttccaaatcctataaaacggccccacccctatctcccttcgctgactctctttttggactcagcccacctgcacccaggaagtggttacctggaaggaaaggagctgcagaacttgatccaggagctccagcaggcgcgaaagaaggctggattggagttatcacctgaaatgaaaacttttgtggatcagtatgggcaaagagatgatggaaaaataggaattgtagagttggctcacgtattacccacagaagagaatttcctgctgctcttccgatgccagcagctgaagtcctgtgaggaattcatgaagacatggagaaaatatgatactgaccacagtggcttcatagaaactgaggagcttaagaactttctaaaggacctgctagaaaaagcaaacaagactgttgatgacacaaaattagccgagtatacagacctaatgctgaaactatttgattcaaataatgatgggaagctggaattaactgagatggccaggttactaccagtgcaggagaattttcttcttaaattccagggaatcaaaatgtgtgggaaagagttcaataaggcttttgagctgtatgatcaggacggcaatggatacatagatgaaaatgaactggatgctttactgaaggatctgtgcgagaagaataaacaggatctggatattaataatattacaacatacaagaagaacataatggctttgtcggatggagggaagctgtaccgaacggatcttgctcttattctctgtgctggggataactag

SEQ ID NO: 9521 - DNA, 586 bp, synthetic construct; identical to SEQ ID NO: 6809
  misc_feature 1..586: note = Synthetic polypeptide
  source 1..586: mol_type = other DNA

SEQ ID NO: 9522 - DNA, 895 bp, synthetic construct; identical to SEQ ID NO: 613
  misc_feature 1..895: note = Synthetic polypeptide
  source 1..895: mol_type = other DNA

SEQ ID NO: 9523 - DNA, 247 bp, synthetic construct; identical to SEQ ID NO: 614
  misc_feature 1..247: note = Synthetic polypeptide
  source 1..247: mol_type = other DNA

SEQ ID NO: 9524 - DNA, 551 bp, synthetic construct; identical to SEQ ID NO: 615
  misc_feature 1..551: note = Synthetic polypeptide
  source 1..551: mol_type = other DNA

SEQ ID NO: 9525 - DNA, 1257 bp, synthetic construct; identical to SEQ ID NO: 8602
  misc_feature 1..1257: note = Synthetic polypeptide
  source 1..1257: mol_type = other DNA

SEQ ID NO: 9526 - DNA, 1072 bp, synthetic construct
  misc_feature 1..1072: note = Synthetic polypeptide
  source 1..1072: mol_type = other DNA
tgtcaggcctctgagcccaagccaagccatcacatcccctgtgacttgcacgtatacacccagatggcctgaagtaactggagaatcacaaaagaagtgaaaaggccctgccccgccttaactgatgacattccaccattgtgatttgttcctgccccaccttaactgagtgattaaccctgtgaatttccttgtcctggctcagaggctcccccactgagcaccttgtgaccactgcccctgcccaccagagaacaaccccctttggctgtaattttccattacctttccaaatcctataaaacggccccacccctatctcccttcgctgactctctttttggactcagcccacctgcacccaggaagtggttacctggaaggaaaggagctgcagaacttgatccaggagctccagcaggcgcgaaagaaggctggattggagttatcacctgaaatgaaaacttttgtggatcagtatgggcaaagagatgatggaaaaataggaattgtagagttggctcacgtattacccacagaagagaatttcctgctgctcttccgatgccagcagctgaagtcctgtgaggaattcatgaagacatggagaaaatatgatactgaccacagtggcttcatagaaactgaggagcttaagaactttctaaaggacctgctagaaaaagcaaacaagactgttgatgacacaaaattagccgagtatacagacctaatgctgaaactatttgattcaaataatgatgggaagctggaattaactgagatggccaggttactaccagtgcaggagaattttcttcttaaattccagggaatcaaaatgtgtgggaaagagttcaataaggcttttgagctgtatgatcaggacggcaatggatacatagatgaaaatgaactggatgctttactgaaggatctgtgcgagaagaataaacaggatctggatattaataatattacaacatacaagaagaacataatggctttgtcggatggagggaagctgtaccgaacggatcttgctcttattctctgtgctggggataactag

SEQ ID NO: 9527 - DNA, 2165 bp, synthetic construct
  misc_feature 1..2165: note = Synthetic polypeptide
  source 1..2165: mol_type = other DNA
tctccctctttccacggtctccctctgaagctggactgtactgctgccatctcagctcactgcaacctccctgcctgattctcctgcctcagcctgccgagtgcctgcgattgcaggcgcgcgccgccacgcctgactggttttcctattttttgggtggagacggggtttcgctgtgttggccgggctggtctccagctcctaaccgcgagtgatccgccagcctcggcctcccgaggtgccgggattgcagacggagtctccttcactcagtgctcaatggtgcccaggctggagtgcagtggcgtgatctcggctccctacaacatccacctcccggcagcctgccttggcctcccaaagtgccgagattgcagcctctgcccagccgccaccccatctgggaaggccgccaccccgtctgggaagtgaggagcgtctctgcctggccgcccatcgtctgggatgtgaggagcccctctgcctggctgcccagtctggaaagtgaggagcatctctgcccagccgccatcccatctaggaagtgagaagcgcctcttcccggccgccatcccatctaggaagtgaggagcgtctctgcccggccacccatcgtctgagatgtggggagcgcctctgccctgtcgccccgtccgggatgtgaggagcgtctctgcctggccacctcgtctgagaagtgaggagaccctctgcctggcaaccgccctgtctgagaagtgaggagcccctccgcccagcagccgccccgtctgagaagttccgacacaaaaaggactgtccatgaatttattaatgaccagagagacaggtttctgctcgagtatgctttgtcaaccaaaagaaacacaatcaaaaagtttgaaaaagacatagcaatgagggaacggcaactaaaaaaagcagagaaaaagctccaagatgatgcactggcctttgaagagttccttcgagaaaatgaccagagatctgtagacgctctgaaaatggcagcacaggaaacaataaacaaactccaaatgacagcagagctgaagaaagcaagcatggaggtacaagcagtgaaaagtgaaatagcaaaaacagaattcctcctcagggagtatatgaaatatggtttttttctgctgcaaatgtctccaaaacattggcaaatccagcaagcactaaaaagagcacaggcatcaaaaagtaaagcaaatatcatccttccaaaaatattagcaaaattatcattacattcaagtaacaaggaaggcatccttgaggagtccgggaggacagctgtcctttcagaagatgcttctcagggaagagacagccaaggaaagccaagcagaagcctgactcgcactccagagaaaaagaaatcaaacctggctgaaagtttcggttcagaagacagtttggaattccttttagatgatgaaatggacgttgatttggagccagcactttatttcaaggaaccagaggagttacttcaagtcctcagagagctggaagagcagaatcttactttgtttcaatattcccaagatgtagatgaaaatcttgaagaggtaaacaaaagagaaaaagttatacaggataaaacaaatagcaacatagagtttcttttggagcaagaaaaaatgcttaaagctaactgtgtgagagaagaagagaaagcagcagaattgcaattaaagtccaagctctttagctttggagaatttaattcagatgctcaggaaatactgatagactcacttagtaaaaagattactcaagtatacaaagtctgcattggagatgctgaggatgacggcctcaacccaattcaaaagctggtaaaagtagaatctcgcctggtagaactgtgtgacctcatcgaatccattcccaaagaaaatgtggaggcaattgagaggatgaaacagaaagaatggcggcaaaagtttcgtgatgagaaaatgaaagaaaaacaaagacaccaacaggaaaggctaaaagctgctctggaaaaagcagtagcacaaccaaagaaaaagttgggaagacgacttgtctttcattcaaaacctccatctggtaacaaacagcagctacctttagtcaatgaaacaaaaacaaaatcacaagaggaagaatatttttttacttga

SEQ ID NO: 9528 - DNA, 611 bp, synthetic construct
  misc_feature 1..611: note = Synthetic polypeptide
  source 1..611: mol_type = other DNA
ggctagttgcaaccgaatcacccaggaacttcttaaaaatcagattcccaggcccacccccaagagattctaattcactatgcaaaagagacttcatcccagaaatctgtatcttcagttctccagactcctgtttcctcaaggccaatgatttgactcacagtctttcctcatacctaaaagaaatttgtcctaagtgggtaaaacttaggaagaaccacagtgagaagaaatcggtcctgatgctgatcatctgcagctcggccgtccgagccctggagctcattaggtcgatgacagcattcagaggagacggcaaagttataaaattatttgcaaagcacataaaggtccaggcgcaggtaaagttgctggagaagcgtgtggtgcacctgggtgtaggaactccggggagaattaaagaacttgttaaacaaggtggccttaatttgagccccttaaaatttctggtttttgactggaactggagagatcagaagttgaggagaatgatggacattcccgagataagaaaggaggtattcgaacttctggaaatgggagtgctcagtctgtgcaagtcagaatccttgaaactgggccttttctaa

SEQ ID NO: 9529 - DNA, 578 bp, synthetic construct
  misc_feature 1..578: note = Synthetic polypeptide
  source 1..578: mol_type = other DNA
ggctagttgcaaccgaatcacccaggaacttcttaaaaatcagattcccaggcccacccccaagagattctaattcactatgcaaaagagacttcatcccagaaatctgtatcttcagttctccagactcctgtttcctcaaggccaatgatttgactcacagtctttcctcatacctaaaagaaatttgtcctaagtgggtaaaacttaggaagaaccacagtgagaagaaatcggtcctgatgctgatcatctgcagctcggccgtccgagccctggagctcattaggtcgatgacagcattcagaggagacggcaaagttataaaattatttgcaaagcacataaaggtccaggcgcaggtaaagttgctggagaagcgtgtggtgcacctgggtgtaggaactccggggagaattaaagaacttgttaaacaaggtggccttaatttgagccccttaaaatttctggtttttgactggaactggagagatcagaagttgaggagaatgatggacattcccgagataagaaaggaggtattcgaacttctggaaatgggagtgctcagtctgtgc

SEQ ID NO: 9530 - DNA, 293 bp, synthetic construct
  misc_feature 1..293: note = Synthetic polypeptide
  source 1..293: mol_type = other DNA
ggctagttgcaaccgaatcacccaggaacttcttaaaaatcagattcccaggcccacccccaagagattctaattcactatgcaaaagagacttcatcccagaaatctgtatcttcagttctccagactcctgtttcctcaaggccaatgatttgactcacagtctttcctcatacctaaaagaaatttgtcctaagtgggtaaaacttaggaagaaccacagtgagaagaaatcggtcctgatgctgatcatctgcagctcggccgtccgagccctggagctcattagataa

SEQ ID NO: 9531 - DNA, 1279 bp, synthetic construct; identical to SEQ ID NO: 795
  misc_feature 1..1279: note = Synthetic polypeptide
  source 1..1279: mol_type = other DNA

SEQ ID NO: 9532 - DNA, 920 bp, synthetic construct
  misc_feature 1..920: note = Synthetic polypeptide
  source 1..920: mol_type = other DNA
gggctccttagagaagtgattgattccagggctgggcagggaaaaaacaagatgagacaagagcattttgtgatgaagtggccattctgcctgcccctcagaacctctctgtactctcaaccaacatgaagcatctcttgatgtggagcccagtgatcgcgcctggagaaacagtgtactattctgtcgaataccagggggagtacgagagcctgtacacgagccacatctggatccccagcagctggtgctcactcactgaaggtcctgagtgtgatgtcactgatgacatcacggccactgtgccatacaaccttcgtgtcagggccacattgggctcacagacctcagcctggagcatcctgaagcatccctttaatagaaactcaaccatccttacccgacctgggatggagatcaccaaagatggcttccacctggttattgagctggaggacctggggccccagtttgagttccttgtggcctactggaggagggagcctggtgccgaggaacatgtcaaaatggtgaggagtgggggtattccagtgcacctagaaaccatggagccaggggctgcatactgtgtgaaggcccagacattcgtgaaggccattgggaggtacagcgccttcagccagacagaatgtgtggaggtgcaaggagaggccattcccctggtactggccctgtttgcctttgttggcttcatgctgatccttgtggtcgtgccactgttcgtctggaaaatgggccggctgctccagtactcctgttgccccgtggtggtcctcccagacaccttgaaaataaccaattcaccccagaagttaatcagctgcagaagggaggaggtggatgcctgtgccacggctgtgatgtctcctgaggaactcctcagggcctggatctcatag

SEQ ID NO: 9533 - DNA, 493 bp, synthetic construct
  misc_feature 1..493: note = Synthetic polypeptide
  source 1..493: mol_type = other DNA
ggcagcctggggtgggagtgtgagcacgggactcagaactggcttcagaccctgctctcttgctgtggccttgggaaagccaccatgcctctgtgacttttattcgttccatacaacgggggacctggatggtggtctctaaggccctgtcagtgggaacactgggtacggctcctacctggtctggaaagagctgggaggcttcacagagaaggctgtggttcccctgggcctctacactgggcagctggccctgaactgggcatggccccccatcttctttggtgcccgacaaatgggctgggccttggtggatctcctgctggtcagtggggcggcggcagccactaccgtggcctggtaccaggtgagcccgctggccgcccgcctgctctacccctacctggcctggctggccttcacgaccacactcaactactgcgtatggcgggacaaccatggctggcgtgggggacggcggctgccagagtga

SEQ ID NO: 9534 - DNA, 304 bp, synthetic construct
  misc_feature 1..304: note = Synthetic polypeptide
  source 1..304: mol_type = other DNA
ggcagcctggggtgggagtgtgagcacgggactcagaactggcttcagaccctgctctcttgctgtggccttgggaaagccaccatgcctctgtgacttttattcgttccatacaacgggggacctggatggtggtctctaaggccctgtcagtgggaacactgggtacggctcctacctggtctggaaagagctgggaggcttcacagagaaggctgtggttcccctgggcctctacactgggcagctggccctgaactgggcatggccccccatcttctttggtgcccgacaaatgggctgg

SEQ ID NO: 9535 - DNA, 3238 bp, synthetic construct
  misc_feature 1..3238: note = Synthetic polypeptide
  source 1..3238: mol_type = other DNA
taattaagatataatgtcggtgggctagcccgttgtcagaggataaaagtgtcctctcagtagataaatggtgacatttctggactattatcccacagcggagcctgtttcaatgactctatttctgctctgccaaatgattaatgatgtagattctgtccttctgcgtgtgacggctggagtcacaggagcgacagatcaagttcggaacagctaccagctctgtaataatggtaccctgagggtgatgtatgctaatgggatgggtatcagcttccacagcgagccccatgtcctagcgggcaccatcacccccaccattggacgctgcaacatctccctgcctatggagaatggcttaaactccattgagtggcgcctaagaaaggaacagattaaaggcaaagtcaccatctttggcaggaagctccgggtccatggaagaaatctcttgtccattgactatgatcgaaatattcggactgaaaagatctatgatgaccaccggaagttcaccctgaggatcatttatgaccaggtgggccgccccttcctctggctgcccagcagcgggctggcagctgtcaacgtgtcatacttcttcaatgggcgcctggctgggcttcagcgtggggccatgagcgagaggacagacatcgacaagcaaggccgcatcgtgtcccgcatgttcgctgacgggaaagtgtggagctactcctaccttgacaagtccatggtcctcctgcttcagagccaacgtcagtatatatttgagtatgactcctctgaccgcctccttgccgtcaccatgcccagcgtggcccggcacagcatgtccacacacacctccatcggctacatccgtaatatttacaacccgcctgaaagcaatgcttcggtcatctttgactacagtgatgacggccgcatcctgaagacctcctttttgggcaccggacgccaggtgttctacaagtatgggaaactctccaagttatcagagattgtctacgacagtaccgccgtcaccttcgggtatgacgagaccactggtgtcttgaagatggtcaacctccaaagtgggggcttctcctgcaccatcaggtaccggaagattggccccctggtggacaagcagatctacaggttctccgaggaaggcatggtcaatgccaggtttgactacacctatcatgacaacagcttccgcatcgcaagcatcaagcccgtcataagtgagactcccctccccgttgacctctaccgctatgatgagatttctggcaaggtggaacactttggtaagtttggagtcatctattatgacatcaaccagatcatcaccactgccgtgatgaccctcagcaaacacttcgacacccatgggcggatcaaggaggtccagtatgagatgttccggtccctcatgtactggatgacggtgcaatatgacagcatgggcagggtgatcaagagggagctaaaactggggccctatgccaataccacgaagtacacctatgactacgatggggacgggcagctccagagcgtggccgtcaatgaccgcccgacctggcgctacagctatgaccttaatgggaatctccacttactgaacccaggcaacagtgtgcgcctcatgcccttgcgctatgacctccgggatcggataaccagactcggggatgtgcagtacaaaattgacgacgatggctatctgtgccagagagggtctgacatcttcgaatacaattccaagggcctcctaacaagagcctacaacaaggccagcgggtggagtgtccagtaccgctatgatggcgtaggacggcgggcttcctacaagaccaacctgggccaccacctgcagtacttctactctgacctccacaacccgacgcgcatcacccatgtctacaatcactccaactcggagattacctcactgtactacgacctccagggccacctctttgccatggagagcagcagtggggaggagtactatgttgcctctgataacacagggactcctctggctgtgttcagcatcaacggcctcatgatcaaacagctgcagtacacggcctatggggagatttattatgactccaaccccgacttccagatggtcattggcttccatgggggactctatgaccccctgaccaagctggtccacttcactcagcgtgattatgatgtgctggcaggacgatggacctccccagactataccatgtggaaaaacgtgggcaaggagccggccccctttaacctgtatatgttcaagagcaacaatcctctcagcagtgagctagatttgaagaactacgtgacagatgtgaaaagctggcttgtgatgtttggatttcagcttagcaacatcattcctggcttcccgagagccaaaatgtatttcgtgcctcctccctatgaattgtcagagagtcaagcaagtgagaatggacagctcattacaggtgtccaacagacaacagagagacataaccaggccttcatggctctggaaggacaggtcattactaaaaagctccacgccagcatccgagagaaagcaggtcactggtttgccaccaccacgcccatcattggcaaaggcatcatgtttgccatcaaagaagggcgggtgaccacgggcgtgtccagcatcgccagcgaagatagccgcaaggtggcatctgtgctgaacaacgcctactacctggacaagatgcactacagcatcgagggcaaggacacccactactttgtgaagattggctcagccgatggcgacctggtcacactaggcaccaccatcggccgcaaggtgctagagagcggggtgaacgtgaccgtgtcccagcccacgctgctggtcaacggcaggactcgaaggttcacgaacattgagttccagtactccacgctgctgctcagcatccgctatggcctcacccccgacaccctggacgaagagaaggcccgcgtcctggaccaggcgagacagagggccctgggcacggcctgggccaaggagcagcagaaagccagggacgggagagaggggagccgcctgtggactgagggcgagaagcagcagcttctgagcaccgggcgcgtgcaagggtacgagggatattacgtgcttcccgtggagcaatacccagagcttgcagacagtagcagcaacatccagtttttaagacagaatgagatgggaaagaggtaa

SEQ ID NO: 9536 - DNA, 3052 bp, synthetic construct; identical to SEQ ID NO: 7029
  misc_feature 1..3052: note = Synthetic polypeptide
  source 1..3052: mol_type = other DNA

SEQ ID NO: 9537 - DNA, 3055 bp, synthetic construct; identical to SEQ ID NO: 7030
  misc_feature 1..3055: note = Synthetic polypeptide
  source 1..3055: mol_type = other DNA

SEQ ID NO: 9538 - DNA, 575 bp, synthetic construct; identical to SEQ ID NO: 6581
  misc_feature 1..575: note = Synthetic polypeptide
  source 1..575: mol_type = other DNA

SEQ ID NO: 9539 - DNA, 77 bp, synthetic construct
  misc_feature 1..77: note = Synthetic polypeptide
  source 1..77: mol_type = other DNA
gccgacacccccactgctgctggagtagtagcttccactgctacacctcctcctcccggaagagcttcaagagctaa

SEQ ID NO: 9540 - DNA, 1211 bp, synthetic construct; identical to SEQ ID NO: 526
  misc_feature 1..1211: note = Synthetic polypeptide
  source 1..1211: mol_type = other DNA

SEQ ID NO: 9541 - DNA, 1133 bp, synthetic construct; identical to SEQ ID NO: 527
  misc_feature 1..1133: note = Synthetic polypeptide
  source 1..1133: mol_type = other DNA

SEQ ID NO: 9542 - DNA, 841 bp, synthetic construct; identical to SEQ ID NO: 529
  misc_feature 1..841: note = Synthetic polypeptide
  source 1..841: mol_type = other DNA

SEQ ID NO: 9543 - DNA, 659 bp, synthetic construct; identical to SEQ ID NO: 530
  misc_feature 1..659: note = Synthetic polypeptide
  source 1..659: mol_type = other DNA

SEQ ID NO: 9544 - DNA, 961 bp, synthetic construct; identical to SEQ ID NO: 6722
  misc_feature 1..961: note = Synthetic polypeptide
  source 1..961: mol_type = other DNA

SEQ ID NO: 9545 - DNA, 265 bp, synthetic construct; identical to SEQ ID NO: 8378
  misc_feature 1..265: note = Synthetic polypeptide
  source 1..265: mol_type = other DNA

SEQ ID NO: 9546 - DNA, 87 bp, synthetic construct
  misc_feature 1..87: note = Synthetic polypeptide
  source 1..87: mol_type = other DNA
aagactgttttcatctaataacaccaagggcccactgatgatggtgaagaagagatggaagaagacacagtcacaaacgggtcctga

SEQ ID NO: 9547 - DNA, 66 bp, synthetic construct
  misc_feature 1..66: note = Synthetic polypeptide
  source 1..66: mol_type = other DNA
aagactgttttcatctaataacaccaagggcccactgatgatggtgaagaagagatggaagaagac

SEQ ID NO: 9548 - DNA, 1407 bp, synthetic construct
  misc_feature 1..1407: note = Synthetic polypeptide
  source 1..1407: mol_type = other DNA
cccccgcctggccagccgccccgtccgggaggaaacttcatggtgttatggtcaacttgccgcacaaccgtgttcaaatctgtcaccaacaggttcattaaaaacctggcctgctcggggatttgtgccagcctggtctgtgtgcccttcgacatcatcctcagcaccagtcctcactgttgctggtggatctacaccatgctcttctgcaaggtcgtcaaatttttgcacaaagtattctgctctgtgaccatcctcagcttccctgctattgctttggacaggtactactcagtcctctatccactggagaggaaaatatctgatgccaagtcccgtgaactggtgatgtacatctgggcccatgcagtggtggccagtgtccctgtgtttgcagtaaccaatgtggctgacatctatgccacgtccacctgcacggaagtctggagcaactccttgggccacctggtgtacgttctggtgtataacatcaccacggtcattgtgcctgtggtggtggtgttcctcttcttgatactgatccgacgggccctgagtgccagccagaagaagaaggtcatcatagcagcgctccggaccccacagaacaccatctctattccctatgcctcccagcgggaggccgagctgcacgccaccctgctctccatggtgatggtcttcatcttgtgtagcgtgccctatgccaccctggtcgtctaccagactgtgctcaatgtccctgacacttccgtcttcttgctgctcactgctgtttggctgcccaaagtctccctgctggcaaaccctgttctctttcttactgtgaacaaatctgtccgcaagtgcttgatagggaccctggtgcaactacaccaccggtacagtcgccgtaatgtggtcagtacagggagtggcatggctgaggccagcctggaacccagcatacgctcgggtagccagctcctggagatgttccacattgggcagcagcagatctttaagcccacagaggatgaggaagagagtgaggccaagtacattggctcagctgacttccaggccaaggagatatttagcacctgcctggagggagagcaggggccacagtttgcgccctctgccccacccctgagcacagtggactctgtatcccaggtggcaccggcagcccctgtggaacctgaaacattccctgataagtattccctgcagtttggctttgggccttttgagttgcctcctcagtggctctcagagacccgaaacagcaagaagcggctgcttccccccttgggcaacaccccagaagagctgatccagacaaaggtgcccaaggtaggcagggtggagcggaagatgagcagaaacaataaagtgagcatttttccaaaggtggattcctag

SEQ ID NO: 9549 - DNA, 689 bp, synthetic construct; identical to SEQ ID NO: 8698
  misc_feature 1..689: note = Synthetic polypeptide
  source 1..689: mol_type = other DNA

SEQ ID NO: 9550 - DNA, 2196 bp, synthetic construct
  misc_feature 1..2196: note = Synthetic polypeptide
  source 1..2196: mol_type = other DNA
tctccctctccctctccccatggtctccctctccctctccccacggtctccctctccctctctttccacggtctccctctcatgctgagccgaagctggactgtactgctgccatctcggctcactgcaacctccctgcctgattctcctgactcagcctgccgagtacctgcgattgcaggctggcgccgccacgcctgactggttttggtggagaccgggtttcgctatgttggccaggccggtctccaacccctaactgcaagtgatccgccagcctcggcctcccgaggtgcggggattgcagacggagtctcgttcactcagtgctcaatggtgcccaggctggagtgcagtggcgtgatctcggctcgctacaacctccacctcccagccgcctgccttggcctcccaaagtgccgagattgcagaaagattgcagcctctgcccggccaccaccccgtctgggaagtgaggagcgtctctgcctggccgcccatcatctgggatgtgaggagcccctctgcctggctgcccagtctggaaagtgaggagcgtctccgcccggccgccatcccacctaggaagtgaggagcacctcttcccggccgccatcacatctaggaagtgaggagcgtctctgcccggccgcccatcgtctgagatgtggggagcgcctctgccctgccgccccgtctgggatgtgaggagcacctctgcccggccgcgaccctgtctgggaggtgaggagcatctctgcctgccgccccctctgagaagtgaggagaccctctgcccggcaaccgccccgtctgagaagaaacttcatggtgttatggtcaacttgccgcacaaccgtgttcaaatctgtcaccaacaggttcattaaaaacctggcctgctcggggatttgtgccagcctggtctgtgtgcccttcgacatcatcctcagcaccagtcctcactgttgctggtggatctacaccatgctcttctgcaaggtcgtcaaatttttgcacaaagtattctgctctgtgaccatcctcagcttccctgctattgctttggacaggtactactcagtcctctatccactggagaggaaaatatctgatgccaagtcccgtgaactggtgatgtacatctgggcccatgcagtggtggccagtgtccctgtgtttgcagtaaccaatgtggctgacatctatgccacgtccacctgcacggaagtctggagcaactccttgggccacctggtgtacgttctggtgtataacatcaccacggtcattgtgcctgtggtggtggtgttcctcttcttgatactgatccgacgggccctgagtgccagccagaagaagaaggtcatcatagcagcgctccggaccccacagaacaccatctctattccctatgcctcccagcgggaggccgagctgcacgccaccctgctctccatggtgatggtcttcatcttgtgtagcgtgccctatgccaccctggtcgtctaccagactgtgctcaatgtccctgacacttccgtcttcttgctgctcactgctgtttggctgcccaaagtctccctgctggcaaaccctgttctctttcttactgtgaacaaatctgtccgcaagtgcttgatagggaccctggtgcaactacaccaccggtacagtcgccgtaatgtggtcagtacagggagtggcatggctgaggccagcctggaacccagcatacgctcgggtagccagctcctggagatgttccacattgggcagcagcagatctttaagcccacagaggatgaggaagagagtgaggccaagtacattggctcagctgacttccaggccaaggagatatttagcacctgcctggagggagagcaggggccacagtttgcgccctctgccccacccctgagcacagtggactctgtatcccaggtggcaccggcagcccctgtggaacctgaaacattccctgataagtattccctgcagtttggctttgggccttttgagttgcctcctcagtggctctcagagacccgaaacagcaagaagcggctgcttccccccttgggcaacaccccagaagagctgatccagacaaaggtgcccaaggtaggcagggtggagcggaagatgagcagaaacaataaagtgagcatttttccaaaggtggattcctag

SEQ ID NO: 9551 - DNA, 1974 bp, synthetic construct
  misc_feature 1..1974: note = Synthetic polypeptide
  source 1..1974: mol_type = other DNA
gagaaattggaaccctcgtacattgctggtgggaatataaaatggtgcggccactttggaaaacagcttggtagttcctcaagaagggaaacatagagttacacatgacccagcaagtctactcctaagtatatacccaagacaatgaaacatgtctacacaaaaacttgtgtataagtgatcatagcagcactattcataattgacaaaaagtagaaacaacccaaatgtccatcagccgaggagtggataagccaaatgtggtggatcgagacaatggaatattatttggcaataaaaaggaatgaacacttaaacatgcttatataacatggatgcacctggaaaacctcccactaagagaaagaagcaggcacaaaaggactgtccaacccattccggggtctcatgaagctgggcaccgtggagcggcggggggcaatgggcatctggaaggagctcttctgcgagctctccccgctggagttccgcctctacctgagcaacgaggagcacacctgtgtggagaactgctcgctgcttcgctgtgagtctgtggggccagcccatagtgatgggcgctttgagctggtcttctctggcaagaagctggccctgcgcgcctcctcccaggacgaagctgaggactggctggaccgggtgcgggaggccctgcagaaggtccggcctcagcaggaggatgagtgggtgaacgtgcagtacccagaccagcctgaggaaccccccgaggcgccccagggctgcctctctccctcagacctgctctcggagcccgcggccctccagggcacacagtttgactggtcgtccgcccaggttccagagccagatgccatcaaggagtccctgctgtacttgtacatggacaggacctggatgccctatatattttctctgtccttggaggctctgaaatgtttccgcatcaggaacaatgagaagatgctgagtgacagccacggcgtggagaccatccgggacatcctgccagacaccagccttgggggcccatccttcttcaaaatcatcacggccaaggctgtcctgaagctgcaggccggaaacgccgaggaagccgccctgtggagggatctggtccgcaaagtcctggcatcctacttggagacagccgaggaggcggtgaccctgggcgggagcctggatgaaaactgtcaggaggtgctgaaatttgccacccgggagaatggcttcctgctgcagtacctggtggctatccccatggagaaaggccttgactcccaaggctgcttctgcgcaggctgctcccggcagatcggcttctcctttgtacgacccaagctctgtgccttctctggcctctattactgtgacatctgccaccaagacgatgcctcagtgattccggccaggatcatccacaactgggacctcaccaagcgcccgatctgcaggcaggccctgaagtttctgacacagatccgggcccagcccctcatcaacctgcagatggtgaacgcgtctctgtacgagcatgtggagcggatgcacctcattgggaggagacgggagcagctgaagctcctgggggattacctgggcctgtgccggagtggcgccctgaaggagctcagcaagaggctcaaccacaggaattatctcttggaatctccgcataggttcagtgttgctgacctccaacagatcgcagacggggtgtatgaaggattcctcaaggccctgattgaatttgcctcccagcatgtctaccactgcgacctgtgcacccagcgcggcttcatctgccagatctgccagcaccacgacatcatcttcccctttgagtttgacaccacagtcaggtgtgccgagtgcaagaccgtcttccaccagagctgccaggctgtggtgaagaagggctgcccccgctgtgcccgccggcgcaagtaccaggaacagaacattttcgcctga

SEQ ID NO: 9552 - DNA, 829 bp, synthetic construct; identical to SEQ ID NO: 6626
  misc_feature 1..829: note = Synthetic polypeptide
  source 1..829: mol_type = other DNA

SEQ ID NO: 9553 - DNA, 484 bp, synthetic construct; identical to SEQ ID NO: 6627
  misc_feature 1..484: note = Synthetic polypeptide
  source 1..484: mol_type = other DNA

SEQ ID NO: 9554 - DNA, 4048 bp, synthetic construct
  misc_feature 1..4048: note = Synthetic polypeptide
  source 1..4048: mol_type = other DNA
atatattttgtaaggctatggatgccataaatagtgatttatcagatggatttggtcaaagtaaattgaaagccttctggaaaggactaaccattctagatgccattgagaacatttgtgattcatgagaggaggtcagagtagcaacattaacaggagtttggaagaagttgattccaaccttcgtggatgacttaagttcaagacttcagcggaggaattagctgcaggtatggtggaaatagcaggagtacaagaattagaagtagagcctgacagtgtgactgaattgctgcagttttatgattaaaccttaatgcatgaggatttgcttcttacggataagcaaagtaagtggcttcttgagatggcatccactcctggtgatgatgctgtgaacactgttgaaattgacaacaaaggatttagaatattacataaacttacttaataaagcagctacagggtttgagaagattgactccaattttgaaagaacttctcttgtggataaaacactgtcaaacagcattgaatgctacagagaaatctttcataaaaggaagtcagtcgaggcagcagaattcattgttgtcttgttttaagaaattgccgtagccacccaaaccttcaacaaacagccatcagcatcaaggcaagaccctccaccaacaaagagattacagttcactcaaggctcaagctggatagaacttatactggcttgcagactcttggagcagagacggtagtggatgttgaactccatcgccattctctcggagaagactgtatctatcctcagtcctcggagtctgacatctctgatgcccctccatctttgcctttgaccattccagccccagtgaaagcttcttcaccaataaagcagtcacatgagccagtacccgatacctctgtggagaaaggattcccagctagcactgaagctgaacgacacactccgttttatgctttgccatcttcattggaaagaacacccaccaaaatgactacatcccagaaagttaccttttgttcccatggcaattcagctttccagccaatagcatcaagctgcaaaattgttccacaaagtcaggttcctaatcctgagtcacctggaaaatccttccagcccatcaccatgagctgcaagattgtgtcaggttccccaatatcaactccaagcccatcaccattgcctcgaaccccgacttccactccagtccacgtgaagcaaggcactgccggctctgttattaataatccttatgttatcatggacaagcagccggggcaggtgattggagccaccactcccagtacaggaagtcctacaaacaagatctccacggcttctcaggtctcccaaggaacaggttcccctgttcctaaaattcatggaagtagttttgtaacatctactgtcaagcaggaggattctttgtttgcatctatgccacctctttgcccaattgggagtcaccctaaggttcaaagccccaaacctataacaggaggacttggagctttcacaaaagtgatcatcaaacaggaacctggtgaagcccctcacgtgcccgcaacaggagctgccagccagtcaccactcccgcagtatgtgactgtgaaagggggtcacatgatagctgtgtcccctcaaaaacaggtcataactcctggagaagggattgcccagtcagcaaaggttcagccctccaaggttgtcggggtaccagttgggtctgctttaccttcaacagtgaagcaggctgtggcgatcagtggtggccagatcctggtagccaaggccagctcttctgtctccaaagcagttgggccaaagcaagttgtaacccaaggagttgccaaagcaattgtgagtggaggtggaggaaccattgttgctcagccagtgcagaccttaaccaaggcccaggttactgccgctggtcctcagaagagtggatcccagggttcagtaatggcaacgttgcagctaccagccactaatttggccaacttggcaaatttgcctcctggcactaaactctacctaactacaaacagcaagaacccttcaggaaaaggaaaactgctgctgatccctcaaggagccatcctgcgagctacgaacaatgctaatctccagtctggctcagctgccagtggtgggagtggtgccggaggaggaggaggaggaggaggaggaggcggcagtggcagcggtggaggcggcagcacaggaggaggaggaggaacagcaggaggaggaactcaaagtactgctggccctggagggatatctcagcacctgacttacacatcttacatcctcaagcaaactccccagggcacatttttagttggccagccatcaccccagacttctggaaaacaactcaccactgggtcagtggtccaaggaacactgggagtcagcacatcttctgcacaaggacaacaaacgctaaaagtcatctctggacagaaaaccacattgtttacacaggcagcccatggaggacaggcatctctaatgaaaatatccgatagcaccttgaagactgtgccagccacctcacagctctcgaagcctggaaccacaatgctgagagtagcaggaggggttatcacaactgccacttcccctgccgtggccctctcagcaaacggtcctgcacaacagtctgaaggaatggctcccgtgtcttcatctacggtcagttctgtaacgaaaacttctgggcagcagcaagtgtgtgtgagccaggccaccgtgggaacctgcaaggctgccacccccaccgtcgtcagcgccacgtccctcgtgcctacaccaaaccccatctctgggaaagccacagtatccggactgttaaagattcactccagtcagtccagtccgcagcaggccgtcctgacgattcccagccagctcaaaccactcagcgtaaacacatctggaggggtgcagacgatcctgatgcctgtgaataaagtggttcagtcattttctaccagcaagccacctgccattctgcctgtagctgccccaactccagttgtccccagctctgctccagcagctgttgcaaaagtgaagactgaaccagaaacacctggaccgagttgcctctctcaggagggtcagacagcagtgaaaacagaagaaagttctgagctgggaaactatgtcattaagatagaccatttagaaactatccagcaactcctaactgcagtagtaaagaagattccattaatcactgcaaaaagtgaagatgccagctgcttttctgcaaagtctgtggagcagtactatggctggaacattggaaaaaggagagccgctgagtggcaaagagcaatgacaatgcgaaaagtcttacaagaaatcctggagaagaatccgagatttcaccacctgactcccctcaaaaccaagcacatcgctcactggtgccgctgtcatggctacaccccaccggaccctgagagcctgaggaatgacggggactccatcgaggacgtgctgacccagatcgacagcgagcccgagtgcccatcatcattctcctctgctgacaacctctgccgcaaactggaggacctgcaacagttccagaaaagggaacccgagaatgaggaggaggtggacatcctcagcctctccgagccagtgaagataaacatcaagaaggagcaggaagagaaacaagaggaagtcaagttctacctgccaccaaccccagggtctgaatttattggggatgtcacacagaagattgggatcaccctgcagcccgtggcactccacaggaacgtgtatgcgtccgtggtggaggacatgatcctgaaggctacagaacagctggtgaatgatatcctgagacaggctttggcagttggataccagacagcttctcacaacaggattcccaaagaaattacagtgagtaatattcaccaggccatttgcaacattccttttctggacttcctcacaaacaaacacatgggaatattgaatgaggaccagtga

SEQ ID NO: 9555 - DNA, 1160 bp, synthetic construct
  misc_feature 1..1160: note = Synthetic polypeptide
  source 1..1160: mol_type = other DNA
aggagaacgagcacagggcttggtttcagatggtggatgggcaggtggtagcactgctggtacagaatctggagcgcctggatgagtctgtgaaagaggaggcagatggcgtccacaacactctggctattgtggaaaacatggctgagttccggcctgagatgtgtacagagggtgcccagcagggtcttctacagtggctgttgaagaggctgaaggcaaagatgccttttgatgccaacaaactgtattgcagtgaagtgctggccatattgctccaggacaatgatgaaaacagggaattgcttggggagctggatggaatcgatgtgcttcttcagcagttatccgtgtttaaaagacacaatcccagcacggctgaggagcaggagatgatggagaatctgtttgattccctctgctcctgtctaatgcttagttccaatcgtgagcgcttcctgaagggcgagggtcttcagctgatgaatctcatgctcagggaaaagaagatctcccggagcagtgccctgaaagtgctggaccatgccatgattggccccgaaggcacagacaactgccataagtttgttgacattcttggcttacgaaccatctttcccctctttatgaaatctcccaggaagatcaagaaagtgggaaccactgagaaggaacatgaagagcatgtctgttcgatcctggcttccctcctgcggaacctgagagggcagcagcggacccggcttctgaataaattcactgaaaatgacagtgagaaggttgacagactaatggagttgcattttaaatatctgggtgcaatgcaggtggcggacaagaagattgaaggggaaaaacacgacatggtccggcgaggagagatcatcgacaatgacaccgaggaggagttctacctccggcgcctggatgcggggctctttgttctccagcacatctgctacatcatggccgagatctgcaatgccaatgtcccccagattcgccagagggttcaccagatcctaaacatgcgaggaagctccatcaaaattgtcaggcatatcatcaaggagtatgcagagaacatcggggacggccggagcccggagttccgggagaacgagcaaaagcgcatcctgggcttgctggagaacttctag

SEQ ID NO: 9556 - DNA, 48 bp, synthetic construct
  misc_feature 1..48: note = Synthetic polypeptide
  source 1..48: mol_type = other DNA
aggagaacgagcacagggcttggtttcagatggtggatgggcaggtgg

SEQ ID NO: 9557 - DNA, 222 bp, synthetic construct
  misc_feature 1..222: note = Synthetic polypeptide
  source 1..222: mol_type = other DNA
cagagacaaattctctttgacctttgtattcccgggtgtgggtgatgtgacatgcaagatgattttatctctccatgtggggcctgcaggcaagtcatgagagagtttggcaccaactggcccgtgtacatgaccaagccggatggtacgtatattgtcatgacggtccaggagctgctgccctcctcctttgggcctgaggacctgcagaagacccagtga

SEQ ID NO: 9558 - DNA, 308 bp, synthetic construct; identical to SEQ ID NO: 6645
  misc_feature 1..308: note = Synthetic polypeptide
  source 1..308: mol_type = other DNA

SEQ ID NO: 9559 - DNA, 281 bp, synthetic construct; identical to SEQ ID NO: 6646
  misc_feature 1..281: note = Synthetic polypeptide
  source 1..281: mol_type = other DNA

SEQ ID NO: 9560 - DNA, 359 bp, synthetic construct; identical to SEQ ID NO: 6647
  misc_feature 1..359: note = Synthetic polypeptide
  source 1..359: mol_type = other DNA

SEQ ID NO: 9561 - DNA, 230 bp, synthetic construct; identical to SEQ ID NO: 6648
  misc_feature 1..230: note = Synthetic polypeptide
  source 1..230: mol_type = other DNA

SEQ ID NO: 9562 - DNA, 2232 bp, synthetic construct
  misc_feature 1..2232: note = Synthetic polypeptide
  source 1..2232: mol_type = other DNA
tacatccctttcttcccttccaaatcgagcaaggatgcctgccctggaagtgtataaacccggggaagggagacagaaaaggatagttttaagtattggtgttggggacgtgttctttagccaaggcagcatgaacccatggcagcacttcccaaccttcctgacatgggcgtttctgtgaactccagtgtgatggagaaatggcattggctcaggtgtgcagctagatatgttacagagcagggtgacaggcaggggtgatgagttttgttttaacaacctgtcccttcaaccctcatggtactgacaaagatcacatggctctcgggggagattcctgcgaggggaagcaaggagagcatccttacatattattgatccaggcagcagatttgcagcaaagctctgtgctttattcatctgttaaaatagttaaaatagtcaaaacataggaaaaggattctgggaagtcagaatcggcttcagagcacacccctcctgcacttgcccggttctcagacttgggaatgggactgggtgggtgggtactctcgggtgttccgcgggtttgggtcttacttgtacactttgcttgatttcaaggaggtgcaggagaacagctctgtgataccatttaacttgttgacattacttttatttgaaggaacgtatattagagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataagatcaagacactcatcaagaagtacatccagaggcaggagacaatcagcctggtggtggtccccagtaatgtggacatcgccaccacagaggctctcagcatggcccaggaggtggaccccgagggagacaggaccatcggaatcttgacgaagcctgatctggtggacaaaggaactgaagacaaggttgtggacgtggtgcggaacctcgtgttccacctgaagaagggttacatgattgtcaagtgccggggccagcaggagatccaggaccagctgagcctgtccgaagccctgcagagagagaagatcttctttgagaaccacccatatttcagggatctgctggaggaaggaaaggccacggttccctgcctggcagaaaaacttaccagcgagctcatcacacatatctgtaaatctctgcccctgttagaaaatcaaatcaaggagactcaccagagaataacagaggagctacaaaagtatggtgtcgacataccggaagacgaaaatgaaaaaatgttcttcctgatagataaagttaatgcctttaatcaggacatcactgctctcatgcaaggagaggaaactgtaggggaggaagacattcggctgtttaccagactccgacacgagttccacaaatggagtacaataattgaaaacaattttcaagaaggccataaaattttgagtagaaaaatccagaaatttgaaaatcagtatcgtggtagagagctgccaggctttgtgaattacaggacatttgagacaatcgtgaaacagcaaatcaaggcactggaagagccggctgtggatatgctacacaccgtgacggatatggtccggcttgctttcacagatgtttcgataaaaaattttgaagagttttttaacctccacagaaccgccaagtccaaaattgaagacattagagcagaacaagagagagaaggtgagaagctgatccgcctccacttccagatggaacagattgtctactgccaggaccaggtatacaggggtgcattgcagaaggtcagagagaaggagctggaagaagaaaagaagaagaaatcctgggattttggggctttccagtccagctcggcaacagactcttccatggaggagatctttcagcacctgatggcctatcaccaggaggccagcaagcgcatctccagccacatccctttgatcatccagttcttcatgctccagacgtacggccagcagcttcagaaggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaa

SEQ ID NO: 9563 - DNA, 834 bp, synthetic construct
  misc_feature 1..834: note = Synthetic polypeptide
  source 1..834: mol_type = other DNA
tacatccctttcttcccttccaaatcgagcaaggatgcctgccctggaagtgtataaacccggggaagggagacagaaaaggatagttttaagtattggtgttggggacgtgttctttagccaaggcagcatgaacccatggcagcacttcccaaccttcctgacatgggcgtttctgtgaactccagtgtgatggagaaatggcattggctcaggtgtgcagctagatatgttacagagcagggtgacaggcaggggtgatgagttttgttttaacaacctgtcccttcaaccctcatggtactgacaaagatcacatggctctcgggggagattcctgcgaggggaagcaaggagagcatccttacatattattgatccaggcagcagatttgcagcaaagctctgtgctttattcatctgttaaaatagttaaaatagtcaaaacataggaaaaggattctgggaagtcagaatcggcttcagagcacacccctcctgcacttgcccggttctcagacttgggaatgggactgggtgggtgggtactctcgggtgttccgcgggtttgggtcttacttgtacactttgcttgatttcaaggaggtgcaggagaacagctctgtgataccatttaacttgttgacattacttttatttgaaggaacgtatattagagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataag

SEQ ID NO: 9564 - DNA, 847 bp, synthetic construct
  misc_feature 1..847: note = Synthetic polypeptide
  source 1..847: mol_type = other DNA
tacatccctttcttcccttccaaatcgagcaaggatgcctgccctggaagtgtataaacccggggaagggagacagaaaaggatagttttaagtattggtgttggggacgtgttctttagccaaggcagcatgaacccatggcagcacttcccaaccttcctgacatgggcgtttctgtgaactccagtgtgatggagaaatggcattggctcaggtgtgcagctagatatgttacagagcagggtgacaggcaggggtgatgagttttgttttaacaacctgtcccttcaaccctcatggtactgacaaagatcacatggctctcgggggagattcctgcgaggggaagcaaggagagcatccttacatattattgatccaggcagcagatttgcagcaaagctctgtgctttattcatctgttaaaatagttaaaatagtcaaaacataggaaaaggattctgggaagtcagaatcggcttcagagcacacccctcctgcacttgcccggttctcagacttgggaatgggactgggtgggtgggtactctcgggtgttccgcgggtttgggtcttacttgtacactttgcttgatttcaaggaggtgcaggagaacagctctgtgataccatttaacttgttgacattacttttatttgaaggaacgtatattagagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataagatcaagacactca

SEQ ID NO: 9565 - DNA, 588 bp, synthetic construct; identical to SEQ ID NO: 7495
  misc_feature 1..588: note = Synthetic polypeptide
  source 1..588: mol_type = other DNA

SEQ ID NO: 9566 - DNA, 164 bp, synthetic construct; identical to SEQ ID NO: 831
  misc_feature 1..164: note = Synthetic polypeptide
  source 1..164: mol_type = other DNA

SEQ ID NO: 9567 - DNA, 193 bp, synthetic construct; identical to SEQ ID NO: 834
  misc_feature 1..193: note = Synthetic polypeptide
  source 1..193: mol_type = other DNA

SEQ ID NO: 9568 - DNA, 1083 bp, synthetic construct; identical to SEQ ID NO: 7080
  misc_feature 1..1083: note = Synthetic polypeptide
  source 1..1083: mol_type = other DNA

SEQ ID NO: 9569 - DNA, 594 bp, synthetic construct
  misc_feature 1..594: note = Synthetic polypeptide
  source 1..594: mol_type = other DNA
gagggaggagccaagatggccgaataggaacagctccggtctacagctcccagcatgagcaacgcagaagacgggtgatttctgcatttccatctgagattagtgggatggtttggccatgaactcagcaccagatttaagatggataacaaactgcagttaatccctggggtctgtggattccgaatttcaaatcctcccattttgttggtctgttccttgcatgctagtttagagatctttaagcaagcgacaatgaaggcattgcggaaaaaatctgttttgctaactggctatctggaatacctgatcaagcataactatggcaaagataaagcagcaaccaagaaaccagttgtgaacataattactccgtctcatgtagaggagcgggggtgccagctaacaataacattttctgttccaaacaaagatgttttccaagaactagaaaaaagaggagtggtttgtgacaagcggaatccaaatggcattcgagtggctccagttcctctctataattctttccatgatgtttataaatttaccaatctgctcacttctatacttgactctgcagaaacaaaaaattag

SEQ ID NO: 9570 - DNA, 236 bp, synthetic construct
  misc_feature 1..236: note = Synthetic polypeptide
  source 1..236: mol_type = other DNA
tttggcccagtgaacaggacaaccaaaactgctctgctcttccgaaaattgcagtcagggaacctgggacccggcaagccagcagaagggaaaatctacctgatttttataatgactggatgttcattgctaaacatctgcctgatctcatagagtctggccagcttcgagaaagagttgagaagttaaacatgctcagcattgatcatctcacagaccacaagtcacagcgcctt

SEQ ID NO: 9571 - DNA, 542 bp, synthetic construct
  misc_feature 1..542: note = Synthetic polypeptide
  source 1..542: mol_type = other DNA
tttggcccagtgaacaggacaaccaaaactgctctgctcttccgaaaattgcagtcagggaacctgggacccggcaagccagcagaagggaaaatctacctgatttttataatgactggatgttcattgctaaacatctgcctgatctcatagagtctggccagcttcgagaaagagttgagaagttaaacatgctcagcattgatcatctcacagaccacaagtcacagcgccttgcacgtctagttctgggatgcatcaccatggcatatgtgtggggcaaaggtcatggagatgtccgtaaggtcttgccaagaaatattgctgttccttactgccaactctccaagaaactggaactgcctcctattttggtttatgcagactgtgtcttggcaaactggaagaaaaaggatcctaataagcccctgacttatgagaacatggacgttttgttctcatttcgtgatggagactgcagtaaaggattcttcctggtctctctattggtggaaatagcagctgcttctgcaatcaaagta

SEQ ID NO: 9572 - DNA, 1214 bp, synthetic construct
  misc_feature 1..1214: note = Synthetic polypeptide
  source 1..1214: mol_type = other DNA
tttggcccagtgaacaggacaaccaaaactgctctgctcttccgaaaattgcagtcagggaacctgggacccggcaagccagcagaagggaaaatctacctgatttttataatgactggatgttcattgctaaacatctgcctgatctcatagagtctggccagcttcgagaaagagttgagaagttaaacatgctcagcattgatcatctcacagaccacaagtcacagcgccttgcacgtctagttctgggatgcatcaccatggcatatgtgtggggcaaaggtcatggagatgtccgtaaggtcttgccaagaaatattgctgttccttactgccaactctccaagaaactggaactgcctcctattttggtttatgcagactgtgtcttggcaaactggaagaaaaaggatcctaataagcccctgacttatgagaacatggacgttttgttctcatttcgtgatggagactgcagtaaaggattcttcctggtctctctattggtggaaatagcagctgcttctgcaatcaaagtaattcctactgtattcaaggcaatgcaaatgcaagaacgggacactttgctaaaggcgctgttggaaatagcttcttgcttggagaaagcccttcaagtgtttcaccaaatccacgatcatgtgaacccaaaagcatttttcagtgttcttcgcatatatttgtctggctggaaaggcaacccccagctatcagacggtctggtgtatgaagggttctgggaagacccaaaggagtttgcagggggcagtgcaggccaaagcagcgtctttcagtgctttgacgtcctgctgggcatccagcagactgctggtggaggacatgctgctcagttcctccaggacatgagaagatatatgccaccagctcacaggaacttcctgtgctcattagagtcaaatccctcagtccgtgagtttgtcctttcaaaaggtgatgctggcctgcgggaagcttatgacgcctgtgtgaaagctctggtctccctgaggagctaccatctgcaaatcgtgactaagtacatcctgattcctgcaagccagcagccaaaggagaataagacctctgaagacccttcaaaactggaagccaaaggaactggaggcactgatttaatgaatttcctgaagactgtaagaagtacaactgagaaatcccttttgaaggaaggttaa

SEQ ID NO: 9573 - DNA, 144 bp, synthetic construct
  misc_feature 1..144: note = Synthetic polypeptide
  source 1..144: mol_type = other DNA
tttggcccagtgaacaggacaaccaaaactgctctgctcttccgaaaattgcagtcagggaacctgggacccggcaagccagcagaagggaaaatctacctgatttttataatgactggatgttcattgctaaacatctgcctg

SEQ ID NO: 9574 - DNA, 515 bp, synthetic construct
  misc_feature 1..515: note = Synthetic polypeptide
  source 1..515: mol_type = other DNA
tttggcccagtgaacaggacaaccaaaactgctctgctcttccgaaaattgcagtcagggaacctgggacccggcaagccagcagaagggaaaatctacctgatttttataatgactggatgttcattgctaaacatctgcctgatctcatagagtctggccagcttcgagaaagagttgagaagttaaacatgctcagcattgatcatctcacagaccacaagtcacagcgccttgcacgtctagttctgggatgcatcaccatggcatatgtgtggggcaaaggtcatggagatgtccgtaaggtcttgccaagaaatattgctgttccttactgccaactctccaagaaactggaactgcctcctattttggtttatgcagactgtgtcttggcaaactggaagaaaaaggatcctaataagtatgtaaacagaacatggacgttttgttctcatttcgtgatggagactgcagtaaaggattcttcctggtctctctattggtggaaatag

SEQ ID NO: 9575 - DNA, 948 bp, synthetic construct
  misc_feature 1..948: note = Synthetic polypeptide
  source 1..948: mol_type = other DNA
ctcttgatctttatcccactcttcctttaatcctctctttcaggaaatgcaaatgcgtagggggaaaccctaaggaatcatcctccagtcttcatcttcctgcacctgttgatctgcaagacctgttggttctgcctccacagcgcatatccacttccatcatttttgctgtcaccctggcccaagccgacgttgtctcgagtcaactaccgaaatagtttcctagctgatctctctgcttttcttctggctcccctaaaattcagtctccgtactctggccaggtataaaagtttggtcacggggacccgagcaagaggggtcattgctgtcctctgggtccttgcctttggcatcggattgactccattcctggggtggaacagtaaagacagtgccaccaacaactgcacagaaccctgggatggaaccacgaatgaaagctgctgccttgtgaagtgtctctttgagaatgtggtccccatgagctacatggtatatttcaatttctttgggtgtgttctgcccccactgcttataatgctggtgatctacattaagatcttcctggtggcctgcaggcagcttcagcgcactgagctgatggaccactcgaggaccaccctccagcgggagatccatgcagccaagtcactggccatgattgtggggatttttgccctgtgctggttacctgtgcatgctgttaactgtgtcactcttttccagccagctcagggtaaaaataagcccaagtgggcaatgaatatggccattcttctgtcacatgccaattcagttgtcaatcccattgtctatgcttaccggaaccgagacttccgctacacttttcacaaaattatctccaggtatcttctctgccaagcagatgtcaagagtgggaatggtcaggctggggtacagcctgctctcggtgtgggcctatga

SEQ ID NO: 9576 - DNA, 966 bp, synthetic construct
  misc_feature 1..966: note = Synthetic polypeptide
  source 1..966: mol_type = other DNA
tcagtcctctgtatcgggggtccacgccgtggatccagccaaccgtaggttggaaatgttcagtttcaggaccacgtcaagacttgtggcaagtgtcgagtcccttgcagattccacgccatcggctgcctcgagacggtagagggtgagaaacagcaggagcacgaggtgcagtggctgcgggagcacctggccatgctactgagctcggtgctggaggcaaagcccctcttgggagaccagagccacgcggggtcagagctcctgcagaggtgcgagagcctggagaagaagacggccacttttgagaacattgtctgcgtcctgaaccgggaggtggagagggtggccatgactgccgaggcctgcagccggcagcaccggctggaccaagacaagattgaagccctgagtagcaaggtgcagcagctggagaggagcattggcctcaaggacctggcgatggctgacttggagcagaaggtcttggagatggaggcatccacctacgatggggtcttcatctggaagatctcagacttcgccaggaagcgccaggaagctgtggctggccgcatacccgccatcttctccccagccttctacaccagcaggtacggctacaagatgtgtctgcgtatctacctgaacggcgacggcaccgggcgaggaacacacctgtccctcttctttgtggtgatgaagggcccgaatgacgccctgctgcggtggcccttcaaccagaaggtgaccttaatgctgctcgaccagaataaccgggagcacgtgattgacgccttcaggcccgacgtgacttcatcctcttttcagaggccagtcaacgacatgaacatcgcaagcggctgccccctcttctgccccgtctccaagatggaggcaaagaattcctacgtgcgggacgatgccatcttcatcaaggccattgtggacctgacagggctctaa

SEQ ID NO: 9577 - DNA, 576 bp, synthetic construct
  misc_feature 1..576: note = Synthetic polypeptide
  source 1..576: mol_type = other DNA
ggccgggtgcagtggctcacaactgtaatcccaggactttgggaggctgaggcgggcagatcacctgaggtcaggagtttgagagcagcctggtcaacatgatgaaatcccgtctctactaaaaatacaaaaaattagctggacatggtggcagccagcacaggccagccagaagatgacactgagactacaggtttggaaggcggcgttgccatgccaggtgccgaagatgatgtggtgactccaggaaccagcgaagaccgctataagtctggcttgacaactctggtggcaacaagtgtcaacagtgtaacaggcattcgcatcgaggatctgccaacttcagaaagcacagtccacgcgcaagaacaaagtccaagcgccacagcctcaaacgtggccaccagtcactccacggagaaagtggatggagacacacagacaacagttgagaaagatggtttgtcaacagtgaccctggttggaatcatagttggggtcttactagccatcggcttcattggtgcaatcatcgttgtggttatgcgaaaaatgtcgggaaggtactcgccctaa

SEQ ID NO: 9578 - DNA, 570 bp, synthetic construct
  misc_feature 1..570: note = Synthetic polypeptide
  source 1..570: mol_type = other DNA
ggccgggtgcagtggctcacaactgtaatcccaggactttgggaggctgaggcgggcagatcacctgaggtcaggagtttgagagcagcctggtcaacatgatgaaatcccgtctctactaaaaatacaaaaaattagctggacatggtggcagccagcacaggccagccagaagatgacactgagactacaggtttggaaggcggcgttgccatgccaggtgccgaagatgatgtggtgactccaggaaccagcgaagaccgctataagtctggcttgacaactctggtggcaacaagtgtcaacagtgtaacaggcattcgcatcgaggatctgccaacttcagaaagcacagtccacgcgcaagaacaaagtccaagcgccacagcctcaaacgtggccaccagtcactccacggagaaagtggatggagacacacagacaacagttgagaaagatggtttgtcaacagtgaccctggttggaatcatagttggggtcttactagccatcggcttcattggtgcaatcatcgttgtggttatgcgaaaaatgtcgggaaggccctaa

SEQ ID NO: 9579 - DNA, 573 bp, synthetic construct
  misc_feature 1..573: note = Synthetic polypeptide
  source 1..573: mol_type = other DNA
ggccgggtgcagtggctcacaactgtaatcccaggactttgggaggctgaggcgggcagatcacctgaggtcaggagtttgagagcagcctggtcaacatgatgaaatcccgtctctactaaaaatacaaaaaattagctggacatggtggcagccagcacaggccagccagaagatgacactgagactacaggtttggaaggcggcgttgccatgccaggtgccgaagatgatgtggtgactccaggaaccagcgaagaccgctataagtctggcttgacaactctggtggcaacaagtgtcaacagtgtaacaggcattcgcatcgaggatctgccaacttcagaaagcacagtccacgcgcaagaacaaagtccaagcgccacagcctcaaacgtggccaccagtcactccacggagaaagtggatggagacacacagacaacagttgagaaagatggtttgtcaacagtgaccctggttggaatcatagttggggtcttactagccatcggcttcattggtgcaatcatcgttgtggttatgcgaaaaatgtcgggaaggtactcgtaa

SEQ ID NO: 9580 - DNA, 375 bp, synthetic construct; identical to SEQ ID NO: 860
  misc_feature 1..375: note = Synthetic polypeptide
  source 1..375: mol_type = other DNA

SEQ ID NO: 9581 - DNA, 255 bp, synthetic construct; identical to SEQ ID NO: 862
  misc_feature 1..255: note = Synthetic polypeptide
  source 1..255: mol_type = other DNA

SEQ ID NO: 9582 - DNA, 994 bp, synthetic construct
  misc_feature 1..994: note = Synthetic polypeptide
  source 1..994: mol_type = other DNA
ctctccctctccctctccctctccccatggtctccctctccccatggtctccctctccctctctttccacggtctccctctcatgccgagccgaagctggactatactgctgccatctcggctcactgcaacctccctgcctgattctcctgcctcagcctgccgagtgcctgcgattgcaggcgcgcgcctccacgcctgactggttttcgtatttttttggtggagacggggtttcgctgtgttggccgggctggtctccagctcctaaccgcgagtgatccgccagcctcggcctcccgaggtgccgggattgcagacggagtctggttcactcagtgctcaatggcgcccaggctggagtgcagtggcgtgatctcggctcgctacaacctccacctcccagccgcctgccttggcctcccgaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctctgcctggccgccatcccatctgggaagtgaggagcgcctcttcccggccgccatcacatctaggaagtgaggagcgtctctgcccggccgcccatcgtctgggatgtggggagtgcctctgccccgccgccctgtctgggatgtgaggagcgcctctgcccggccgccaccccgtctgggaggatgggcacgatctcggctcactgcaacctccgcctcccgggttcaagcaattctcctgtctcagcctcccctcagtgcacttttataaaccgtcctcagaacccttgggaagcccaagatcgtcaaaaagagaaccaagaagtttatccggcaccagtctgaccgatatgtcaaaattaagcgtaaccggcggaaacccagaggtattgacaacagggttcgtggaaggttcaagggttagatcttga

SEQ ID NO: 9583 - DNA, 582 bp, synthetic construct
  misc_feature 1..582: note = Synthetic polypeptide
  source 1..582: mol_type = other DNA
cccccgcccggccagccgccctgtccgggagggaggtgggggggtcagccctccgctgggccagccgccccgtctgggaggtgaggggcgcctctgcccggccgcccctactgggaagtgaggagcccctctgcccggccagccgccccgtccgggagggaggtgggggggtcagccccccgcccggccagccgccccgtccgggagggaggtggggggggtcagccccctgcccggccggcctccccgtccgggaggtgaggggcgcctctgcccggccgcccctactgggaagtgaggagcccctctgcccggccagccgccccgtccgggagggaggttggggggtcagccccccgcccggccagccgccccgtccgggagtgctacagttgaaactccagcagcgccggacccgggaagaactggtgagccaagggatcatgccgcctttgaaaagtccagccgcatttcatgagcagagaaggagcttggagcgggccaggacagaggactatctcaaacggaagattcgttcccggccggagagatcggagctggtcaggatgcacattttggaag

SEQ ID NO: 9584 - DNA, 711 bp, synthetic construct; identical to SEQ ID NO: 7377
  misc_feature 1..711: note = Synthetic polypeptide
  source 1..711: mol_type = other DNA

SEQ ID NO: 9585 - DNA, 1234 bp, synthetic construct; identical to SEQ ID NO: 676
  misc_feature 1..1234: note = Synthetic polypeptide
  source 1..1234: mol_type = other DNA

SEQ ID NO: 9586 - DNA, 586 bp, synthetic construct; identical to SEQ ID NO: 677
  misc_feature 1..586: note = Synthetic polypeptide
  source 1..586: mol_type = other DNA

SEQ ID NO: 9587 - DNA, 890 bp, synthetic construct; identical to SEQ ID NO: 678
  misc_feature 1..890: note = Synthetic polypeptide
  source 1..890: mol_type = other DNA

SEQ ID NO: 9588 - DNA, 1516 bp, synthetic construct; identical to SEQ ID NO: 534
  misc_feature 1..1516: note = Synthetic polypeptide
  source 1..1516: mol_type = other DNA

SEQ ID NO: 9589 - DNA, 591 bp, synthetic construct; identical to SEQ ID NO: 539
  misc_feature 1..591: note = Synthetic polypeptide
  source 1..591: mol_type = other DNA

SEQ ID NO: 9590 - DNA, 482 bp, synthetic construct; identical to SEQ ID NO: 540
  misc_feature 1..482: note = Synthetic polypeptide
  source 1..482: mol_type = other DNA

SEQ ID NO: 9591 - DNA, 444 bp, synthetic construct; identical to SEQ ID NO: 541
  misc_feature 1..444: note = Synthetic polypeptide
  source 1..444: mol_type = other DNA

SEQ ID NO: 9592 - DNA, 334 bp, synthetic construct; identical to SEQ ID NO: 533
  misc_feature 1..334: note = Synthetic polypeptide
  source 1..334: mol_type = other DNA

SEQ ID NO: 9593 - DNA, 38 bp, synthetic construct; identical to SEQ ID NO: 543
  misc_feature 1..38: note = Synthetic polypeptide
  source 1..38: mol_type = other DNA

SEQ ID NO: 9594 - DNA, 245 bp, synthetic construct; identical to SEQ ID NO: 542
  misc_feature 1..245: note = Synthetic polypeptide
  source 1..245: mol_type = other DNA

SEQ ID NO: 9595 - DNA, 898 bp, synthetic construct; identical to SEQ ID NO: 569
  misc_feature 1..898: note = Synthetic polypeptide
  source 1..898: mol_type = other DNA

SEQ ID NO: 9596 - DNA, 961 bp, synthetic construct; identical to SEQ ID NO: 570
  misc_feature 1..961: note = Synthetic polypeptide
  source 1..961: mol_type = other DNA

SEQ ID NO: 9597 - DNA, 818 bp, synthetic construct; identical to SEQ ID NO: 572
  misc_feature 1..818: note = Synthetic polypeptide
  source 1..818: mol_type = other DNA

SEQ ID NO: 9598 - DNA, 974 bp, synthetic construct
  misc_feature 1..974: note = Synthetic polypeptide
  source 1..974: mol_type = other DNA
ctctcccctctcccttctcccctctcccctctccctctcggtctccctctccctctctttccactgtctccctctgatgccgagccgaagctggactgtactgctgccatctcggctcactgcaacctccccgcctgattctcctgcctcagcctgcccagtgcctgcgattgcaggcgcgcgccaccacgcctgactggttttcgtacttttttggtggagatggggtttcgctgtgttggccgggctggtctccagctcctaaccgcgagtgatccgccagcctcggcctcccgaggtgccgggattgcagacggagtctggttcactcagtgctcaatggtgcccaggctggagtgcagtggcgtgatctcagctcgctacaacctccatctcccagccgcctgccttggcctcccaaagtgccgagattgcagcctctgcccggccgccaccccgtctgggaagtgaggagcgtctctgcctggccgcccatcgtctgggacgtgaggagcccctctgcctggctgcccagtctggaaagtgaggagcgtctctgccccgccgccatcccgtctaggaagtgaggagcgcctcttcccggcagccatcccatctgggaagtgaggagcgtctctgcccggccgcccatcgtctgagatgtggggagcgcctctgccccgccgccccgtctgggatgtgaggagcgcctctgccaggctgcgaccccgtctgggaggtgaggagcgtctctgcccagccgccccgtctgagaagtgaggagcccctccgcccggcagctgccccgtctgagaaggagaagtgaattcaaacggtgctggaagggtcaaggggcctgccaaacttactgcacaaggcaagaaacttacatgcacctgtgcccggatgcgtccctgtgctgtctctcctatgcattgaaacctccaccggtccccaagcatgaatatgagtag

SEQ ID NO: 9599 - DNA, 1039 bp, synthetic construct
  misc_feature 1..1039: note = Synthetic polypeptide
  source 1..1039: mol_type = other DNA
ttctggctaaccatctactgctcttgtgaggccaagtgtctcatctctcagcctcagtgatgtttataatcttgctatgaggggaaatcctagcagcctcctagagttattgtgaaaattgaatgagctaattcccagaatgtgtccatgggacctggagcgtaggaagcaattgatagagtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctag

SEQ ID NO: 9600 - DNA, 248 bp, synthetic construct
  misc_feature 1..248: note = Synthetic polypeptide
  source 1..248: mol_type = other DNA
ttctggctaaccatctactgctcttgtgaggccaagtgtctcatctctcagcctcagtgatgtttataatcttgctatgaggggaaatcctagcagcctcctagagttattgtgaaaattgaatgagctaattcccagaatgtgtccatgggacctggagcgtaggaagcaattgatagagtacatgtacccctccatggatcagctggctgaaatgcttcctggagtccttcaacagtttgggctga

SEQ ID NO: 9601 - DNA, 505 bp, synthetic construct
  misc_feature 1..505: note = Synthetic polypeptide
  source 1..505: mol_type = other DNA
ttctggctaaccatctactgctcttgtgaggccaagtgtctcatctctcagcctcagtgatgtttataatcttgctatgaggggaaatcctagcagcctcctagagttattgtgaaaattgaatgagctaattcccagaatgtgtccatgggacctggagcgtaggaagcaattgatagagtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagcctttcgattaccaggcattggtattagatactgtgatgtgtgcagttacttcttgcagtccttcccttgaccttgtggccttgaagttcctggcactcccagttccagattag

SEQ ID NO: 9602 - DNA, 383 bp, synthetic construct
  misc_feature 1..383: note = Synthetic polypeptide
  source 1..383: mol_type = other DNA
ttctggctaaccatctactgctcttgtgaggccaagtgtctcatctctcagcctcagtgatgtttataatcttgctatgaggggaaatcctagcagcctcctagagttattgtgaaaattgaatgagctaattcccagaatgtgtccatgggacctggagcgtaggaagcaattgatagagtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccg

SEQ ID NO: 9603 - DNA, 352 bp, synthetic construct
  misc_feature 1..352: note = Synthetic polypeptide
  source 1..352: mol_type = other DNA
ttctggctaaccatctactgctcttgtgaggccaagtgtctcatctctcagcctcagtgatgtttataatcttgctatgaggggaaatcctagcagcctcctagagttattgtgaaaattgaatgagctaattcccagaatgtgtccatgggacctggagcgtaggaagcaattgatagagtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaac

SEQ ID NO: 9604 - DNA, 349 bp, synthetic construct
  misc_feature 1..349: note = Synthetic polypeptide
  source 1..349: mol_type = other DNA
ttctggctaaccatctactgctcttgtgaggccaagtgtctcatctctcagcctcagtgatgtttataatcttgctatgaggggaaatcctagcagcctcctagagttattgtgaaaattgaatgagctaattcccagaatgtgtccatgggacctggagcgtaggaagcaattgatagagtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtg

SEQ ID NO: 9605 - DNA, 328 bp, synthetic construct
  misc_feature 1..328: note = Synthetic polypeptide
  source 1..328: mol_type = other DNA
ttctggctaaccatctactgctcttgtgaggccaagtgtctcatctctcagcctcagtgatgtttataatcttgctatgaggggaaatcctagcagcctcctagagttattgtgaaaattgaatgagctaattcccagaatgtgtccatgggacctggagcgtaggaagcaattgatagagtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggag

SEQ ID NO: 9606 - DNA, 291 bp, synthetic construct
  misc_feature 1..291: note = Synthetic polypeptide
  source 1..291: mol_type = other DNA
ttctggctaaccatctactgctcttgtgaggccaagtgtctcatctctcagcctcagtgatgtttataatcttgctatgaggggaaatcctagcagcctcctagagttattgtgaaaattgaatgagctaattcccagaatgtgtccatgggacctggagcgtaggaagcaattgatagagtacatgtacccctccatggatcagctggctgaaatgcttcctggagtccttcaacagtttgggctgaaaagcattattggcatgggaacaggagcaggcgcctacatcct

SEQ ID NO: 9607 - DNA, 254 bp, synthetic construct
  misc_feature 1..254: note = Synthetic polypeptide
  source 1..254: mol_type = other DNA
ttctggctaaccatctactgctcttgtgaggccaagtgtctcatctctcagcctcagtgatgtttataatcttgctatgaggggaaatcctagcagcctcctagagttattgtgaaaattgaatgagctaattcccagaatgtgtccatgggacctggagcgtaggaagcaattgatagagtacatgtacccctccatggatcagctggctgaaatgcttcctggagtccttcaacagtttgggctgaaaagca

SEQ ID NO: 9608 - DNA, 193 bp, synthetic construct
  misc_feature 1..193: note = Synthetic polypeptide
  source 1..193: mol_type = other DNA
ttctggctaaccatctactgctcttgtgaggccaagtgtctcatctctcagcctcagtgatgtttataatcttgctatgaggggaaatcctagcagcctcctagagttattgtgaaaattgaatgagctaattcccagaatgtgtccatgggacctggagcgtaggaagcaattgatagagtacatgtacccc

SEQ ID NO: 9609 - DNA, 779 bp, synthetic construct
  misc_feature 1..779: note = Synthetic polypeptide
  source 1..779: mol_type = other DNA
cagccgcctgccttggcctcccaaagtgccgagattgcagcctctgcccggccgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcagccgccatcacatctaggaagtgaggagcgtctctgcccggccgcccatcgtctgagatgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagccgccccgtctgagaagtgaggagcctctccacccggcagccaccccatctgggaagtgaggagcgtctccgcccggcagccaccccgtccgggagggaggtggggggggtcagccccccgcccggccagccgccccgtccgggagtgctacagttgaaactccagcagcgccggacccgggaagaactggtgagccaagggatcatgccgcctttgaaaagtccagccgcatttcatgagcagagaaggagcttggagcgggccaggacagaggactatctcaaacggaagattcgttcccggccggagagatcggagctggtcaggatgcacattttggaag

SEQ ID NO: 9610 - DNA, 3999 bp, synthetic construct
  misc_feature 1..3999: note = Synthetic polypeptide
  source 1..3999: mol_type = other DNA
ctctccctctccctctccctctttctccctctccctctccccatggtctccctctccctctctttccacggtctccctctgatgccgagccaaagctggactgtactgccgccatctcggctcactgcaacctccctgcctgattctcctgcctcagcctgcccagtgcctgcgattgcaggcgcgcgccgccacgcctgactggttttcgtatttttttggtggagacggggtttcgctgtgttggccgggctggtctccagctcctagccgcgagtgatctgccagcctcggcatcctgaggtgccgggattgcagacggagtctggttcactcagtgctcaatggtgcccaggctggagtgcagtggcgtgatctcggctcgctacaacatccacctcccagccgcctgccttggcctcccaaagtgccgagattgcagcctctgcccggccaccaccccgtctgggaagtgaggagcgtctctgcctggccgcccatcgtctgggacatgaggagcccctctgcctggctgcccagtctggaaagtgaggagcgtctctgcccggccgccatcccatctaggaagtgaggagcgcctcttcccggccgccatcccatctaggaagtgaggagcgtctctgcccggccacccatcgtctgagatgtggggagcgcctctgccccgccgccccatctgggatgtgaggagcgcctctgcccagccgcgaccccgtctgggaggtgaggagcgtctctgcccggccgccccgtctgagaagtgaggagaccctccgcccggcagccgccccgtctgagaagtgaggagcccctccgcctggcagctgccctgtctgagaagaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagggggaaggttcctcctcattcttgtcggaaacttgccatgaggatccctctgtttcccccaactttactccccccaaccctcaagctctcaagtggtga

SEQ ID NO: 9611 - DNA, 4128 bp, synthetic construct
  misc_feature 1..4128: note = Synthetic polypeptide
  source 1..4128: mol_type = other DNA
ctctccctctccctctccctctttctccctctccctctccccatggtctccctctccctctctttccacggtctccctctgatgccgagccaaagctggactgtactgccgccatctcggctcactgcaacctccctgcctgattctcctgcctcagcctgcccagtgcctgcgattgcaggcgcgcgccgccacgcctgactggttttcgtatttttttggtggagacggggtttcgctgtgttggccgggctggtctccagctcctagccgcgagtgatctgccagcctcggcatcctgaggtgccgggattgcagacggagtctggttcactcagtgctcaatggtgcccaggctggagtgcagtggcgtgatctcggctcgctacaacatccacctcccagccgcctgccttggcctcccaaagtgccgagattgcagcctctgcccggccaccaccccgtctgggaagtgaggagcgtctctgcctggccgcccatcgtctgggacatgaggagcccctctgcctggctgcccagtctggaaagtgaggagcgtctctgcccggccgccatcccatctaggaagtgaggagcgcctcttcccggccgccatcccatctaggaagtgaggagcgtctctgcccggccacccatcgtctgagatgtggggagcgcctctgccccgccgccccatctgggatgtgaggagcgcctctgcccagccgcgaccccgtctgggaggtgaggagcgtctctgcccggccgccccgtctgagaagtgaggagaccctccgcccggcagccgccccgtctgagaagtgaggagcccctccgcctggcagctgccctgtctgagaagaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagctgcaggtggagctggagcaagaataccaagacaaattcaaaagactgcccctcgagattttggaattcgtgcaggaagccatgaaaggaaagatcagtgaagacagcaatcacggttctgcccctctctccctgtcctcagaccctggaaaagtgaaccacaagactccctccagtgaggagctgggaggagacatcccaggaaaagaatttgatactcctctgtga

SEQ ID NO: 9612 - DNA, 1177 bp, synthetic construct
  misc_feature 1..1177: note = Synthetic polypeptide
  source 1..1177: mol_type = other DNA
ctctccctctccctctccctctttctccctctccctctccccatggtctccctctccctctctttccacggtctccctctgatgccgagccaaagctggactgtactgccgccatctcggctcactgcaacctccctgcctgattctcctgcctcagcctgcccagtgcctgcgattgcaggcgcgcgccgccacgcctgactggttttcgtatttttttggtggagacggggtttcgctgtgttggccgggctggtctccagctcctagccgcgagtgatctgccagcctcggcatcctgaggtgccgggattgcagacggagtctggttcactcagtgctcaatggtgcccaggctggagtgcagtggcgtgatctcggctcgctacaacatccacctcccagccgcctgccttggcctcccaaagtgccgagattgcagcctctgcccggccaccaccccgtctgggaagtgaggagcgtctctgcctggccgcccatcgtctgggacatgaggagcccctctgcctggctgcccagtctggaaagtgaggagcgtctctgcccggccgccatcccatctaggaagtgaggagcgcctcttcccggccgccatcccatctaggaagtgaggagcgtctctgcccggccacccatcgtctgagatgtggggagcgcctctgccccgccgccccatctgggatgtgaggagcgcctctgcccagccgcgaccccgtctgggaggtgaggagcgtctctgcccggccgccccgtctgagaagtgaggagaccctccgcccggcagccgccccgtctgagaagtgaggagcccctccgcctggcagctgccctgtctgagaagaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaagggtggaaaaagctaatgaggctgcgaaaagtgagcagagctgtggaaaggctcccccaaaacattttcaccttcattttataaagcaaaataaaatgcttgaacctg

SEQ ID NO: 9613 - DNA, 370 bp, synthetic construct; identical to SEQ ID NO: 6522
  misc_feature 1..370: note = Synthetic polypeptide
  source 1..370: mol_type = other DNA

SEQ ID NO: 9614 - DNA, 1114 bp, synthetic construct
  misc_feature 1..1114: note = Synthetic polypeptide
  source 1..1114: mol_type = other DNA
tactagctaagtgaacttaaacatatttcccagtctcttcacatctcaacttcttcatctgcaaagaggagataaataaatgcatcgcacaggttatggtgaaaaatcaagataatgtagtgatggagatgggcaccaggacagcacagacaactgccccaccgtcattaacagtgcccagctggacaccgataaggatggaattggtgacgagtgtgatgatgatgatgacaatgatggtatcccagacctggtgccccctggaccagacaactgccggctggtccccaacccagcccaggaggatagcaacagcgacggagtgggagacatctgtgagtctgactttgaccaggaccaggtcatcgatcggatcgacgtctgcccagagaacgcagaggtcaccctgaccgacttcagggcttaccagaccgtggtcctggatcctgaaggggatgcccagatcgatcccaactgggtggtcctgaaccagggcatggagattgtacagaccatgaacagtgatcctggcctggcagtggggtacacagcttttaatggagttgacttcgaagggaccttccatgtgaatacccagacagatgatgactatgcaggctttatctttggctaccaagatagctccagcttctacgtggtcatgtggaagcagacggagcagacatattggcaagccaccccattccgagcagttgcagaacctggcattcagctcaaggctgtgaagtctaagacaggtccaggggagcatctccggaactccctgtggcacacgggggacaccagtgaccaggtcaggctgctgtggaaggactccaggaatgtgggctggaaggacaaggtgtcctaccgctggttcctacagcacaggccccaggtgggctacatcagggtacgattttatgaaggctctgagttggtggctgactctggcgtcaccatagacaccacaatgcgtggaggccgacttggcgttttctgcttctctcaagaaaacatcatctggtccaacctcaagtatcgctgcaatgacaccatccctgaggacttccaagagtttcaaacccagaatttcgaccgcttcgataattaa

SEQ ID NO: 9615 - DNA, 3919 bp, synthetic construct
  misc_feature 1..3919: note = Synthetic polypeptide
  source 1..3919: mol_type = other DNA
ctctccctctccctctccctctttctccctctccctctccccatggtctccctctccctctctttccacggtctccctctgatgccgagccaaagctggactgtactgccgccatctcggctcactgcaacctccctgcctgattctcctgcctcagcctgcccagtgcctgcgattgcaggcgcgcgccgccacgcctgactggttttcgtatttttttggtggagacggggtttcgctgtgttggccgggctggtctccagctcctagccgcgagtgatctgccagcctcggcatcctgaggtgccgggattgcagacggagtctggttcactcagtgctcaatggtgcccaggctggagtgcagtggcgtgatctcggctcgctacaacatccacctcccagccgcctgccttggcctcccaaagtgccgagattgcagcctctgcccggccaccaccccgtctgggaagtgaggagcgtctctgcctggccgcccatcgtctgggacatgaggagcccctctgcctggctgcccagtctggaaagtgaggagcgtctctgcccggccgccatcccatctaggaagtgaggagcgcctcttcccggccgccatcccatctaggaagtgaggagcgtctctgcccggccacccatcgtctgagatgtggggagcgcctctgccccgccgccccatctgggatgtgaggagcgcctctgcccagccgcgaccccgtctgggaggtgaggagcgtctctgcccggccgccccgtctgagaagaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagggggaaggttcctcctcattcttgtcggaaacttgccatgaggatccctctgtttcccccaactttactccccccaaccctcaagctctcaagtggtga

SEQ ID NO: 9616 - DNA, 4048 bp, synthetic construct
  misc_feature 1..4048: note = Synthetic polypeptide
  source 1..4048: mol_type = other DNA
ctctccctctccctctccctctttctccctctccctctccccatggtctccctctccctctctttccacggtctccctctgatgccgagccaaagctggactgtactgccgccatctcggctcactgcaacctccctgcctgattctcctgcctcagcctgcccagtgcctgcgattgcaggcgcgcgccgccacgcctgactggttttcgtatttttttggtggagacggggtttcgctgtgttggccgggctggtctccagctcctagccgcgagtgatctgccagcctcggcatcctgaggtgccgggattgcagacggagtctggttcactcagtgctcaatggtgcccaggctggagtgcagtggcgtgatctcggctcgctacaacatccacctcccagccgcctgccttggcctcccaaagtgccgagattgcagcctctgcccggccaccaccccgtctgggaagtgaggagcgtctctgcctggccgcccatcgtctgggacatgaggagcccctctgcctggctgcccagtctggaaagtgaggagcgtctctgcccggccgccatcccatctaggaagtgaggagcgcctcttcccggccgccatcccatctaggaagtgaggagcgtctctgcccggccacccatcgtctgagatgtggggagcgcctctgccccgccgccccatctgggatgtgaggagcgcctctgcccagccgcgaccccgtctgggaggtgaggagcgtctctgcccggccgccccgtctgagaagaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagctgcaggtggagctggagcaagaataccaagacaaattcaaaagactgcccctcgagattttggaattcgtgcaggaagccatgaaaggaaagatcagtgaagacagcaatcacggttctgcccctctctccctgtcctcagaccctggaaaagtgaaccacaagactccctccagtgaggagctgggaggagacatcccaggaaaagaatttgatactcctctgtga

SEQ ID NO: 9617 - DNA, 1097 bp, synthetic construct
  misc_feature 1..1097: note = Synthetic polypeptide
  source 1..1097: mol_type = other DNA
ctctccctctccctctccctctttctccctctccctctccccatggtctccctctccctctctttccacggtctccctctgatgccgagccaaagctggactgtactgccgccatctcggctcactgcaacctccctgcctgattctcctgcctcagcctgcccagtgcctgcgattgcaggcgcgcgccgccacgcctgactggttttcgtatttttttggtggagacggggtttcgctgtgttggccgggctggtctccagctcctagccgcgagtgatctgccagcctcggcatcctgaggtgccgggattgcagacggagtctggttcactcagtgctcaatggtgcccaggctggagtgcagtggcgtgatctcggctcgctacaacatccacctcccagccgcctgccttggcctcccaaagtgccgagattgcagcctctgcccggccaccaccccgtctgggaagtgaggagcgtctctgcctggccgcccatcgtctgggacatgaggagcccctctgcctggctgcccagtctggaaagtgaggagcgtctctgcccggccgccatcccatctaggaagtgaggagcgcctcttcccggccgccatcccatctaggaagtgaggagcgtctctgcccggccacccatcgtctgagatgtggggagcgcctctgccccgccgccccatctgggatgtgaggagcgcctctgcccagccgcgaccccgtctgggaggtgaggagcgtctctgcccggccgccccgtctgagaagaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaagggtggaaaaagctaatgaggctgcgaaaagtgagcagagctgtggaaaggctcccccaaaacattttcaccttcattttataaagcaaaataaaatgcttgaacctg

SEQ ID NO: 9618 - DNA, 1453 bp, synthetic construct; identical to SEQ ID NO: 8375
  misc_feature 1..1453: note = Synthetic polypeptide
  source 1..1453: mol_type = other DNA

SEQ ID NO: 9619 - DNA, 720 bp, synthetic construct; identical to SEQ ID NO: 7789
  misc_feature 1..720: note = Synthetic polypeptide
  source 1..720: mol_type = other DNA

SEQ ID NO: 9620 - DNA, 731 bp, synthetic construct
  misc_feature 1..731: note = Synthetic polypeptide
  source 1..731: mol_type = other DNA
cagccgcctgccttggcctcccaaagtgccgagattgcagcctctgcccggctgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagatggggacccagacacgccaaagcctgtgagcttcacagtgaaggagacagtgtgccccaggacgacacagcagtcaccagaggattgtgacttcaagaaggacgggctggtgaagcggtgtatggggacagtgaccctcaaccaggccaggggctcctttgacatcagttgtgataaggataacaagagatttgccctgctgggtgatttcttccggaaatctaaagagaagattggcaaagagtttaaaagaattgtccagagaatcaaggattttttgcggaatcttgtacccaggacagagtcctag

SEQ ID NO: 9621 - DNA, 451 bp, synthetic construct; identical to SEQ ID NO: 837
  misc_feature 1..451: note = Synthetic polypeptide
  source 1..451: mol_type = other DNA

SEQ ID NO: 9622 - DNA, 3744 bp, synthetic construct; identical to SEQ ID NO: 8524
  misc_feature 1..3744: note = Synthetic polypeptide
  source 1..3744: mol_type = other DNA

SEQ ID NO: 9623 - DNA, 864 bp, synthetic construct; identical to SEQ ID NO: 6975
  misc_feature 1..864: note = Synthetic polypeptide
  source 1..864: mol_type = other DNA

SEQ ID NO: 9624 - DNA, 471 bp, synthetic construct; identical to SEQ ID NO: 6976
  misc_feature 1..471: note = Synthetic polypeptide
  source 1..471: mol_type = other DNA

SEQ ID NO: 9625 - DNA, 367 bp, synthetic construct; identical to SEQ ID NO: 548
  misc_feature 1..367: note = Synthetic polypeptide
  source 1..367: mol_type = other DNA

SEQ ID NO: 9626 - DNA, 1157 bp, synthetic construct
  misc_feature 1..1157: note = Synthetic polypeptide
  source 1..1157: mol_type = other DNA
ctctccctctccctctccgtctccgtctccgtctccgtctccgtctccgtctccgtctccccatggtctccctctcatgcggagccgaagctggactgtactgctgccatctcggctcactgcaacctccctgcctgattctcctgcctcagtctgccgaatgcctgcgattgcaggcccgcgccgccacgcctgattggttttggtggagacggggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcactacaacctacacctcccagccgcctgccttggcctcccaaagtgccgagattgcagcctctgcccggccgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatagtctgagacgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccgtctgagaagatggggacccagacacgccaaagcctgtgagcttcacagtgaaggagacagtgtgccccaggacgacacagcagtcaccagaggattgtgacttcaagaaggacgggctggtgaagcggtgtatggggacagtgaccctcaaccaggccaggggctcctttgacatcagttgtgataaggataacaagagatttgccctgctgggtgatttcttccggaaatctaaagagaagattggcaaagagtttaaaagaattgtccagagaatcaaggattttttgcggaatcttgtacccaggacagagtcctag

SEQ ID NO: 9627 - DNA, 763 bp, synthetic construct
  misc_feature 1..763: note = Synthetic polypeptide
  source 1..763: mol_type = other DNA
ggtttggctgtgtccccacacaagtctcaacttgaattataactctcagaattcccatgtgttgtgggagggacccagtggggaggtaatttagtcatgagggccggtctttcccgtgctattctcatgatagtgaacaagtctcacgagatctgatgggtttatcaggggtttctgcttttgcatctttctctttttctcttgctactgccacataagaagtgcctttctcctcctgccatgattctgaggcctccccagccatgtggaactgcgcagtcatgcaggaaaacctcagatttgcttcatcaggagatgatattaaaatatgggatgcttcatctatgacattggtggataaattcaacccacacacatcaccacatggaatcagctcaatatgttggagcagcaataataactttttagtaacagcatcttccagtggcgacaaaatagttgtctcaagttgcaaatgtaaacctgttccacttttagagcttgctgaagggcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtag

SEQ ID NO: 9628 - DNA, 2264 bp, synthetic construct
  misc_feature 1..2264: note = Synthetic polypeptide
  source 1..2264: mol_type = other DNA
ggtttggctgtgtccccacacaagtctcaacttgaattataactctcagaattcccatgtgttgtgggagggacccagtggggaggtaatttagtcatgagggccggtctttcccgtgctattctcatgatagtgaacaagtctcacgagatctgatgggtttatcaggggtttctgcttttgcatctttctctttttctcttgctactgccacataagaagtgcctttctcctcctgccatgattctgaggcctccccagccatgtggaactgcgcagtcatgcaggaaaacctcagatttgcttcatcaggagatgatattaaaatatgggatgcttcatctatgacattggtggataaattcaacccacacacatcaccacatggaatcagctcaatatgttggagcagcaataataactttttagtaacagcatcttccagtggcgacaaaatagttgtctcaagttgcaaatgtaaacctgttccacttttagagcttgctgaagggcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtagtaaccagtctgttcggcacttgaagtactccttgtttaagaaatcactactgggcagtgtttcggataatggaatagtaactctctgggatgtaaatagtcagagtccataccataactttgacagtgtacacaaagctccagcgtcaggcatctgtttttctcctgtcaatgaattgctctttgtaaccataggcttggataaaagaatcatcctctatgacacttcaagtaagaagctagtgaaaactttagtggctgacactcctctaactgcggtagatttcatgcctgatggagccactttggctattggatcttcccgggggaaaatatatcaatatgatttaagaatgttgaaatcaccagttaagaccatcagtgctcacaagacatctgtgcagtgtatagcatttcagtactccactgttcttactaagtcaagtttaaataaaggctgttcaaataagcccacaacagtgaacaaacgaagtgttaatgtgaatgctgctagtggaggagttcagaattccggaattgtcagagaagcacctgccacgtccattgccacagttctaccacaacctatgacatcagctatggggaaaggaacagttgctgttcaagaaaaagcaggtttgcctcgaagcataaacacagacactttatctaaggaaacagacagtggaaaaaatcaggatttctccagctttgatgatactgggaaaagtagtttaggtgacatgttctcacctatcagagatgatgctgtagttaacaagggaagtgatgagtccataggcaaaggagatggctttgactttctaccgcagttgaactcagtgtttcctccaagaaaaaatccagtaacttcaagtacttcagtattgcattctagtcctcttaatgtttttatgggatctccagggaaagaggaaaatgaaaaccgtgatctaacagctgagtctaagaaaatatatatgggaaaacaggaatctaaagactccttcaaacagttagcaaagttggtcacatctggtgctgaaagtggaaatctaaatacctctccatcatctaaccaaacaagaaattctgagaaatttgaaaagccagagaatgaaattgaagcccagttgatatgtgaacccccaatcaatggatcctcaactccaaatccaaagatagcatcttctgtcactgctggagttgccagttcactctcagaaaaaatagccgacagcattggaaataaccggcaaaatgcaccattgacttccattcaaattcgttttattcagaacatgatacaggaaacgttggatgactttagagaagcatgccatagggacattgtgaatttgcaagtggagatgattaaacagtttcatatgcaactgaatgaaatgcattctttgctggaaagatactcagtgaatgaaggtttagtggctgaaattgaaagactacgagaagaaaacaaaagattacgggcccacttttga

SEQ ID NO: 9629 - DNA, 761 bp, synthetic construct; identical to SEQ ID NO: 7260
  misc_feature 1..761: note = Synthetic polypeptide
  source 1..761: mol_type = other DNA

SEQ ID NO: 9630 - DNA, 675 bp, synthetic construct; identical to SEQ ID NO: 7261
  misc_feature 1..675: note = Synthetic polypeptide
  source 1..675: mol_type = other DNA

SEQ ID NO: 9631 - DNA, 883 bp, synthetic construct
  misc_feature 1..883: note = Synthetic polypeptide
  source 1..883: mol_type = other DNA
catgcctttgctgctgtccttggtcagaatgactcatcattcgtgtaattcttgctacttgctcaatccagttcaaatgctgctccttctcagaagccttccctgttctctccctccctgcacagataattgttttttctggctctggcccttcatcactctgctgttgcaccttctgcagtgtctgtgttctgatcagactgtgggctactggaatgcaggcaccagcttgagtcatcctttttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctga

SEQ ID NO: 9632 - DNA, 3347 bp, synthetic construct
  misc_feature 1..3347: note = Synthetic polypeptide
  source 1..3347: mol_type = other DNA
aggcggtcatgtggcagatgaaatgctgcaagtgtgactccaggcagcctcacaactactacagtcaccgagtagagaatgtggcttcatcctccggccccatgcgctggtggcagtcacagaatgatgtgaaccctgtctctctgcagctggacctggacaggagattccagcttcaagaagtcatgatggagttccaggggcccatgcccgccggcatgctgattgagcgctcctcagacttcggtaagacctggcgagtgtaccagtacctggctgccgactgcacctccaccttccctcgggtccgccagggtcggcctcagagctggcaggatgttcggtgccagtccctgcctcagaggcctaatgcacgcctaaatggggggaaggtccaacttaaccttatggatttagtgtctgggattccagcaactcaaagtcaaaaaattcaagaggtgggggagatcacaaacttgagagtcaatttcaccaggctggcccctgtgccccaaaggggctaccaccctcccagcgcctactatgctgtgtcccagctccgtctgcaggggagctgcttctgtcacggccatgctgatcgctgcgcacccaagcctggggcctctgcaggcccctccaccgctgtgcaggtccacgatgtctgtgtctgccagcacaacactgccggcccaaattgtgagcgctgtgcacccttctacaacaaccggccctggagaccggcggagggccaggacgcccatgaatgccaaaggtgcgactgcaatgggcactcagagacatgtcactttgaccccgctgtgtttgccgccagccagggggcatatggaggtgtgtgtgacaattgccgggaccacaccgaaggcaagaactgtgagcggtgtcagctgcactatttccggaaccggcgcccgggagcttccattcaggagacctgcatctcctgcgagtgtgatccggatggggcagtgccaggggctccctgtgacccagtgaccgggcagtgtgtgtgcaaggagcatgtgcagggagagcgctgtgacctatgcaagccgggcttcactggactcacctacgccaacccgcagggctgccaccgctgtgactgcaacatcctggggtcccggagggacatgccgtgtgacgaggagagtgggcgctgcctttgtctgcccaacgtggtgggtcccaaatgtgaccagtgtgctccctaccactggaagctggccagtggccagggctgtgaaccgtgtgcctgcgacccgcacaactccctcagcccacagtgcaaccagttcacagggcagtgcccctgtcgggaaggctttggtggcctgatgtgcagcgctgcagccatccgccagtgtccagaccggacctatggagacgtggccacaggatgccgagcctgtgactgtgatttccggggaacagagggcccgggctgcgacaaggcatcaggccgctgcctctgccgccctggcttgaccgggccccgctgtgaccagtgccagcgaggctactgtaatcgctacccggtgtgcgtggcctgccacccttgcttccagacctatgatgcggacctccgggagcaggccctgcgctttggtagactccgcaatgccaccgccagcctgtggtcagggcctgggctggaggaccgtggcctggcctcccggatcctagatgcaaagagtaagattgagcagatccgagcagttctcagcagccccgcagtcacagagcaggaggtggctcaggtggccagtgccatcctctccctcaggcgaactctccagggcctgcagctggatctgcccctggaggaggagacgttgtcccttccgagagacctggagagtcttgacagaagcttcaatggtctccttactatgtatcagaggaagagggagcagtttgaaaaaataagcagtgctgatccttcaggagccttccggatgctgagcacagcctacgagcagtcagcccaggctgctcagcaggtctccgacagctcgcgccttttggaccagctcagggacagccggagagaggcagagaggctggtgcggcaggcgggaggaggaggaggcaccggcagccccaagcttgtggccctgaggctggagatgtcttcgttgcctgacctgacacccaccttcaacaagctctgtggcaactccaggcagatggcttgcaccccaatatcatgccctggtgagctatgtccccaagacaatggcacagcctgtggctcccgctgcaggggtgtccttcccagggccggtggggccttcttgatggcggggcaggtggctgagcagctgcggggcttcaatgcccagctccagcggaccaggcagatgattagggcagccgaggaatctgcctcacagattcaatccagtgcccagcgcttggagacccaggtgagcgccagccgctcccagatggaggaagatgtcagacgcacacggctcctaatccagcaggtccgggacttcctaacagaccccgacactgatgcagccactatccaggaggtcagcgaggccgtgctggccctgtggctgcccacagactcagctactgttctgcagaagatgaatgagatccaggccattgcagccaggctccccaacgtggacttggtgctgtcccagaccaagcaggacattgcgcgtgcccgccggttgcaggctgaggctgaggaagccaggagccgagcccatgcagtggagggccaggtggaagatgtggttgggaacctgcggcaggggacagtggcactgcaggaagctcaggacaccatgcaaggcaccagccgctcccttcggcttatccaggacagggttgctgaggttcagcaggtactgcggccagcagaaaagctggtgacaagcatgaccaagcagctgggtgacttctggacacggatggaggagctccgccaccaagcccggcagcagggggcagaggcagtccaggcccagcagcttgcggaaggtgccagcgagcaggcattgagtgcccaagagggatttgagagaataaaacaaaagtatgctgagttgaaggaccggttgggtcagagttccatgctgggtgagcagggtgcccggatccagagtgtgaagacagaggcagaggagctgtttggggagaccatggagatgatggacaggatgaaagacatggagttggagctgctgcggggcagccaggccatcatgctgcgctcagcggacctgacaggactggagaagcgtgtggagcagatccgtgaccacatcaatgggcgcgtgctctactatgccacctgcaagtga

SEQ ID NO: 9633 - DNA, 392 bp, synthetic construct
  misc_feature 1..392: note = Synthetic polypeptide
  source 1..392: mol_type = other DNA
aggcggtcatgtggcagatgaaatgctgcaagtgtgactccaggcagcctcacaactactacagtcaccgagtagagaatgtggcttcatcctccggccccatgcgctggtggcagtcacagaatgatgtgaaccctgtctctctgcagctggacctggacaggagattccagcttcaagaagtcatgatggagttccaggggcccatgcccgccggcatgctgattgagcgctcctcagacttcggtaagacctggcgagtgtaccagtacctggctgccgactgcacctccaccttccctcgggtccgccagggtcggcctcagagctggcaggatgttcggtgccagtccctgcctcagaggcctaatgcacgcctaaatggggggaag

SEQ ID NO: 9634 - DNA, 3140 bp, synthetic construct
  misc_feature 1..3140: note = Synthetic polypeptide
  source 1..3140: mol_type = other DNA
tttggtgccatgactcggatcgggggacctcccttgggagatcaatcccctgttctcctgctctttgctccgtgagaaagatccacctatgacctcaggtcctcagaccgaccagcccaagaaatatctcaccaatttcaaatctggtaagcggcctctttttacactcttctccaacctccctcactatccctcaacctctttctcctttcaatcttggcgccacacttcaatctctcccttctcttaatttcaattcctttcattttctggtagagacaaaggagacacgttttatccgtggacccaaaactccggcgccggtcacagactgggaaggcagccttcccttggtgtttaatcaatgcagggaagcctctctgattattcacccatgtttcaagggtgtcagaccacgcagggatgcctgccttggtccttcacccttagcggcaagacctgcttttctggggaaggggcaagtactccaaccccttctctccttgtctctaccccttctctgcttttctggggaaagggcaagtaccccaaccccttctctccttgtctctaccccttctctgcttttctggggaaagggcaagtaccccaaccccttctctccttgtctctaccccttctctgcttttctgggggaggagcaagtacccctcaaccccttctccttcacccttagcagcaagtcccacttttctagggggcaagaacccccaattccttatttccacaccccgacctcttatctctgtgccccaatcccttatttcctcacccctacctcttatctctgtgccccaatcctttatttccacaccccgacctcttatctctgtgccccaatcccttatttccgcaccccatcctcttatctctgtgccccaatcccttatttccatgccccgaccccccttcccgcttttctggagggtaagaacccccgaaccccttccctccgtgtctctatgctctcttttctctaggtttgcctccttcactatgggcaaccttccaccctccattcctcctccttctccctcagcctgtgttctcaagaacttaaaacctcttcaactcacacctgacctaaaacccaaatgccttattttcttctgcaatgctgcttgaccccaatacaaactagacagtagttccaaatagccagaaaacggcactttcaatttttccatcctacaagatctaaatatttcttgttgtaaaatgagcaaatggtctgaggtgcctgacgtccaggcattcttttacacatcagtcccttcctagtctctgtgcccagtgcaactcgtcccaaatcttccttctttccctcccgcctgtcgcctcagtcccaaccccaagcgttgctgagtctttctaatcttccttttctacagacctatctgacctctcccctcctcgccaggccaagctaggtcccaattcttcctcagcctctgctcctccaccctataatctttttattgcctcccctcctcacacctggtccggcttacagtttcgttcggtgactagccctcccccacctgcccagcaatttactcttaaaaaggtggctggagccaaaggcatagtcaaggttaatgctcctttttgtttatcccaaatcagatagtgtttaggctctttttcatcaaatataaaaacccagcccagttcatgactcgtttggcagcaaccctgagatgctttacagccctagaccctaaaaggtcaaaaggccgtcttattctcaatatacattttattacccaatctgctcccgacattaaataaaactccaaaaattggaatctggccctcaaaccccacaacaggacttaattaacctcaccttcaaggtgtacaataacagaaaaaagttgcaattccttgcctccactgtgagacaaaccccagccacatctccagcacacaagaacttccaaatgcctgaaccgcagcggccaggcgttcctccagaacctcctcccccaggagcttgctacaagtgccagaaatctgaccaccaggccaaggaatgcctgcagcccaggatttctcctaagccacgtcccatctctgcgggaccccactagaaatcggactgttcaactcacctggcagccactcccatagcttctggaactctggcccaaggctctctgactccttcccagatcttcttggcttagcggctgaagactgatgctgcctaattgcctcggaaacaccgtagaccatcacggacgccgagcttcaggtgcgttgtagaagacaagaactcaaaggtggcctggttgaaccgttctggcatcatttttgctggacatgacaagtggtctctggacccacgggttgagctggagaaacgccattctctggaatacagcctccgaatccagaaggtggatgtctatgatgagggttcctacacttgctcagttcagacacagcatgagcccaagacctcccaagtttacttgatcgtacaagtcccaccaaagatctccaatatctcctcggatgtcactgtgaatgagggcagcaacgtgactctggtctgcatggccaatggccgtcctgaacctgttatcacctggagacaccttacaccaactggaagggaatttgaaggagaagaagaatatctggagatccttggcatcaccagggagcagtcaggcaaatatgagtgcaaagctgccaacgaggtctcctcggcggatgtcaaacaagtcaaggtcactgtgaactatcctcccactatcacagaatccaagagcaatgaagccaccacaggacgacaagcttcactcaaatgtgaggcctcggcagtgcctgcacctgactttgagtggtaccgggatgacactaggataaatagtgccaatggccttgagattaagagcacggagggccagtcttccctgacggtgaccaacgtcactgaggagcactacggcaactacacctgtgtggctgccaacaagctgggggtcaccaatgccagcctagtccttttcagacctgggtcggtgagaggaataaatggatccatcagtctggccgtaccactgtggctgctggcagcatctctgctctgccttctcagcaaatgttaa

SEQ ID NO: 9635 - DNA, 3209 bp, synthetic construct
  misc_feature 1..3209: note = Synthetic polypeptide
  source 1..3209: mol_type = other DNA
tttggtgccatgactcggatcgggggacctcccttgggagatcaatcccctgttctcctgctctttgctccgtgagaaagatccacctatgacctcaggtcctcagaccgaccagcccaagaaatatctcaccaatttcaaatctggtaagcggcctctttttacactcttctccaacctccctcactatccctcaacctctttctcctttcaatcttggcgccacacttcaatctctcccttctcttaatttcaattcctttcattttctggtagagacaaaggagacacgttttatccgtggacccaaaactccggcgccggtcacagactgggaaggcagccttcccttggtgtttaatcaatgcagggaagcctctctgattattcacccatgtttcaagggtgtcagaccacgcagggatgcctgccttggtccttcacccttagcggcaagacctgcttttctggggaaggggcaagtactccaaccccttctctccttgtctctaccccttctctgcttttctggggaaagggcaagtaccccaaccccttctctccttgtctctaccccttctctgcttttctggggaaagggcaagtaccccaaccccttctctccttgtctctaccccttctctgcttttctgggggaggagcaagtacccctcaaccccttctccttcacccttagcagcaagtcccacttttctagggggcaagaacccccaattccttatttccacaccccgacctcttatctctgtgccccaatcccttatttcctcacccctacctcttatctctgtgccccaatcctttatttccacaccccgacctcttatctctgtgccccaatcccttatttccgcaccccatcctcttatctctgtgccccaatcccttatttccatgccccgaccccccttcccgcttttctggagggtaagaacccccgaaccccttccctccgtgtctctatgctctcttttctctaggtttgcctccttcactatgggcaaccttccaccctccattcctcctccttctccctcagcctgtgttctcaagaacttaaaacctcttcaactcacacctgacctaaaacccaaatgccttattttcttctgcaatgctgcttgaccccaatacaaactagacagtagttccaaatagccagaaaacggcactttcaatttttccatcctacaagatctaaatatttcttgttgtaaaatgagcaaatggtctgaggtgcctgacgtccaggcattcttttacacatcagtcccttcctagtctctgtgcccagtgcaactcgtcccaaatcttccttctttccctcccgcctgtcgcctcagtcccaaccccaagcgttgctgagtctttctaatcttccttttctacagacctatctgacctctcccctcctcgccaggccaagctaggtcccaattcttcctcagcctctgctcctccaccctataatctttttattgcctcccctcctcacacctggtccggcttacagtttcgttcggtgactagccctcccccacctgcccagcaatttactcttaaaaaggtggctggagccaaaggcatagtcaaggttaatgctcctttttgtttatcccaaatcagatagtgtttaggctctttttcatcaaatataaaaacccagcccagttcatgactcgtttggcagcaaccctgagatgctttacagccctagaccctaaaaggtcaaaaggccgtcttattctcaatatacattttattacccaatctgctcccgacattaaataaaactccaaaaattggaatctggccctcaaaccccacaacaggacttaattaacctcaccttcaaggtgtacaataacagaaaaaagttgcaattccttgcctccactgtgagacaaaccccagccacatctccagcacacaagaacttccaaatgcctgaaccgcagcggccaggcgttcctccagaacctcctcccccaggagcttgctacaagtgccagaaatctgaccaccaggccaaggaatgcctgcagcccaggatttctcctaagccacgtcccatctctgcgggaccccactagaaatcggactgttcaactcacctggcagccactcccatagcttctggaactctggcccaaggctctctgactccttcccagatcttcttggcttagcggctgaagactgatgctgcctaattgcctcggaaacaccgtagaccatcacggacgccgagcttcaggtgcgttgtagaagacaagaactcaaaggtggcctggttgaaccgttctggcatcatttttgctggacatgacaagtggtctctggacccacgggttgagctggagaaacgccattctctggaatacagcctccgaatccagaaggtggatgtctatgatgagggttcctacacttgctcagttcagacacagcatgagcccaagacctcccaagtttacttgatcgtacaagtcccaccaaagatctccaatatctcctcggatgtcactgtgaatgagggcagcaacgtgactctggtctgcatggccaatggccgtcctgaacctgttatcacctggagacaccttacaccaactggaagggaatttgaaggagaagaagaatatctggagatccttggcatcaccagggagcagtcaggcaaatatgagtgcaaagctgccaacgaggtctcctcggcggatgtcaaacaagtcaaggtcactgtgaactatcctcccactatcacagaatccaagagcaatgaagccaccacaggacgacaagcttcactcaaatgtgaggcctcggcagtgcctgcacctgactttgagtggtaccgggatgacactaggataaatagtgccaatggccttgagattaagagcacggagggccagtcttccctgacggtgaccaacgtcactgaggagcactacggcaactacacctgtgtggctgccaacaagctgggggtcaccaatgccagcctagtccttttcaaacgtgttttacccacaatcccccaccccattcaagaaattggtaccaccgtgcacttcaagcaaaaaggacctgggtcggtgagaggaataaatggatccatcagtctggccgtaccactgtggctgctggcagcatctctgctctgccttctcagcaaatgttaa

SEQ ID NO: 9636 - DNA, 2637 bp, synthetic construct
  misc_feature 1..2637: note = Synthetic polypeptide
  source 1..2637: mol_type = other DNA
tttggtgccatgactcggatcgggggacctcccttgggagatcaatcccctgttctcctgctctttgctccgtgagaaagatccacctatgacctcaggtcctcagaccgaccagcccaagaaatatctcaccaatttcaaatctggtaagcggcctctttttacactcttctccaacctccctcactatccctcaacctctttctcctttcaatcttggcgccacacttcaatctctcccttctcttaatttcaattcctttcattttctggtagagacaaaggagacacgttttatccgtggacccaaaactccggcgccggtcacagactgggaaggcagccttcccttggtgtttaatcaatgcagggaagcctctctgattattcacccatgtttcaagggtgtcagaccacgcagggatgcctgccttggtccttcacccttagcggcaagacctgcttttctggggaaggggcaagtactccaaccccttctctccttgtctctaccccttctctgcttttctggggaaagggcaagtaccccaaccccttctctccttgtctctaccccttctctgcttttctggggaaagggcaagtaccccaaccccttctctccttgtctctaccccttctctgcttttctgggggaggagcaagtacccctcaaccccttctccttcacccttagcagcaagtcccacttttctagggggcaagaacccccaattccttatttccacaccccgacctcttatctctgtgccccaatcccttatttcctcacccctacctcttatctctgtgccccaatcctttatttccacaccccgacctcttatctctgtgccccaatcccttatttccgcaccccatcctcttatctctgtgccccaatcccttatttccatgccccgaccccccttcccgcttttctggagggtaagaacccccgaaccccttccctccgtgtctctatgctctcttttctctaggtttgcctccttcactatgggcaaccttccaccctccattcctcctccttctccctcagcctgtgttctcaagaacttaaaacctcttcaactcacacctgacctaaaacccaaatgccttattttcttctgcaatgctgcttgaccccaatacaaactagacagtagttccaaatagccagaaaacggcactttcaatttttccatcctacaagatctaaatatttcttgttgtaaaatgagcaaatggtctgaggtgcctgacgtccaggcattcttttacacatcagtcccttcctagtctctgtgcccagtgcaactcgtcccaaatcttccttctttccctcccgcctgtcgcctcagtcccaaccccaagcgttgctgagtctttctaatcttccttttctacagacctatctgacctctcccctcctcgccaggccaagctaggtcccaattcttcctcagcctctgctcctccaccctataatctttttattgcctcccctcctcacacctggtccggcttacagtttcgttcggtgactagccctcccccacctgcccagcaatttactcttaaaaaggtggctggagccaaaggcatagtcaaggttaatgctcctttttgtttatcccaaatcagatagtgtttaggctctttttcatcaaatataaaaacccagcccagttcatgactcgtttggcagcaaccctgagatgctttacagccctagaccctaaaaggtcaaaaggccgtcttattctcaatatacattttattacccaatctgctcccgacattaaataaaactccaaaaattggaatctggccctcaaaccccacaacaggacttaattaacctcaccttcaaggtgtacaataacagaaaaaagttgcaattccttgcctccactgtgagacaaaccccagccacatctccagcacacaagaacttccaaatgcctgaaccgcagcggccaggcgttcctccagaacctcctcccccaggagcttgctacaagtgccagaaatctgaccaccaggccaaggaatgcctgcagcccaggatttctcctaagccacgtcccatctctgcgggaccccactagaaatcggactgttcaactcacctggcagccactcccatagcttctggaactctggcccaaggctctctgactccttcccagatcttcttggcttagcggctgaagactgatgctgcctaattgcctcggaaacaccgtagaccatcacggacgccgagcttcaggtgcgttgtagaagacaagaactcaaaggtggcctggttgaaccgttctggcatcatttttgctggacatgacaagtggtctctggacccacgggttgagctggagaaacgccattctctggaatacagcctccgaatccagaaggtggatgtctatgatgagggttcctacacttgctcagttcagacacagcatgagcccaagacctcccaagtttacttgatcgtacaagtcccaccaaagatctccaatatctcctcggatgtcactgtgaatgagggcagcaacgtgactctggtctgcatggccaatggccgtcctgaacctgttatcacctggagacaccttacaccaactg

SEQ ID NO: 9637 - DNA, 952 bp, synthetic construct; identical to SEQ ID NO: 8583
  misc_feature 1..952: note = Synthetic polypeptide
  source 1..952: mol_type = other DNA

SEQ ID NO: 9638 - DNA, 87 bp, synthetic construct; identical to SEQ ID NO: 8584
  misc_feature 1..87: note = Synthetic polypeptide
  source 1..87: mol_type = other DNA

SEQ ID NO: 9639 - DNA, 2513 bp, synthetic construct
  misc_feature 1..2513: note = Synthetic polypeptide
  source 1..2513: mol_type = other DNA
ggatcctgatgcttatcaaatccaggctccttccttgaatgtgtgacctttggccagagattgagaatttatcacaagttgatggtcctcaagtggaagagcaacttctttcaaccacagttcagccaaatctggagaaggaggtctggggcatggagaataactcatcagaatcatcttttgcagattcttctgtagtttcagaatcagacacaagtttggcagaaggaagtgtcagctgcttagatgaaagtcttggacataacagcaacatgggcagtgattcaggcaccatgggaagtgattcagatgaagagaatgtggcagcaagagcatccccggagccagaactccagctcaggccttaccaaatggaagttgcccagccagccttggaagggaagaatatcatcatctgcctccctacagggagtggaaaaaccagagtggctgtttacattgccaaggatcacttagacaagaagaaaaaagcatctgagcctggaaaagttatagttcttgtcaataaggtactgctagttgaacagctcttccgcaaggagttccaaccatttttgaagaaatggtatcgtgttattggattaagtggtgatacccaactgaaaatatcatttccagaagttgtcaagtcctgtgatattattatcagtacagctcaaatccttgaaaactccctcttaaacttggaaaatggagaagatgctggtgttcaattgtcagacttttccctcattatcattgatgaatgtcatcacaccaacaaagaagcagtgtataataacatcatgaggcattatttgatgcagaagttgaaaaacaatagactcaagaaagaaaacaaaccagtgattccccttcctcagatactgggactaacagcttcacctggtgttggaggggccacgaagcaagccaaagctgaagaacacattttaaaactatgtgccaatcttgatgcatttactattaaaactgttaaagaaaaccttgatcaactgaaaaaccaaatacaggagccatgcaagaagtttgccattgcagatgcaaccagagaagatccatttaaagagaaacttctagaaataatgacaaggattcaaacttattgtcaaatgagtccaatgtcagattttggaactcaaccctatgaacaatgggccattcaaatggaaaaaaaagctgcaaaagaaggaaatcgcaaagaacgtgtttgtgcagaacatttgaggaagtacaatgaggccctacaaattaatgacacaattcgaatgatagatgcgtatactcatcttgaaactttctataatgaagagaaagataagaagtttgcagtcatagaagatgatagtgatgagggtggtgatgatgagtattgtgatggtgatgaagatgaggatgatttaaagaaacctttgaaactggatgaaacagatagatttctcatgactttattttttgaaaacaataaaatgttgaaaaggctggctgaaaacccagaatatgaaaatgaaaagctgaccaaattaagaaataccataatggagcaatatactaggactgaggaatcagcacgaggaataatctttacaaaaacacgacagagtgcatatgcgctttcccagtggattactgaaaatgaaaaatttgctgaagtaggagtcaaagcccaccatctgattggagctggacacagcagtgagttcaaacccatgacacagaatgaacaaaaagaagtcattagtaaatttcgcactggaaaaataaatctgcttatcgctaccacagtggcagaagaaggtctggatattaaagaatgtaacattgttatccgttatggtctcgtcaccaatgaaatagccatggtccaggcccgtggtcgagccagagctgatgagagcacctacgtcctggttgctcacagtggttcaggagttatcgaacatgagacagttaatgatttccgagagaagatgatgtataaagctatacattgtgttcaaaatatgaaaccagaggagtatgctcataagattttggaattacagatgcaaagtataatggaaaagaaaatgaaaaccaagagaaatattgccaagcattacaagaataacccatcactaataactttcctttgcaaaaactgcagtgtgctagcctgttctggggaagatatccatgtaattgagaaaatgcatcacgtcaatatgaccccagaattcaaggaactttacattgtaagagaaaacaaagcactgcaaaagaagtgtgccgactatcaaataaatggtgaaatcatctgcaaatgtggccaggcttggggaacaatgatggtgcacaaaggcttagatttgccttgtctcaaaataaggaattttgtagtggttttcaaaaataattcaacaaagaaacaatacaaaaagtgggtagaattacctatcacatttcccaatcttgactattcagaatgctgtttatttagtgatgaggattag

SEQ ID NO: 9640 - DNA, 1181 bp, synthetic construct
  misc_feature 1..1181: note = Synthetic polypeptide
  source 1..1181: mol_type = other DNA
tcatacacctaaatgtaaaatgtctagagaaaacataaaaatctttgtgatcttgagttaggcatatttcttgaatacaactcagaaataaatccatgaaataaatttgtcaaaatgtaaaactttcccaaaaacaataagaaaatgaaaaaagccatagactggtaaaaattctttgcaacatacataacttacaaatgacaagtatccataatacacccaaaactcaagaaaaaccagtttttaaaaaattgacaagaaatctgaactaattaatttatcaaagatgataacatgaatggcaaagaaatacatgaaaagatgctcacttcatttattatttagggggatgcaaattaaaaaccacaataaattgtcactacatacctgttagcataaattttaaaagttaacaatgccaaatgctgatgaagattcagaacagtagaactcctatacacttaagacctagcattcccactcctaggtatttactaagagaaataagaacttatgttcataccaaaacttatatgtaaatgtttataggaattttacttgcagttacctaaaattgtaaacaactgctcttcaacaagaggataaatttacagtacatccacataatggaataccattcagcattaacaaggaatgagctattgatatgcacaacaccgggccggatcgagctgggagatgtgacaccacacaatattaaacagttgaaaagattgaatcaggtcatctttccagtcagctacaatgacaagttctacaaggatgtgctggaggttggcgagctagcaaaacttgcctatttcaatgatattgctgtaggtgcagtatgctgtagggtggatcattcacagaatcagaagagactttacatcatgacactaggatgtctggcaccttaccgaaggctaggaataggaactaaaatgttaaatcatgtcttaaacatctgtgaaaaagatggtacttttgacaacatttatctgcatgtccagatcagcaatgagtcggcaattgacttctacaggaagtttggctttgagattattgagacaaagaagaactactataagaggatagagcccgcagatgctcatgtgctgcagaaaaacctcaaagttccttctggtcagaatgcagatgtgcaaaagacagacaactga

SEQ ID NO: 9641 - DNA, 1061 bp, synthetic construct
  misc_feature 1..1061: note = Synthetic polypeptide
  source 1..1061: mol_type = other DNA
tcatacacctaaatgtaaaatgtctagagaaaacataaaaatctttgtgatcttgagttaggcatatttcttgaatacaactcagaaataaatccatgaaataaatttgtcaaaatgtaaaactttcccaaaaacaataagaaaatgaaaaaagccatagactggtaaaaattctttgcaacatacataacttacaaatgacaagtatccataatacacccaaaactcaagaaaaaccagtttttaaaaaattgacaagaaatctgaactaattaatttatcaaagatgataacatgaatggcaaagaaatacatgaaaagatgctcacttcatttattatttagggggatgcaaattaaaaaccacaataaattgtcactacatacctgttagcataaattttaaaagttaacaatgccaaatgctgatgaagattcagaacagtagaactcctatacacttaagacctagcattcccactcctaggtatttactaagagaaataagaacttatgttcataccaaaacttatatgtaaatgtttataggaattttacttgcagttacctaaaattgtaaacaactgctcttcaacaagaggataaatttacagtacatccacataatggaataccattcagcattaacaaggaatgagctattgatatgcacaacaccgggccggatcgagctgggagatgtgacaccacacaatattaaacagttgaaaagattgaatcaggtcatctttccagtcagctacaatgacaagttctacaaggatgtgctggaggttggcgagctagcaaaacttggaactaaaatgttaaatcatgtcttaaacatctgtgaaaaagatggtacttttgacaacatttatctgcatgtccagatcagcaatgagtcggcaattgacttctacaggaagtttggctttgagattattgagacaaagaagaactactataagaggatagagcccgcagatgctcatgtgctgcagaaaaacctcaaagttccttctggtcagaatgcagatgtgcaaaagacagacaactga

SEQ ID NO: 9642 - DNA, 851 bp, synthetic construct
  misc_feature 1..851: note = Synthetic polypeptide
  source 1..851: mol_type = other DNA
tcatacacctaaatgtaaaatgtctagagaaaacataaaaatctttgtgatcttgagttaggcatatttcttgaatacaactcagaaataaatccatgaaataaatttgtcaaaatgtaaaactttcccaaaaacaataagaaaatgaaaaaagccatagactggtaaaaattctttgcaacatacataacttacaaatgacaagtatccataatacacccaaaactcaagaaaaaccagtttttaaaaaattgacaagaaatctgaactaattaatttatcaaagatgataacatgaatggcaaagaaatacatgaaaagatgctcacttcatttattatttagggggatgcaaattaaaaaccacaataaattgtcactacatacctgttagcataaattttaaaagttaacaatgccaaatgctgatgaagattcagaacagtagaactcctatacacttaagacctagcattcccactcctaggtatttactaagagaaataagaacttatgttcataccaaaacttatatgtaaatgtttataggaattttacttgcagttacctaaaattgtaaacaactgctcttcaacaagaggataaatttacagtacatccacataatggaataccattcagcattaacaaggaatgagctattgatatgcacaacaccgggccggatcgagctgggagatgtgacaccacacaatattaaacagttgaaaagattgaatcaggtcatctttccagtcagctacaatgacaagttctacaaggatgtgctggagaaaaacctcaaagttccttctggtcagaatgcagatgtgcaaaagacagacaactga

SEQ ID NO: 9643 - DNA, 818 bp, synthetic construct
  misc_feature 1..818: note = Synthetic polypeptide
  source 1..818: mol_type = other DNA
tcatacacctaaatgtaaaatgtctagagaaaacataaaaatctttgtgatcttgagttaggcatatttcttgaatacaactcagaaataaatccatgaaataaatttgtcaaaatgtaaaactttcccaaaaacaataagaaaatgaaaaaagccatagactggtaaaaattctttgcaacatacataacttacaaatgacaagtatccataatacacccaaaactcaagaaaaaccagtttttaaaaaattgacaagaaatctgaactaattaatttatcaaagatgataacatgaatggcaaagaaatacatgaaaagatgctcacttcatttattatttagggggatgcaaattaaaaaccacaataaattgtcactacatacctgttagcataaattttaaaagttaacaatgccaaatgctgatgaagattcagaacagtagaactcctatacacttaagacctagcattcccactcctaggtatttactaagagaaataagaacttatgttcataccaaaacttatatgtaaatgtttataggaattttacttgcagttacctaaaattgtaaacaactgctcttcaacaagaggataaatttacagtacatccacataatggaataccattcagcattaacaaggaatgagctattgatatgcacaacaccgggccggatcgagctgggagatgtgacaccacacaatattaaacagttgaaaagattgaatcaggtcatctttccagtcagctacaatgacaagttctacaaggatgtgctggagcctatttcaatgatattgctgtag

SEQ ID NO: 9644 - DNA, 847 bp, synthetic construct
  misc_feature 1..847: note = Synthetic polypeptide
  source 1..847: mol_type = other DNA
tcatacacctaaatgtaaaatgtctagagaaaacataaaaatctttgtgatcttgagttaggcatatttcttgaatacaactcagaaataaatccatgaaataaatttgtcaaaatgtaaaactttcccaaaaacaataagaaaatgaaaaaagccatagactggtaaaaattctttgcaacatacataacttacaaatgacaagtatccataatacacccaaaactcaagaaaaaccagtttttaaaaaattgacaagaaatctgaactaattaatttatcaaagatgataacatgaatggcaaagaaatacatgaaaagatgctcacttcatttattatttagggggatgcaaattaaaaaccacaataaattgtcactacatacctgttagcataaattttaaaagttaacaatgccaaatgctgatgaagattcagaacagtagaactcctatacacttaagacctagcattcccactcctaggtatttactaagagaaataagaacttatgttcataccaaaacttatatgtaaatgtttataggaattttacttgcagttacctaaaattgtaaacaactgctcttcaacaagaggataaatttacagtacatccacataatggaataccattcagcattaacaaggaatgagctattgatatgcacaacaccgggccggatcgagctgggagatgtgacaccacacaatattaaacagttgaaaagattgaatcaggtcatctttccagtcagctacaatgacaagttctacaaggatgtgctggaggttggcgagctagcaaaacttggtgcagtatgctgtagggtggatcattcaca

SEQ ID NO: 9645 - DNA, 785 bp, synthetic construct; identical to SEQ ID NO: 6642
  misc_feature 1..785: note = Synthetic polypeptide
  source 1..785: mol_type = other DNA

SEQ ID NO: 9646 - DNA, 440 bp, synthetic construct; identical to SEQ ID NO: 6643
  misc_feature 1..440: note = Synthetic polypeptide
  source 1..440: mol_type = other DNA

SEQ ID NO: 9647 - DNA, 312 bp, synthetic construct
  misc_feature 1..312: note = Synthetic polypeptide
  source 1..312: mol_type = other DNA
gaagagaggagggaataagacatagccagagagctgaatgccaagaaaattgagtttgaacaatttctgcctatgatgcaagccatttccaacaacaaggaccaggccacctatgaagactttgttgagggtctgcgtgtctttgacaaggaaggcaatggcacagtcatgggtgctgaactccgccatgttctagccaccctgggtgaaaagatgaaagaggaagaagtggaagccctgatggcaggtcaagaagactccaatggctgcatcaactacgaagcttttgtcaagcacatcatgtctatctga

SEQ ID NO: 9648 - DNA, 557 bp, synthetic construct; identical to SEQ ID NO: 7108
  misc_feature 1..557: note = Synthetic polypeptide
  source 1..557: mol_type = other DNA

SEQ ID NO: 9649 - DNA, 599 bp, synthetic construct
  misc_feature 1..599: note = Synthetic polypeptide
  source 1..599: mol_type = other DNA
gttctcaaaatatggttaagggacccctgaggattaccaagatcctttcatgaagtttttgagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaa

SEQ ID NO: 9650 - DNA, 686 bp, synthetic construct
  misc_feature 1..686: note = Synthetic polypeptide
  source 1..686: mol_type = other DNA
gttctcaaaatatggttaagggacccctgaggattaccaagatcctttcatgaagtttttgagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaatttctattgctccaccccctccccctatgcctcagttgactccacagatacctctcacaggcttcgtggccagggtgcaggaaaacattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaa

SEQ ID NO: 9651 - DNA, 375 bp, synthetic construct
  misc_feature 1..375: note = Synthetic polypeptide
  source 1..375: mol_type = other DNA
cttccaggaagagtcccatgcctattccacagctgggagccctccccagggtgcctctcttccccctgcccaccgtctgcggtgaaggccctggtcaatttcaactcgactgagttttatttattcactctcctctccccctggactgtgagccacccggggcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctga

SEQ ID NO: 9652 - DNA, 618 bp, synthetic construct
  misc_feature 1..618: note = Synthetic polypeptide
  source 1..618: mol_type = other DNA
cccccgcccggccagccgccccgtccgggagggaggtgggggggtcagccccccgcccggccagccaccccgtccggggggtgaggggcgcctctgcccggccgcccctactgggaagtgaggaacccctctgcccggccagccgccccgtccgggagggaggtgggggggtcagccccccgcccggccagccgccttgtccaggagggaggtgggggggtcagccccccgcccggccagccgccccgtccgggaggtgaggggcacctctgcccggccgcccctactaggaagtgaggcgccccgctgcccggccagccgctccgtccgggagggaggtgggggggtcagccccctgcccgtccagccgccccgtccgggaggtgaggggcgcctctgcccggccgcccctactgggaagtgaggagcccctctgcccggccaccaccccgtctgggagggagaagtgaattcaaacggtgctggaagggtcaaggggcctgccaaacttactgcacaaggcaagaaacttacatgcacctgtgcccggatgcgtccctgtgctgtctctcctatgcattgaaacctccaccggtccccaagcatgaatatgagtag

SEQ ID NO: 9653 - DNA, 659 bp, synthetic construct
  misc_feature 1..659: note = Synthetic polypeptide
  source 1..659: mol_type = other DNA
tgtggaggaaggatcatggagtttggaattaaagcccagttgtactacttcccagctatgtaagcttggctctttggcctatagcagctgtggaaatttatacctcccgggtgctggaggctgttaatgggacagatgctcggttaaaatgcactttctccagctttgcccctgtgggtgatgctctaacagtgacctggaattttcgtcctctagacgggggacctgagcagtttgtattctactaccacatagatcccttccaacccatgagtgggcggtttaaggaccgggtgtcttgggatgggaatcctgagcggtacgatgcctccatccttctctggaaactgcagttcgacgacaatgggacatacacctgccaggtgaagaacccacctgatgttgatggggtgataggggagatccggctcagcgtcgtgcacactgtacgcttctctgagatccacttcctggctctggccattggctctgcctgtgcactgatgatcataatagtaattgtagtggtcctcttccagcattaccggaaaaagcgatgggccgaaagagctcataaagtggtggagataaaatcaaaagaagaggaaaggctcaaccaagagaaaaaggtctctgtttatttagaagacacagactaa

SEQ ID NO: 9654 - DNA, 852 bp, synthetic construct
  misc_feature 1..852: note = Synthetic polypeptide
  source 1..852: mol_type = other DNA
ctggagagaaagaaccatgggtgggaaaaggtcctggagatctgaaatgaagacccggttctgccatagacttgctgtgtgatcttggccaaggatatcacctaccttcgcatcccggtcgctgatacccctgaggtacccatcaaaaagcacttcaaagaatgtatcaacttcatccactgctgccgccttaatggggggaactgccttgtgcactgctttgcaggcatctctcgcagcaccacgattgtgacagcgtatgtgatgactgtgacggggctaggctggcgggacgtgcttgaagccatcaaggccaccaggcccatcgccaaccccaacccaggctttaggcagcagcttgaagagtttggctgggccagttcccagaagggtgccagacataggacctcaaaaacctctggtgcccaatgccctccgatgacttcagcaacctgcctgctggctgcacgtgtggctcttctctccgcagcgctggtgcgcgaagccaccgggcgcacagcccagcgctgtcgtctgagtccgcgggcggccgccgagcgcctgctggggccgccacctcacgttgcagcaggatggtcaccggacccaaagtaccagatctgtctgtgcttcggtgaggaggacccgggccccacacagcaccccaaggagcagctcatcatggcggacgtgcaggtgcagcttcggcctgggagctcgtcctgcactctaagtgcctcaaccgagcgcccagatgggtcctcaacccctggcaaccccgatggcatcactcaccttcaatgcagctgcctccatcctaagcgagccgcttcctcttcttgtacccgctga

SEQ ID NO: 9655 - DNA, 663 bp, synthetic construct
  misc_feature 1..663: note = Synthetic polypeptide
  source 1..663: mol_type = other DNA
ctggagagaaagaaccatgggtgggaaaaggtcctggagatctgaaatgaagacccggttctgccatagacttgctgtgtgatcttggccaaggatatcacctaccttcgcatcccggtcgctgatacccctgaggtacccatcaaaaagcacttcaaagaatgtatcaacttcatccactgctgccgccttaatggggggaactgccttgtgcactgctttgcaggcatctctcgcagcaccacgattgtgacagcgtatgtgatgactgtgacggggctaggctggcgggacgtgcttgaagccatcaaggccaccaggcccatcgccaaccccaacccaggctttaggcagcagcttgaagagtttggctgggccagttcccagaagcttcgccggcagctggaggagcgcttcggcgagagccccttccgcgacgaggaggagttgcgcgcgctgctgccgctgtgcaagcgctgccggcagggctccgcgacctcggcctcctccgccgggccgcactcagcagcctccgagggaaccgtgcagcgcctggtgccgcgcacgccccgggaagcccaccggccgctgccgctgctggcgcgcgtcaagcagactttctcttgcctcccccggtgtctgtcccgcaagggcggcaagtga

SEQ ID NO: 9656 - DNA, 218 bp, synthetic construct
  misc_feature 1..218: note = Synthetic polypeptide
  source 1..218: mol_type = other DNA
ctggagagaaagaaccatgggtgggaaaaggtcctggagatctgaaatgaagacccggttctgccatagacttgctgtgtgatcttggccaaggatatcacctaccttcgcatcccggtcgctgatacccctgaggtacccatcaaaaagcacttcaaagaatgtatcaacttcatccactgctgccgccttaatggggggaactgccttgtgcactg

SEQ ID NO: 9657 - DNA, 1211 bp, synthetic construct
  misc_feature 1..1211: note = Synthetic polypeptide
  source 1..1211: mol_type = other DNA
tgtactagatttgttagtcattgcctaccaaacccagccacttctgagcaaccatactccatccacagcccaattgctgaaactgcaaatggaatggtagcattctgcacggtgggatctttcttctccaggcaccagtcacttcagagactgttgtgacggaggttttgggtcaccgggtgactttgccctgtctgtactcatcctggtctcacaacagcaacagcatgtgctgggggaaagaccagtgcccctactccggttgcaaggaggcgctcatccgcactgatggaatgagggtgacctcaagaaagtcagcaaaatatagacttcaggggactatcccgagaggtgatgtctccttgaccatcttaaaccccagtgaaagtgacagcggtgtgtactgctgccgcatagaagtgcctggctggttcaacgatgtaaagataaacgtgcgcctgaatctacagagagcctcaacaaccacgcacagaacagcaaccaccaccacacgcagaacaacaacaacaagccccaccaccacccgacaaatgacaacaaccccagctgcacttccaacaacagtcgtgaccacacccgatctcacaaccggaacaccactccagatgacaaccattgccgtcttcacaacagcaaacacgtgcctttcactaaccccaagcacccttccggaggaagccacaggtcttctgactcccgagccttctaaggaagggcccatcctcactgcagaatcagaaactgtcctccccagtgattcctggagtagtgttgagtctacttctgctgacactgtcctgctgacatccaaagagtccaaagtttgggatctcccatcaacatcccacgtgtcaatgtggaaaacgagtgattctgtgtcttctcctcagcctggagcatctgatacagcagttcctgagcagaacaaaacaacaaaaacaggacagatggatggaatacccatgtcaatgaagaatgaaatgcccatctcccaactactgatgatcatcgccccctccttgggatttgtgctcttcgcattgtttgtggcgtttctcctgagagggaaactcatggaaacctattgttcgcagaaacacacaaggctagactacattggagatagtaaaaatgtcctcaatgacgtgcagcatggaagggaagacgaagacggcctttttaccctctaa

SEQ ID NO: 9658 - DNA, 1127 bp, synthetic construct
  misc_feature 1..1127: note = Synthetic polypeptide
  source 1..1127: mol_type = other DNA
tgtactagatttgttagtcattgcctaccaaacccagccacttctgagcaaccatactccatccacagcccaattgctgaaactgcaaatggaatggtagcattctgcacggtgggatctttcttctccaggcaccagtcacttcagagactgttgtgacggaggttttgggtcaccgggtgactttgccctgtctgtactcatcctggtctcacaacagcaacagcatgtgctgggggaaagaccagtgcccctactccggttgcaaggaggcgctcatccgcactgatggaatgagggtgacctcaagaaagtcagcaaaatatagacttcaggggactatcccgagaggtgatgtctccttgaccatcttaaaccccagtgaaagtgacagcggtgtgtactgctgccgcatagaagtgcctggctggttcaacgatgtaaagataaacgtgcgcctgaatctacagagagcctcaacaaccacgcacagaacagcaaccaccaccacacgcagaacaacaacaacaagccccaccaccacccgacaaatgacaacaaccccagctgcacttccaacaacagtcgtgaccacacccgatctcacaaccggaacaccactccagatgacaaccattgccgtcttcacaacagcaaacacgtgcctttcactaaccccaagcacccttccggaggaagccacaggtcttctgactcccgagccttctaaggaagggcccatcctcactgcagaatcagaaactgtcctccccagtgattcctggagtagtgttgagtctacttctgctgacactgtcctgctgacatccaaagcatctgatacagcagttcctgagcagaacaaaacaacaaaaacaggacagatggatggaatacccatgtcaatgaagaatgaaatgcccatctcccaactactgatgatcatcgccccctccttgggatttgtgctcttcgcattgtttgtggcgtttctcctgagagggaaactcatggaaacctattgttcgcagaaacacacaaggctagactacattggagatagtaaaaatgtcctcaatgacgtgcagcatggaagggaagacgaagacggcctttttaccctctaa

SEQ ID NO: 9659 - DNA, 866 bp, synthetic construct
  misc_feature 1..866: note = Synthetic polypeptide
  source 1..866: mol_type = other DNA
ggccaggtgcagtggctcacgcctgtaatcccagcactttgggaggccgaggtgggcggatcacctgaggtcaggggttcaagatcagcctgaccaacatgaagaaaccccatctctacaaaaaatacaaaattagccaggtgtggtggcgcatgcctgtaatcccagccacgctactcgggaggctgaggaaggagaatcgcttgaacccaggaggcagaggttacgttcctcataaccagaggaagcctgaatcaactcatctgttagaaaaccaaaatactcaagagattccacttgccattagcagttcttcattcacgacaagcaaccacagtgtgcaaaacagagatcatagaggaggcatgcagccctgttctcctcagagatgccagcctccagccagctgcagccctcacgaaaatatactgccctataaatacacaagctggagaccacctttccccaaaaggtctgatagaaaggatgtccagcacaatgaatggtacattggagaatacagccgccaggcagtggaagaggcattcatgaaggagaacaaggatggtagtttcttggtccgagattgttccacaaaatccaaggaagagccctatgttttggctgtgttttatgagaacaaagtctacaatgtaaaaatacgcttcctggagaggaatcagcagtttgccctggggacaggactcagaggagatgagaagtttgattcagtagaagacatcatcgaacactacaagaattttcccattatactaattgatgggaaagataaaactggggtccacaggaaacagtgtcacctcactcagccactccctctcaccagacacctcttgcctctgtag

SEQ ID NO: 9660 - DNA, 888 bp, synthetic construct
  misc_feature 1..888: note = Synthetic polypeptide
  source 1..888: mol_type = other DNA
gccgggcgcagtggctcacgcctgtaatcctagcactttgggaggccgaggcaggcagatcacaaggtcaagagatcgagaccatcctggccaacatggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagaaattgcaggtgctgcagtgtctgaaatttccgggcctttctcaacagaggatgtag

SEQ ID NO: 9661 - DNA, 1254 bp, synthetic construct
  misc_feature 1..1254: note = Synthetic polypeptide
  source 1..1254: mol_type = other DNA
gccgggcgcagtggctcacgcctgtaatcctagcactttgggaggccgaggcaggcagatcacaaggtcaagagatcgagaccatcctggccaacatggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatga

SEQ ID NO: 9662 - DNA, 1104 bp, synthetic construct
  misc_feature 1..1104: note = Synthetic polypeptide
  source 1..1104: mol_type = other DNA
gccgggcgcagtggctcacgcctgtaatcctagcactttgggaggccgaggcaggcagatcacaaggtcaagagatcgagaccatcctggccaacatggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatga

SEQ ID NO: 9663 - DNA, 1077 bp, synthetic construct
  misc_feature 1..1077: note = Synthetic polypeptide
  source 1..1077: mol_type = other DNA
ctatttagaacccttcagtggcccagaacccactgagtagaggccctgtgccttagcagggccttcagggccttcccagcaccacccccagcctcccccaacctgagttcctgaacacacgggatgcttacactgccaggctcggtctatgttggtcccacttcttataatgtctcctcttccttcttcacttgtccaattcatagattgtccttccagatcaccttcatacattcattaccttctcaggaagcaattctccatctcagtcccctcccttacccctatccctggggcctctgcggcccctcctcctggacccctgcagtctctgttcttctctgggttggtcgcttatcccactggtaatcaaatttcctcctaagtgtctgtctccacaccagacagtggttcctggaggaaggggctatctggttcatctccaaagcctgcctcacaggcgccactgccgtcctctttgctgtctttgtccgctacaaccacaaaaccgacgctgccctctggcaccggagcaaccacagtaacgcggacaatgaattttactttcgctacccaaggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatggtccacatccaaaatgcagcgctggctggaggggttgtggtggggacctcaagtgaaatgatgctgacaccctttggggctctggcagctggcttcttggctgggactgtctccacgctgggcccatccttgaatcaaaattcaaagtccaagacacatgtggagtccacaacctccatgggatgccgggggtcctgggggccctcctgggggtccttgtggctggacttgccacccatgaagcttacggagatgggtgagtttcctcccaacccgtactgcagtcgtcatccatctggaatgacctctgtcattctctttcactgtgtgtga

SEQ ID NO: 9664 - DNA, 684 bp, synthetic construct
  misc_feature 1..684: note = Synthetic polypeptide
  source 1..684: mol_type = other DNA
ctatttagaacccttcagtggcccagaacccactgagtagaggccctgtgccttagcagggccttcagggccttcccagcaccacccccagcctcccccaacctgagttcctgaacacacgggatgcttacactgccaggctcggtctatgttggtcccacttcttataatgtctcctcttccttcttcacttgtccaattcatagattgtccttccagatcaccttcatacattcattaccttctcaggaagcaattctccatctcagtcccctcccttacccctatccctggggcctctgcggcccctcctcctggacccctgcagtctctgttcttctctgggttggtcgcttatcccactggtaatcaaatttcctcctaagtgtctgtctccacaccagacagtggttcctggaggaaggggctatctggttcatctccaaagcctgcctcacaggcgccactgccgtcctctttgctgtctttgtccgctacaaccacaaaaccgacgctgccctctggcaccggagcaaccacagtaacgcggacaatgaattttactttcgctacccaaatggagtttcgctcttgttgcccaggctggagtgcaatggcacaatctcggctcaccacaacctctgcctcccgggttcaagcgattctcctgcctcagtctcctga

SEQ ID NO: 9665 - DNA, 1764 bp, synthetic construct
  misc_feature 1..1764: note = Synthetic polypeptide
  source 1..1764: mol_type = other DNA
ctatttagaacccttcagtggcccagaacccactgagtagaggccctgtgccttagcagggccttcagggccttcccagcaccacccccagcctcccccaacctgagttcctgaacacacgggatgcttacactgccaggctcggtctatgttggtcccacttcttataatgtctcctcttccttcttcacttgtccaattcatagattgtccttccagatcaccttcatacattcattaccttctcaggaagcaattctccatctcagtcccctcccttacccctatccctggggcctctgcggcccctcctcctggacccctgcagtctctgttcttctctgggttggtcgcttatcccactggtaatcaaatttcctcctaagtgtctgtctccacaccagacagtggttcctggaggaaggggctatctggttcatctccaaagcctgcctcacaggcgccactgccgtcctctttgctgtctttgtccgctacaaccacaaaaccgacgctgccctctggcaccggagcaaccacagtaacgcggacaatgaattttactttcgctacccaagcttccaggacgtgcatgccatggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctgacttttgtgcgggggccgtgctcatctcctttggtgccgtcctgggcaagaccgggcctacccagctgctgctcatggccctgctggaggtggtgctgtttggcatcaatgagtttgtgctccttcatctcctgggggtgagagatgccggaggctccatgactatccacacctttggtgcctacttcgggctcgtcctttcgcgggttctgtacaggccccagctggagaagagcaagcaccgccagggctccgtctaccattcagacctcttcgccatgattgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatggtccacatccaaaatgcagcgctggctggaggggttgtggtggggacctcaagtgaaatgatgctgacaccctttggggctctggcagctggcttcttggctgggactgtctccacgctggggtacaagttcttcacgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggagggctcctgctgaagctaccctttctggaccccccagactcccagcactacgaggaccaagttcactggcaggtgcctggcgagcatgaggataaagcccagagacctctgagggtggaggaggcagacactcaggcctaa

SEQ ID NO: 9666 - DNA, 1716 bp, synthetic construct
  misc_feature 1..1716: note = Synthetic polypeptide
  source 1..1716: mol_type = other DNA
ctatttagaacccttcagtggcccagaacccactgagtagaggccctgtgccttagcagggccttcagggccttcccagcaccacccccagcctcccccaacctgagttcctgaacacacgggatgcttacactgccaggctcggtctatgttggtcccacttcttataatgtctcctcttccttcttcacttgtccaattcatagattgtccttccagatcaccttcatacattcattaccttctcaggaagcaattctccatctcagtcccctcccttacccctatccctggggcctctgcggcccctcctcctggacccctgcagtctctgttcttctctgggttggtcgcttatcccactggtaatcaaatttcctcctaagtgtctgtctccacaccagacagtggttcctggaggaaggggctatctggttcatctccaaagcctgcctcacaggcgccactgccgtcctctttgctgtctttgtccgctacaaccacaaaaccgacgctgccctctggcaccggagcaaccacagtaacgcggacaatgaattttactttcgctacccaagcttccaggacgtgcatgccatggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctgacttttgtgcgggggccgtgctcatctcctttggtgccgtcctgggcaagaccgggcctacccagctgctgctcatggccctgctggaggtggtgctgtttggcatcaatgagtttgtgctccttcatctcctgggggtgagagatgccggaggctccatgactatccacacctttggtgcctacttcgggctcgtcctttcgcgggttctgtacaggccccagctggagaagagcaagcaccgccagggctccgtctaccattcagacctcttcgccatgattgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatggtccacatccaaaatgcagcgctggctggaggggttgtggtggggacctcaagtgaaatgatgctgacaccctttggggctctggcagctggcttcttggctgggactgtctccacgctggggtacaagttcttcacgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggagggctcctgctgaagctaccctttctggactccccccccagactcccagcactacgaggaccaagttcactggcaggtgcctggcgagcatga

SEQ ID NO: 9667 - DNA, 852 bp, synthetic construct
  misc_feature 1..852: note = Synthetic polypeptide
  source 1..852: mol_type = other DNA
ctatttagaacccttcagtggcccagaacccactgagtagaggccctgtgccttagcagggccttcagggccttcccagcaccacccccagcctcccccaacctgagttcctgaacacacgggatgcttacactgccaggctcggtctatgttggtcccacttcttataatgtctcctcttccttcttcacttgtccaattcatagattgtccttccagatcaccttcatacattcattaccttctcaggaagcaattctccatctcagtcccctcccttacccctatccctggggcctctgcggcccctcctcctggacccctgcagtctctgttcttctctgggttggtcgcttatcccactggtaatcaaatttcctcctaagtgtctgtctccacaccagacagtggttcctggaggaaggggctatctggttcatctccaaagcctgcctcacaggcgccactgccgtcctctttgctgtctttgtccgctacaaccacaaaaccgacgctgccctctggcaccggagcaaccacagtaacgcggacaatgaattttactttcgctacccaaaagagtctcactctgttgcccaggctggagtgcaacggcgcaatctcggctcactgcaaccttcacctcccaggcttccaggacgtgcatgccatggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctga

SEQ ID NO: 9668 - DNA, 1828 bp, synthetic construct; identical to SEQ ID NO: 6812
  misc_feature 1..1828: note = Synthetic polypeptide
  source 1..1828: mol_type = other DNA

SEQ ID NO: 9669 - DNA, 1926 bp, synthetic construct
  misc_feature 1..1926: note = Synthetic polypeptide
  source 1..1926: mol_type = other DNA
tggtaaccatggagggattctgagttgaggtacccctgacctttgacagatctattggtgcttggtagcaccatgagctaaccttatggctcaaaccaacaggacaatttgctgaggtctgggagcaccccctccatagagtccctgatctctcaaaacttggtcgtgatctaaagtttatttgatgtacaactccccctctccttcttttggagttttatttgcttccaagaaggaaggcaagatttcctgggtccgtgatgatggaaggctgacaactcttttatggagtttgagcttgctcccagcagggaagacaagttcgagtttttttcctgcttcaaggatggtagagagcagtcttcagcctgagacccatccctaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccagggaagccatctttgacaccctttgcaccgatgacagctctgaagaggcaaagacactcacaatggacatattgacattggctcacacctccacagaagctaagggcctgtcctcagagagcagcgcctcttccgacagcccccatccagtcatcaccccgtcacgggcctcagagagcagcgcctcttccgacggcccccatccagtcatcaccccgtcacgggcctcagagagcagcgcctcttccgacggcccccatccagtcatcaccccctcatggtccccgggatctgacgtcactctcctcgctgaagccctggtgactgtcacaaacatcgaggttattaattgcagcatcacagaaatagaaacaacgacttccagcatccctggggcctcagacacagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctgatgccacggttgggaccccactccccactaacagcgccacagaaagagaagtgacagcacccggggccacgaccctcagtggagctctggtcacagttagcaggaatccccttgaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagctccaccgggaactccacgcccacgcgcctcacttccaggtctccttactgcgtgtcaggagaggctaa

SEQ ID NO: 9670 - DNA, 2439 bp, synthetic construct
  misc_feature 1..2439: note = Synthetic polypeptide
  source 1..2439: mol_type = other DNA
tggtaaccatggagggattctgagttgaggtacccctgacctttgacagatctattggtgcttggtagcaccatgagctaaccttatggctcaaaccaacaggacaatttgctgaggtctgggagcaccccctccatagagtccctgatctctcaaaacttggtcgtgatctaaagtttatttgatgtacaactccccctctccttcttttggagttttatttgcttccaagaaggaaggcaagatttcctgggtccgtgatgatggaaggctgacaactcttttatggagtttgagcttgctcccagcagggaagacaagttcgagtttttttcctgcttcaaggatggtagagagcagtcttcagcctgagacccatccctaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccagggaagccatctttgacaccctttgcaccgatgacagctctgaagaggcaaagacactcacaatggacatattgacattggctcacacctccacagaagctaagggcctgtcctcagagagcagcgcctcttccgacagcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcctccatccagtcatcaccccgtcacgggcctcagagagcagcgcctcttccgacggcccccatccagtcatcaccccgtcacgggcctcagagagcagcgcctcttccgacggcccccatccagtcatcaccccctcatggtccccgggatctgacgtcactctcctcgctgaagccctggtgactgtcacaaacatcgaggttattaattgcagcatcacagaaatagaaacaacgacttccagcatccctggggcctcagacacagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctgatgccacggttgggaccccactccccactaacagcgccacagaaagagaagtgacagcacccggggccacgaccctcagtggagctctggtcacagttagcaggaatccccttgaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagctccaccgggaactccacgcccacgcgcctcacttccaggtctccttactgcgtgtcaggagaggctaa

SEQ ID NO: 9671 - DNA, 2481 bp, synthetic construct
  misc_feature 1..2481: note = Synthetic polypeptide
  source 1..2481: mol_type = other DNA
tggtaaccatggagggattctgagttgaggtacccctgacctttgacagatctattggtgcttggtagcaccatgagctaaccttatggctcaaaccaacaggacaatttgctgaggtctgggagcaccccctccatagagtccctgatctctcaaaacttggtcgtgatctaaagtttatttgatgtacaactccccctctccttcttttggagttttatttgcttccaagaaggaaggcaagatttcctgggtccgtgatgatggaaggctgacaactcttttatggagtttgagcttgctcccagcagggaagacaagttcgagtttttttcctgcttcaaggatggtagagagcagtcttcagcctgagacccatccctaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccagggaagccatctttgacaccctttgcaccgatgacagctctgaagaggcaaagacactcacaatggacatattgacattggctcacacctccacagaagctaagggcctgtcctcagagagcagcgcctcttccgacagcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcctccatccagtcatcaccccgtcacgggcctcagagagcagcgcctcttccgacggcccccatccagtcatcaccccgtcacgggcctcagagagcagcgcctcttccgacggcccccatccagtcatcaccccctcatggtccccgggatctgacgtcactctcctcgctgaagccctggtgactgtcacaaacatcgaggttattaattgcagcatcacagaaatagaaacaacgacttccagcatccctggggcctcagacacagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctgatgccacggttgggaccccactccccactaacagcgccacagaaagagaagtgacagcacccggggccacgaccctcagtggagctctggtcacagttagcaggaatccccttgaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagatggaaaggagcctggctctgtcacccaggctggagtgcagtggcgtgatctcagctcactgcaagctccacctcttgggttcacgtgattctcctgcctcagcctcctga

SEQ ID NO: 9672 - DNA, 2327 bp, synthetic construct
  misc_feature 1..2327: note = Synthetic polypeptide
  source 1..2327: mol_type = other DNA
ggtggcccgtacagggagcccattctcctctggggaggggtctccagtactttcccgtgtggaggcgcgcccagtcaccttgttgcggtagcctcaaggtgaggaatcgagacccaccaagtatgatgaataaacccagactctcagcaatgcaggaaaggaacaaacgggcagcttgggaaaagggggctcacataccacagcgactaggtaaactctacacagaccaagattttgatagtttacctgtgcaaattacagttccggagaaaatacggtcaataataaaggaaggaattgaatcgcaggcatcctacaaaattgtaattgaagggaaaccatatactgtgaatttaatgcaaaaaaactttttaccccataattttagagtttacagttatagtggcacaggaattatgaaaccacttgaccaagattttcagaatttctgccactaccaagggtatattgaaggttatccaaaatctgtggtgatggttagcacatgtactggactcaggggcgtactacagtttgaaaatgttagttatggaatagaacccctggagtcttcagttggctttgaacatgtaatttaccaagtaaaacataagaaagcagatgtttccttatataatgagaaggatattgaatcaagagatctgtcctttaaattacaaagcgtagagtataatcatatggggtctgatacaactgttgtcgctcaaaaagttttccagttgattggattgacgaatgctatttttgtttcatttaatattacaattattctgtcttcattggagctttggatagatgaaaataaaattgcaaccactggagaagctaatgagttattacacacatttttaagatggaaaacatcttatcttgttttacgtcctcatgatgtggcatttttacttgtttacagagaaaagtcaaattatgttggtgcaacctttcaagggaagatgtgtgatgcaaactatgcaggaggtgttgttctgcaccccagaaccataagtctggaatcacttgcagttattttagctcaattattgagccttagtatggggatcacttatgatgacattaacaaatgccagtgctcaggagctgtctgcattatgaatccagaagcaattcatttcagtggtgtgaagatctttagtaactgcagcttcgaagactttgcacattttatttcaaagcagaagtcccagtgtcttcacaatcagcctcgcttagatccttttttcaaacagcaagcagtgtgtggtaatgcaaagctggaagcaggagaggagtgtgactgtgggactgaacaggattgtgcccttattggagaaacatgctgtgatattgccacatgtagatttaaagccggttcaaactgtgctgaaggaccatgctgcgaaaactgtctatttatgtcaaaagaaagaatgtgtaggccttcctttgaagaatgcgacctccctgaatattgcaatggatcatctgcatcatgcccagaaaaccactatgttcagactgggcatccgtgtggactgaatcaatggatctgtatagatggagtttgtatgagtggggataaacaatgtacagacacatttggcaaagaagtagagtttggcccttcagaatgttattctcaccttaattcaaagactgatgtatctggaaactgtggtataagtgattcaggatacacacagtgtgaagctgacaatctgcagtgcggaaaattaatatgtaaatatgtaggtaaatttttattacaaattccaagagccactattatttatgccaacataagtggacatctctgcattgctgtggaatttgccagtgatcatgcagacagccaaaagatgtggataaaagatggaacttcttgtggttcaaataaggtttgcaggaatcaaagatgtgtgagttcttcatacttgggttatgattgtactactgacaaatgcaatgatagaggtgtatgcaataacaaaaagcactgtcactgtagtgcttcatatttacctccagattgctcagttcaatcagatctatggcctggtgggagtattgacagtggcaattttccacctgtagctataccagccagactccctgaaaggcgctacattgagaacatttaccattccaaaccaatgagatggccatttttcttattcattcctttctttattattttctgtgtactgattgctataatggtgaaagttaatttccaaaggaaaaaatggagaactgaggactattcaagcgatgagcaacctgaaagtgagagtgaacctaaagggtag

SEQ ID NO: 9673 - DNA, 1916 bp, synthetic construct
  misc_feature 1..1916: note = Synthetic polypeptide
  source 1..1916: mol_type = other DNA
ggtggcccgtacagggagcccattctcctctggggaggggtctccagtactttcccgtgtggaggcgcgcccagtcaccttgttgcggtagcctcaaggtgaggaatcgagacccaccaagtatgatgaataaacccagactctcagcaatgcaggaaaggaacaaacgggcagcttgggaaaagggggctcacataccacagcgactaggtaaactctacacagaccaagattttgatagtttacctgtgcaaattacagttccggagaaaatacggtcaataataaaggaaggaattgaatcgcaggcatcctacaaaattgtaattgaagggaaaccatatactgtgaatttaatgcaaaaaaactttttaccccataattttagagtttacagttatagtggcacaggaattatgaaaccacttgaccaagattttcagaatttctgccactaccaagggtatattgaaggttatccaaaatctgtggtgatggttagcacatgtactggactcaggggcgtactacagtttgaaaatgttagttatggaatagaacccctggagtcttcagttggctttgaacatgtaatttaccaagtaaaacataagaaagcagatgtttccttatataatgagaaggatattgaatcaagagatctgtcctttaaattacaaagcgtagagcaccccagaaccataagtctggaatcacttgcagttattttagctcaattattgagccttagtatggggatcacttatgatgacattaacaaatgccagtgctcaggagctgtctgcattatgaatccagaagcaattcatttcagtggtgtgaagatctttagtaactgcagcttcgaagactttgcacattttatttcaaagcagaagtcccagtgtcttcacaatcagcctcgcttagatccttttttcaaacagcaagcagtgtgtggtaatgcaaagctggaagcaggagaggagtgtgactgtgggactgaacaggattgtgcccttattggagaaacatgctgtgatattgccacatgtagatttaaagccggttcaaactgtgctgaaggaccatgctgcgaaaactgtctatttatgtcaaaagaaagaatgtgtaggccttcctttgaagaatgcgacctccctgaatattgcaatggatcatctgcatcatgcccagaaaaccactatgttcagactgggcatccgtgtggactgaatcaatggatctgtatagatggagtttgtatgagtggggataaacaatgtacagacacatttggcaaagaagtagagtttggcccttcagaatgttattctcaccttaattcaaagactgatgtatctggaaactgtggtataagtgattcaggatacacacagtgtgaagctgatggacatctctgcattgctgtggaatttgccagtgatcatgcagacagccaaaagatgtggataaaagatggaacttcttgtggttcaaataaggtttgcaggaatcaaagatgtgtgagttcttcatacttgggttatgattgtactactgacaaatgcaatgatagaggtgtatgcaataacaaaaagcactgtcactgtagtgcttcatatttacctccagattgctcagttcaatcagatctatggcctggtgggagtattgacagtggcaattttccacctgtagctataccagccagactccctgaaaggcgctacattgagaacatttaccattccaaaccaatgagatggccatttttcttattcattcctttctttattattttctgtgtactgattgctataatggtgaaagttaatttccaaaggaaaaaatggagaactgaggactattcaagcgatgagcaacctgaaagtgagagtgaacctaaagggtag

SEQ ID NO: 9674 - DNA, 2384 bp, synthetic construct
  misc_feature 1..2384: note = Synthetic polypeptide
  source 1..2384: mol_type = other DNA
ggtggcccgtacagggagcccattctcctctggggaggggtctccagtactttcccgtgtggaggcgcgcccagtcaccttgttgcggtagcctcaaggtgaggaatcgagacccaccaagtatgatgaataaacccagactctcagcaatgcaggaaaggaacaaacgggcagcttgggaaaagggggctcacataccacagcgactaggtaaactctacacagaccaagattttgatagtttacctgtgcaaattacagttccggagaaaatacggtcaataataaaggaaggaattgaatcgcaggcatcctacaaaattgtaattgaagggaaaccatatactgtgaatttaatgcaaaaaaactttttaccccataattttagagtttacagttatagtggcacaggaattatgaaaccacttgaccaagattttcagaatttctgccactaccaagggtatattgaaggttatccaaaatctgtggtgatggttagcacatgtactggactcaggggcgtactacagtttgaaaatgttagttatggaatagaacccctggagtcttcagttggctttgaacatgtaatttaccaagtaaaacataagaaagcagatgtttccttatataatgagaaggatattgaatcaagagatctgtcctttaaattacaaagcgtagagccacagcaagattttgcaaagtatatagaaatgcatgttatagttgaaaaacaattgtataatcatatggggtctgatacaactgttgtcgctcaaaaagttttccagttgattggattgacgaatgctatttttgtttcatttaatattacaattattctgtcttcattggagctttggatagatgaaaataaaattgcaaccactggagaagctaatgagttattacacacatttttaagatggaaaacatcttatcttgttttacgtcctcatgatgtggcatttttacttgtttacagagaaaagtcaaattatgttggtgcaacctttcaagggaagatgtgtgatgcaaactatgcaggaggtgttgttctgcaccccagaaccataagtctggaatcacttgcagttattttagctcaattattgagccttagtatggggatcacttatgatgacattaacaaatgccagtgctcaggagctgtctgcattatgaatccagaagcaattcatttcagtggtgtgaagatctttagtaactgcagcttcgaagactttgcacattttatttcaaagcagaagtcccagtgtcttcacaatcagcctcgcttagatccttttttcaaacagcaagcagtgtgtggtaatgcaaagctggaagcaggagaggagtgtgactgtgggactgaacaggattgtgcccttattggagaaacatgctgtgatattgccacatgtagatttaaagccggttcaaactgtgctgaaggaccatgctgcgaaaactgtctatttatgtcaaaagaaagaatgtgtaggccttcctttgaagaatgcgacctccctgaatattgcaatggatcatctgcatcatgcccagaaaaccactatgttcagactgggcatccgtgtggactgaatcaatggatctgtatagatggagtttgtatgagtggggataaacaatgtacagacacatttggcaaagaagtagagtttggcccttcagaatgttattctcaccttaattcaaagactgatgtatctggaaactgtggtataagtgattcaggatacacacagtgtgaagctgacaatctgcagtgcggaaaattaatatgtaaatatgtaggtaaatttttattacaaattccaagagccactattatttatgccaacataagtggacatctctgcattgctgtggaatttgccagtgatcatgcagacagccaaaagatgtggataaaagatggaacttcttgtggttcaaataaggtttgcaggaatcaaagatgtgtgagttcttcatacttgggttatgattgtactactgacaaatgcaatgatagaggtgtatgcaataacaaaaagcactgtcactgtagtgcttcatatttacctccagattgctcagttcaatcagatctatggcctggtgggagtattgacagtggcaattttccacctgtagctataccagccagactccctgaaaggcgctacattgagaacatttaccattccaaaccaatgagatggccatttttcttattcattcctttctttattattttctgtgtactgattgctataatggtgaaagttaatttccaaaggaaaaaatggagaactgaggactattcaagcgatgagcaacctgaaagtgagagtgaacctaaagggtag

SEQ ID NO: 9675 - DNA, 2195 bp, synthetic construct
  misc_feature 1..2195: note = Synthetic polypeptide
  source 1..2195: mol_type = other DNA
ggtggcccgtacagggagcccattctcctctggggaggggtctccagtactttcccgtgtggaggcgcgcccagtcaccttgttgcggtagcctcaaggtgaggaatcgagacccaccaagtatgatgaataaacccagactctcagcaatgcaggaaaggaacaaacgggcagcttgggaaaagggggctcacataccacagcgactaggtaaactctacacagaccaagattttgatagtttacctgtgcaaattacagttccggagaaaatacggtcaataataaaggaaggaattgaatcgcaggcatcctacaaaattgtaattgaagggaaaccatatactgtgaatttaatgcaaaaaaactttttaccccataattttagagtttacagttatagtggcacaggaattatgaaaccacttgaccaagattttcagaatttctgccactaccaagggtatattgaaggttatccaaaatctgtggtgatggttagcacatgtactggactcaggggcgtactacagtttgaaaatgttagttatggaatagaacccctggagtcttcagttggctttgaacatgtaatttaccaagtaaaacataagaaagcagatgtttccttatataatgagaaggatattgaatcaagagatctgtcctttaaattacaaagcgtagagccacagcaagattttgcaaagtatatagaaatgcatgttatagttgaaaaacaattgtataatcatatggggtctgatacaactgttgtcgctcaaaaagttttccagttgattggattgacgaatgctatttttgtttcatttaatattacaattattctgtcttcattggagctttggatagatgaaaataaaattgcaaccactggagaagctaatgagttattacacacatttttaagatggaaaacatcttatcttgttttacgtcctcatgatgtggcatttttacttgtttacagagaaaagtcaaattatgttggtgcaacctttcaagggaagatgtgtgatgcaaactatgcaggaggtgttgttctgcaccccagaaccataagtctggaatcacttgcagttattttagctcaattattgagccttagtatggggatcacttatgatgacattaacaaatgccagtgctcaggagctgtctgcattatgaatccagaagcaattcatttcagtggtgtgaagatctttagtaactgcagcttcgaagactttgcacattttatttcaaagcagaagtcccagtgtcttcacaatcagcctcgcttagatccttttttcaaacagcaagcagtgtgtggtaatgcaaagctggaagcaggagaggagtgtgactgtgggactgaacaggattgtgcccttattggagaaacatgctgtgatattgccacatgtagatttaaagccggttcaaactgtgctgaaggaccatgctgcgaaaactgtctatttatgtcaaaagaaagaatgtgtaggccttcctttgaagaatgcgacctccctgaatattgcaatggatcatctgcatcatgcccagaaaaccactatgttcagactgggcatccgtgtggactgaatcaatggatctgtatagatggagtttgtatgagtggggataaacaatgtacagacacatttggcaaagaagtagagtttggcccttcagaatgttattctcaccttaattcaaagactgatgtatctggaaactgtggtataagtgattcaggatacacacagtgtgaagtttgcaggaatcaaagatgtgtgagttcttcatacttgggttatgattgtactactgacaaatgcaatgatagaggtgtatgcaataacaaaaagcactgtcactgtagtgcttcatatttacctccagattgctcagttcaatcagatctatggcctggtgggagtattgacagtggcaattttccacctgtagctataccagccagactccctgaaaggcgctacattgagaacatttaccattccaaaccaatgagatggccatttttcttattcattcctttctttattattttctgtgtactgattgctataatggtgaaagttaatttccaaaggaaaaaatggagaactgaggactattcaagcgatgagcaacctgaaagtgagagtgaacctaaagggtag

SEQ ID NO: 9676 - DNA, 2911 bp, synthetic construct
  misc_feature 1..2911: note = Synthetic polypeptide
  source 1..2911: mol_type = other DNA
gcctggtgtggaggctcacgcctgtaatcccagcactttgggaggccaaggcgggcggatcacttgaagtcaggagttcaagatcagcctggccaacatggtggctgacatggaggagctgaccatctgggaacagcacacggccacactgtccaaggacccccgccggggctttggcattgcgatctctggaggccgagaccggcccggtggatccatggttgtatctgacgtggtacctggagggccggcggagggcaggctacagacaggcgaccacatcgtcatggtgaacggggtttccatggagaatgccacctccgcgtttgccattcagatactcaagacctgcaccaagatggccaacatcacagtgaaacgtccccggaggatccacctgcccgccaccaaagccagcccctccagcccagggcgccaggactcggatgaagacgatgggccccagcgggtggaggaggtggaccagggccggggctatgacggcgactcatccagtggctccggccgctcctgggacgagcgctcccgccggccgaggcctggtcgccggggccgggccggcagccatgggcgtaggagcccaggtggtggctctgaggccaacgggctggccctggtgtccggctttaagcggctgccacggcaggacgtgcagatgaagcctgtgaagtcagtgctggtgaagaggagagacagcgaagagtttggcgtcaagctgggcagtcagatcttcatcaagcacattacagattcgggcctggctgcccggcaccgtgggctgcaggaaggagatctcattctacagatcaacggggtgtctagccagaacctgtcactgaacgacacccggcgactgattgagaagtcagaagggaagctaagcctgctggtgctgagagatcgtgggcagttcctggtgaacattccgcctgctgtcagtgacagcgacagctcgccattggaggaaggcgtgaccatggctgatgagatgtcctctccccctgcagacatctcggacctcgcctcggagctatcgcaggcaccaccatcccacatcccaccaccaccccggcatgctcagcggagccccgaggccagccagaccgactctcccgtggagagtccccggcttcggcgggaaagttcagtagattccagaaccatctcggaaccagatgagcaacggtcagagttgcccagggaaagcagctatgacatctacagagtgcccagcagtcagagcatggaggatcgtgggtacagccccgacacgcgtgtggtccgcttcctcaagggcaagagcatcgggctgcggctggcagggggcaatgacgtgggcatcttcgtgtccggggtgcaggcgggcagcccggccgacgggcagggcatccaggagggagatcagattctgcaggtgaatgacgtgccattccagaacctgacacgggaggaggcagtgcagttcctgctggggctgccaccaggcgaggagatggagctggtgacgcagaggaagcaggacattttctggaaaatggtgcagtcccgcgtgggtgactccttctacatccgcactcactttgagctggagcccagtccaccgtctggcctgggcttcacccgtggcgacgtcttccacgtgctggacacgctgcaccccggccccgggcagagccacgcacgaggaggccactggctggcggtgcgcatgggtcgtgacctgcgggagcaagagcggggcatcattcccaaccagagcagggcggagcagctggccagcctggaagctgcccagagggccgtgggagtcgggcccggctcctccgcgggctccaatgctcgggccgagttctggcggctgcggggtcttcgtcgaggagccaagaagaccactcagcggagccgtgaggacctctcagctctgacccgacagggccgctacccgccctacgaacgagtggtgttgcgagaagccagtttcaagcgcccggtagtgatcctgggacccgtggccgacattgctatgcagaagttgactgctgagatgcctgaccagtttgaaatcgcagagactgtgtccaggaccgacagcccctccaagatcatcaaactagacaccgtgcgggtgattgcagaaaaagacaagcatgcgctcctggatgtgaccccctccgccatcgagcgcctcaactatgtgcagtactaccccattgtggtcttcttcatccccgagagccggccggccctcaaggcactgcgccagtggctggcgcctgcctcccgccgcagcacccgtcgcctctacgcacaagcccagaagctgcgaaaacacagcagccacctcttcacagccaccatccctctgaatggcacgagtgacacctggtaccaggagctcaaggccatcattcgagagcagcagacgcggcccatctggacggcggaagatcagctggatggctccttggaggacaacctagacctccctcaccacggcctggccgacagctccgctgacctcagctgcgacagccgcgttaacagcgactacgagacggacggcgagggcggcgcgtacacggatggcgagggctacacagacggcgagggggggccctacacggatgtggatgatgagcccccggctccagccctggcccggtcctcggagcccgtgcaggcagatgagtcccagagcccgagggatcgtgggagaatctcggctcatcagggggcccaggtggacagccgccacccccagggacagtggcgacaggacagcatgcgaacctatgaacgggaagccctgaagaaaaagtttatgcgagtacatgatgcggagtcctccgatgaagacggctatgactggggtccggccactgacctgtga

SEQ ID NO: 9677 - DNA, 2869 bp, synthetic construct
  misc_feature 1..2869: note = Synthetic polypeptide
  source 1..2869: mol_type = other DNA
gcctggtgtggaggctcacgcctgtaatcccagcactttgggaggccaaggcgggcggatcacttgaagtcaggagttcaagatcagcctggccaacatggtggctgacatggaggagctgaccatctgggaacagcacacggccacactgtccaaggacccccgccggggctttggcattgcgatctctggaggccgagaccggcccggtggatccatggttgtatctgacgtggtacctggagggccggcggagggcaggctacagacaggcgaccacatcgtcatggtgaacggggtttccatggagaatgccacctccgcgtttgccattcagatactcaagacctgcaccaagatggccaacatcacagtgaaacgtccccggaggatccacctgcccgccaccaaagccagcccctccagcccagggcgccaggactcggatgaagacgatgggccccagcgggtggaggaggtggaccagggccggggctatgacggcgactcatccagtggctccggccgctcctgggacgagcgctcccgccggccgaggcctggtcgccggggccgggccggcagccatgggcgtaggagcccaggtggtggctctgaggccaacgggctggccctggtgtccggctttaagcggctgccacggcaggacgtgcagatgaagcctgtgaagtcagtgctggtgaagaggagagacagcgaagagtttggcgtcaagctgggcagtcagatcttcatcaagcacattacagattcgggcctggctgcccggcaccgtgggctgcaggaaggagatctcattctacagatcaacggggtgtctagccagaacctgtcactgaacgacacccggcgactgattgagaagtcagaagggaagctaagcctgctggtgctgagagatcgtgggcagttcctggtgaacattccgcctgctgtcagtgacagcgacagctcgccattggaggacatctcggacctcgcctcggagctatcgcaggcaccaccatcccacatcccaccaccaccccggcatgctcagcggagccccgaggccagccagaccgactctcccgtggagagtccccggcttcggcgggaaagttcagtagattccagaaccatctcggaaccagatgagcaacggtcagagttgcccagggaaagcagctatgacatctacagagtgcccagcagtcagagcatggaggatcgtgggtacagccccgacacgcgtgtggtccgcttcctcaagggcaagagcatcgggctgcggctggcagggggcaatgacgtgggcatcttcgtgtccggggtgcaggcgggcagcccggccgacgggcagggcatccaggagggagatcagattctgcaggtgaatgacgtgccattccagaacctgacacgggaggaggcagtgcagttcctgctggggctgccaccaggcgaggagatggagctggtgacgcagaggaagcaggacattttctggaaaatggtgcagtcccgcgtgggtgactccttctacatccgcactcactttgagctggagcccagtccaccgtctggcctgggcttcacccgtggcgacgtcttccacgtgctggacacgctgcaccccggccccgggcagagccacgcacgaggaggccactggctggcggtgcgcatgggtcgtgacctgcgggagcaagagcggggcatcattcccaaccagagcagggcggagcagctggccagcctggaagctgcccagagggccgtgggagtcgggcccggctcctccgcgggctccaatgctcgggccgagttctggcggctgcggggtcttcgtcgaggagccaagaagaccactcagcggagccgtgaggacctctcagctctgacccgacagggccgctacccgccctacgaacgagtggtgttgcgagaagccagtttcaagcgcccggtagtgatcctgggacccgtggccgacattgctatgcagaagttgactgctgagatgcctgaccagtttgaaatcgcagagactgtgtccaggaccgacagcccctccaagatcatcaaactagacaccgtgcgggtgattgcagaaaaagacaagcatgcgctcctggatgtgaccccctccgccatcgagcgcctcaactatgtgcagtactaccccattgtggtcttcttcatccccgagagccggccggccctcaaggcactgcgccagtggctggcgcctgcctcccgccgcagcacccgtcgcctctacgcacaagcccagaagctgcgaaaacacagcagccacctcttcacagccaccatccctctgaatggcacgagtgacacctggtaccaggagctcaaggccatcattcgagagcagcagacgcggcccatctggacggcggaagatcagctggatggctccttggaggacaacctagacctccctcaccacggcctggccgacagctccgctgacctcagctgcgacagccgcgttaacagcgactacgagacggacggcgagggcggcgcgtacacggatggcgagggctacacagacggcgagggggggccctacacggatgtggatgatgagcccccggctccagccctggcccggtcctcggagcccgtgcaggcagatgagtcccagagcccgagggatcgtgggagaatctcggctcatcagggggcccaggtggacagccgccacccccagggacagtggcgacaggacagcatgcgaacctatgaacgggaagccctgaagaaaaagtttatgcgagtacatgatgcggagtcctccgatgaagacggctatgactggggtccggccactgacctgtga

SEQ ID NO: 9678 - DNA, 1110 bp, synthetic construct; identical to SEQ ID NO: 8310
  misc_feature 1..1110: note = Synthetic polypeptide
  source 1..1110: mol_type = other DNA

SEQ ID NO: 9679 - DNA, 519 bp, synthetic construct
  misc_feature 1..519: note = Synthetic polypeptide
  source 1..519: mol_type = other DNA
tattacagttcttacctgtccttgtttacagtctgtaccggctaggtgctgagcggcttgaaggctggctttgctacagctgaccactccagtcaggagagagagactgagaaggctatggatcgactagcccgtggaacacagagcattcctaatgacagtcctgcccggggtgagggcacccattctgaagaggaaggctttgccatggatgaggaggactctgatggagaactgaatacctgggagctgtcagaagggacaaactgtccacccaaggaacagcctggcgatctttttaatgaggactgggactcggagttgaaagcagatcaagggaatccatatgatgctgacgacatccaggagagcatttctcaagagcttaaaccttgggtgtgctgtgccccacaaggagacatgatctatgaccccagctggcaccatccgcctccactgataccctattattccaagatggtctttgaaacaggacagtttgacgatgctgaagattga

SEQ ID NO: 9680 - DNA, 213 bp, synthetic construct
  misc_feature 1..213: note = Synthetic polypeptide
  source 1..213: mol_type = other DNA
tattacagttcttacctgtccttgtttacagtctgtaccggctaggtgctgagcggcttgaaggctggctttgctacagctgaccactccagtcaggagagagagactgagaaggctatggatcgactagccagtcctctctgctgcttagtggccttctctgcccagttgaacagtaacctcctttggaagccttgcttggagcttccttaa

SEQ ID NO: 9681 - DNA, 1692 bp, synthetic construct
  misc_feature 1..1692: note = Synthetic polypeptide
  source 1..1692: mol_type = other DNA
gcaattccccctttccttgtttttgcttatgctgtttttatccaaccatgatgtttttcccaccacatcaccctggaccaaactttttcaaatcccatcttataagctactttctccatctaataccttttaagtatccatttccttatctcccaaccagagggtgttttaacgctgcgggcaaaacctccacctcctgatgaatttcttgactgtttccaaaagtttaaacacggatttaaccttctggccaaactgaagtctcatattcagaatcctagtgctgcagatttggttcactttttgtttactccattaaatatggtggtgcaggcaacaggaggtcctgaactagccagttcagtacttagtcccctattgaataaggacacaattgatttcttaaattatactgtcaatggtgatgaacggcagctgtggatgtcattgggaggaacttggatgaaagccagagcagagtggccaaaagaacagtttattccaccatatgttccacgattccgcaatggctgggagcccccaatgctgaactttatgggagccacaatggaacaagatctttatcaactggcagaatctgtggcaaatgtagcagaacatcagcgcaaacaggaaataaaaagattatccacagagcattccagtgtatcagagtatcatccagccgatggctatgcgttcagtagcaacatttacacaagaggatcccacctggaccaaggggaagctgctgttgcttttaagccaacttctaatcgccatatagatagaaattatgaaccactcaaaacacaacccaagaaatatgccaaatccaagtatgactttgtagcaaggaacaacagtgagctctcggttctaaaggatgatattttagagatacttgatgatcggaagcaatggtggaaagttcgaaatgcaagtggagactctggatttgtgccaaataacattttggatattgtgagacctccagaatctggattggggcgtgctgatccaccttatactcatactatacagaaacaaaggatggagtatggcccaagaccagctgatactccccctgctccatcacctcctccaacaccagctcctgttcctgttccccttcccccttccactccagcacctgttcctgtgtcaaaggtcccagcaaatataacacgtcaaaacagcagctccagtgacagtggtggcagtatcgtgcgagacagccagagacacaaacaacttccggtggaccgaaggaaatctcagatggaggaagtgcaagatgaactcatccacagactgaccattggtcggagtgccgctcagaagaaattccatgtgccacggcagaacgtgccagttatcaatatcacttacgactccacaccagaggatgtgaagacgtggttacagtcaaagggattcaaccctgtgactgtcaatagtcttggagtattaaatggtgcacaacttttctctctcaataaggatgaactgaggacagtctgccctgaaggggcgagagtctatagccaaatcactgtacaaaaagctgcattggaggatagcagtggcagctccgagttacaagaaattatgagaagacgacaggaaaaaatcagtgctgccgctagtgattcaggagtggaatcttttgatgaaggaagcagtcactaa

SEQ ID NO: 9682 - DNA, 569 bp, synthetic construct
  misc_feature 1..569: note = Synthetic polypeptide
  source 1..569: mol_type = other DNA
aatgatagtagattgagtacctgtatttactttttctccctcccgaaatcagtctagaataatagtggattgtttatatacacaaacacactctgaaggacaaacagaacaggagaagaaaaaaccacaataaaacactttaagctgaaaatccagtgggtgagagctaactgattaagcaaatgtaggaaggcagaattctgagatgggaagcagataatctcattgggtctcaatttatatcacagaacccctggaaggttccagcattggcagtaccaggtgctgcccccagagtggggtgaaggtcaaggagttgcaagtctgtttaagaagcagtcagatccccaaatctcccatgtccgtacaacttatgcctgccctcctccctctagcaaaaaaccattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaac

SEQ ID NO: 9683 - DNA, 1940 bp, synthetic construct
  misc_feature 1..1940: note = Synthetic polypeptide
  source 1..1940: mol_type = other DNA
aatgatagtagattgagtacctgtatttactttttctccctcccgaaatcagtctagaataatagtggattgtttatatacacaaacacactctgaaggacaaacagaacaggagaagaaaaaaccacaataaaacactttaagctgaaaatccagtgggtgagagctaactgattaagcaaatgtaggaaggcagaattctgagatgggaagcagataatctcattgggtctcaatttatatcacagaacccctggaaggttccagcattggcagtaccaggtgctgcccccagagtggggtgaaggtcaaggagttgcaagtctgtttaagaagcagtcagatccccaaatctcccatgtccgtacaacttatgcctgccctcctccctctagcaaaaaaccattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcagcaggatctggggccagctcacctctcacgtccccgtcatcgccaactccaccctctacatcagggatatctgcattacctccacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaaacctgtgatcacagtgctccgaagatcggctga

SEQ ID NO: 9684 - DNA, 1751 bp, synthetic construct
  misc_feature 1..1751: note = Synthetic polypeptide
  source 1..1751: mol_type = other DNA
aatgatagtagattgagtacctgtatttactttttctccctcccgaaatcagtctagaataatagtggattgtttatatacacaaacacactctgaaggacaaacagaacaggagaagaaaaaaccacaataaaacactttaagctgaaaatccagtgggtgagagctaactgattaagcaaatgtaggaaggcagaattctgagatgggaagcagataatctcattgggtctcaatttatatcacagaacccctggaaggttccagcattggcagtaccaggtgctgcccccagagtggggtgaaggtcaaggagttgcaagtctgtttaagaagcagtcagatccccaaatctcccatgtccgtacaacttatgcctgccctcctccctctagcaaaaaaccattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcagcaggatctggggccagctcacctctcacgtccccgtcatcgccaactccaccctctacatcagtagagcatgcaccattttga

SEQ ID NO: 9685 - DNA, 1946 bp, synthetic construct
  misc_feature 1..1946: note = Synthetic polypeptide
  source 1..1946: mol_type = other DNA
aatgatagtagattgagtacctgtatttactttttctccctcccgaaatcagtctagaataatagtggattgtttatatacacaaacacactctgaaggacaaacagaacaggagaagaaaaaaccacaataaaacactttaagctgaaaatccagtgggtgagagctaactgattaagcaaatgtaggaaggcagaattctgagatgggaagcagataatctcattgggtctcaatttatatcacagaacccctggaaggttccagcattggcagtaccaggtgctgcccccagagtggggtgaaggtcaaggagttgcaagtctgtttaagaagcagtcagatccccaaatctcccatgtccgtacaacttatgcctgccctcctccctctagcaaaaaaccattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcaggatctggggccagctcacctctcacgtccccgtcatcgccaactccaccctctacatcagctgccttaggtttgagtaaaagatgtaaagaaagggatatctgcattacctccacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaaacctgtga

SEQ ID NO: 9686 - DNA, 629 bp, synthetic construct
  misc_feature 1..629: note = Synthetic polypeptide
  source 1..629: mol_type = other DNA
aatgatagtagattgagtacctgtatttactttttctccctcccgaaatcagtctagaataatagtggattgtttatatacacaaacacactctgaaggacaaacagaacaggagaagaaaaaaccacaataaaacactttaagctgaaaatccagtgggtgagagctaactgattaagcaaatgtaggaaggcagaattctgagatgggaagcagataatctcattgggtctcaatttatatcacagaacccctggaaggttccagcattggcagtaccaggtgctgcccccagagtggggtgaaggtcaaggagttgcaagtctgtttaagaagcagtcagatccccaaatctcccatgtccgtacaacttatgcctgccctcctccctctagcaaaaaaccattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgcacccttacatctatcgggttacctttgccacagctaa

SEQ ID NO: 9687 - DNA, 1579 bp, synthetic construct
  misc_feature 1..1579: note = Synthetic polypeptide
  source 1..1579: mol_type = other DNA
ccttgctgcccagagtgtggtctgtggagtcacagcgttacctgggagctgatgaaaaatgcagaatctcgggcctgcttagacctgtgagtcagaagcgacggcttaggagccccagcacttctcagaacttctggatgagttttcccagaacgtcttgggtcagctcctgaatgatcctttcctctcagagaagagtgtgtcaatggaggtggaaccttccccgacgtccccggcgcctctcatccaggctgagcacagctactccctgtgcgaggagcctcgggcccagtcgcccttcacccacattaccaccagtgacagcttcaatgacgatgaggtggaaagtgagaaatggtacctgtctacagacttcccttcaacatccatcaagacagagccagttacagacgaaccacccccaggactcgttccgtctgtcactctgaccatcacagccatctccaccccgttggaaaaggaggaacctcctctggaaatgaacactggggttgattcctcgtgccagaccattattcctaaaattaagctggagcctcatgaagtggatcagtttctaaacttctctcctaaagaagccccagtggaccacctgcatttgccgcccacccctccgagcagtcacggcagtgactcagagggcagcctgagtcccaacccacgcctgcaccccttcagcctgcctcagacccacagcccctccagagctgcaccccgggccccctccgccctctccagctcccctctcctcacggctcctcataaactgcagggatcaggccctctggtcctgacagaggaggagaagaggaccctgatcgctgagggctatcccatccccaccaaattgcccctgtcaaaatcagaggagaaggccctgaagaaaattcggaggaagatcaagaataagatttctgctcaggaaagtaggagaaagaagaaagaatacatggacagcctggagaaaaaagtggagtcttgttcaactgagaacttggagcttcggaagaaggtagaggttctagagaacactaataggactctccttcagcaactccagaagcttcagactttggtgatgggcaaggtttctcgaacctgcaagttagctggcacgcagactggcacctgcctcatggttgtggtgctgtgctttgccgttgcattcggcagcttctttcaaggctacgggccctatccttctgccaccaagatggctctgcccagccagcattccctgcaggagccctacacagcctccgtggtgagatccagaaacctgctgatctacgaggaacattctcccccagaggagtcatccagcccgggctcggctggggagctggggggctgggatagaggttcctccctgctcagggtgtcagggctggagtccaggccggatgtggatcttccccatttcattatctcgaatgagaccagcctggagaagtcagtgcttttggagctgcagcagcacctggtcagcgccaaactggaggggaatgaaacactaaaagttgtagaactcgacagaagagtgaacaccactttctaa

SEQ ID NO: 9688 - DNA, 1399 bp, synthetic construct
  misc_feature 1..1399: note = Synthetic polypeptide
  source 1..1399: mol_type = other DNA
ccttgctgcccagagtgtggtctgtggagtcacagcgttacctgggagctgatgaaaaatgcagaatctcgggcctgcttagacctgtgagtcagaagcgacggcttaggagccccagcacttctcagaacttctggatgagttttcccagaacgtcttgggtcagctcctgaatgatcctttcctctcagagaagagtgtgtcaatggaggtggaaccttccccgacgtccccggcgcctctcatccaggctgagcacagctactccctgtgcgaggagcctcgggcccagtcgcccttcacccacattaccaccagtgacagcttcaatgacgatgaggtggaaagtgagaaatggtacctgtctacagacttcccttcaacatccatcaagacagagccagttacagacgaaccacccccaggactcgttccgtctgtcactctgaccatcacagccatctccaccccgttggaaaaggaggaacctcctctggaaatgaacactggggttgattcctcgtgccagaccattattcctaaaattaagctggagcctcatgaagtggatcagtttctaaacttctctcctaaagaagccccagtggaccacctgcatttgccgcccacccctccgagcagtcacggcagtgactcagagggcagcctgagtcccaacccacgcctgcaccccttcagcctgcctcagacccacagcccctccagagctgcaccccgggccccctccgccctctccagctcccctctcctcacggctcctcataaactgcagggatcaggccctctggtcctgacagaggaggagaagaggaccctgatcgctgagggctatcccatccccaccaaattgcccctgtcaaaatcagaggagaaggccctgaagaaaattcggaggaagatcaagaataagatttctgctcaggaaagtaggagaaagaagaaagaatacatggacagcctggagaaaaaagtggagtcttgttcaactgagaacttggagcttcggaagaaggtagaggttctagagaacactaataggactctccttcagcaactccagaagcttcagactttggtgatgggcaaggtttctcgaacctgcaagttagctggcacgcagactggcacctgcctcatggttgtggtgctgtgctttgccgttgcattcggcagcttctttcaaggctacgggccctatccttctgccaccaagatggctctgcccagccagcattccctgcaggagccctacacagcctccgtgggtaagacagcatgtggcaagttgggcagggtcttgttttatttccctagagctgggtttctcagtcttccaaaaggaatcttctgtgaaagtccaatgtttaaaaagtggtaa

SEQ ID NO: 9689 - DNA, 763 bp, synthetic construct
  misc_feature 1..763: note = Synthetic polypeptide
  source 1..763: mol_type = other DNA
ccttgctgcccagagtgtggtctgtggagtcacagcgttacctgggagctgatgaaaaatgcagaatctcgggcctgcttagacctgtgagtcagaagcgacggcttaggagccccagcacttctcagaacttctggatgagttttcccagaacgtcttgggtcagctcctgaatgatcctttcctctcagagaagagtgtgtcaatggaggtggaaccttccccgacgtccccggcgcctctcatccaggctgagcacagctactccctgtgcgaggagcctcgggcccagtcgcccttcacccacattaccaccagtgacagcttcaatgacgatgaggtggaaagtgagaaatggtacctgtctacagacttcccttcaacatccatcaagacagagccagttacagacgaaccacccccaggactcgttccgtctgtcactctgaccatcacagccatctccaccccgttggaaaaggaggaacctcctctggaaatgaacactggggttgattcctcgtgccagaccattattcctaaaattaagctggagcctcatgaagtggatcagtttctaaacttctctcctaaagaaggtctgtctgccctccctgtgtccctttgggttatggatatggtctctgggtctacagagagggaatatggcgagagagctgggatgagtttgtaccacagatgttgtagctggctttatgaaatagctctgttcttaaaaaataaaaattttgcttccaaataa

SEQ ID NO: 9690 - DNA, 1029 bp, synthetic construct
  misc_feature 1..1029: note = Synthetic polypeptide
  source 1..1029: mol_type = other DNA
gaggtcatgggaacccagacactttcagatgctgatggagcattcaatcggaggaaacgaaactccatctatgtcaccgtgactttgcttattgtgtccgtgttaattctcacagtgggccttgctgcaaccaccaggacccagaatgtgactgtaggaggttattaccccggagttattctcggctttggatcgttccttggaatcattggatcaaaccttattgagaacaaaaggcagatgctggtggcttctatcgtgtttatcagctttggtgtgattgcggctttttgttgtgccatagttgacggggtctttgctgccagacacattgatctgaaaccactctacgctaaccggtgccattatgttcccaagacatcacagaaggaagctgaggaggtcataagttcctcaaccaaaaattctccttccacgagggttatgaggaaccttacccaggcagctagagaggttaactgccctcacctcagccgtgaattctgcacacctcgcatccggggcaacacctgcttctgctgtgacctctacaactgtggcaaccgggtggagatcactggtgggtactacgaatacatcgatgtcagcagttgccaagatatcatccacctctaccacctgctctggtctgccaccatcctcaacattgttggcctgttcctgggcatcatcactgccgctgtccttggaggctttaaggacatgaacccaactctcccagcactgaactgttctgttgaaaatacccatccaacagtttcttactatgctcatccccaagtggcatcctacaatacctactaccatagccctcctcacctgccaccatattctgcttatgactttcagcattccggtgtctttccatcctcccctccctctggactttctgatgagccccagtctgcctctccctcacccagctacatgtggtcctcaagtgcaccgccccgttactctccaccctactatccaccttttgaaaagccaccaccttacagtccctaa

SEQ ID NO: 9691 - DNA, 957 bp, synthetic construct
  misc_feature 1..957: note = Synthetic polypeptide
  source 1..957: mol_type = other DNA
gaggtcatgggaacccagacactttcagatgctgatggagcattcaatcggaggaaacgaaactccatctatgtcaccgtgactttgcttattgtgtccgtgttaattctcacagtgggccttgctgcaaccaccaggacccagaatgtgactgtaggaggttattaccccggagttattctcggctttggatcgttccttggaatcattggatcaaaccttattgagaacaaaaggcagatgctggtggcttctatcgtgtttatcagctttggtgtgattgcggctttttgttgtgccatagttgacggggtctttgctgccagacacattgatctgaaaccactctacgctaaccggtgccattatgttcccaagacatcacagaaggaagctgaggaggttaactgccctcacctcagccgtgaattctgcacacctcgcatccggggcaacacctgcttctgctgtgacctctacaactgtggcaaccgggtggagatcactggtgggtactacgaatacatcgatgtcagcagttgccaagatatcatccacctctaccacctgctctggtctgccaccatcctcaacattgttggcctgttcctgggcatcatcactgccgctgtccttggaggctttaaggacatgaacccaactctcccagcactgaactgttctgttgaaaatacccatccaacagtttcttactatgctcatccccaagtggcatcctacaatacctactaccatagccctcctcacctgccaccatattctgcttatgactttcagcattccggtgtctttccatcctcccctccctctggactttctgatgagccccagtctgcctctccctcacccagctacatgtggtcctcaagtgcaccgccccgttactctccaccctactatccaccttttgaaaagccaccaccttacagtccctaa

SEQ ID NO: 9692 - DNA, 705 bp, synthetic construct
  misc_feature 1..705: note = Synthetic polypeptide
  source 1..705: mol_type = other DNA
gaggtcatgggaacccagacactttcagatgctgatggagcattcaatcggaggaaacgaaactccatctatgtcaccgtgactttgcttattgtgtccgtgttaattctcacagtgggccttgctgcaaccaccaggacccagaatgtgactgtaggaggttattaccccggagttattctcggctttggatcgttccttggaatcattggatcaaaccttattgagaacaaaaggcagatgctggtggcttctatcgtgtttatcagctttggtgtgattgcggctttttgttgtgccatagttgacggggtctttgctgccagacacattgatctgaaaccactctacgctaaccggtgccattatgttcccaagacatcacagaaggaagctgaggagaacccaactctcccagcactgaactgttctgttgaaaatacccatccaacagtttcttactatgctcatccccaagtggcatcctacaatacctactaccatagccctcctcacctgccaccatattctgcttatgactttcagcattccggtgtctttccatcctcccctccctctggactttctgatgagccccagtctgcctctccctcacccagctacatgtggtcctcaagtgcaccgccccgttactctccaccctactatccaccttttgaaaagccaccaccttacagtccctaa

SEQ ID NO: 9693 - DNA, 427 bp, synthetic construct
  misc_feature 1..427: note = Synthetic polypeptide
  source 1..427: mol_type = other DNA
gaggtcatgggaacccagacactttcagatgctgatggagcattcaatcggaggaaacgaaactccatctatgtcaccgtgactttgcttattgtgtccgtgttaattctcacagtgggccttgctgcaaccaccaggacccagaatgtgactgtaggaggttattaccccggagttattctcggctttggatcgttccttggaatcattggatcaaaccttattgagaacaaaaggcagatgctggtggcttctatcgtgtttatcagctttggtgtgattgcggctttttgttgtgccatagttgacggggtctttgctgccagacacattgatctgaaaccactctacgctaaccggtgccattatgttcccaagacatcacagaaggaagctgaggagaacccaactctcccagcactgaact

SEQ ID NO: 9694 - DNA, 1325 bp, synthetic construct; identical to SEQ ID NO: 7686
  misc_feature 1..1325: note = Synthetic polypeptide
  source 1..1325: mol_type = other DNA

SEQ ID NO: 9695 - DNA, 1691 bp, synthetic construct; identical to SEQ ID NO: 7687
  misc_feature 1..1691: note = Synthetic polypeptide
  source 1..1691: mol_type = other DNA

SEQ ID NO: 9696 - DNA, 1541 bp, synthetic construct; identical to SEQ ID NO: 7688
  misc_feature 1..1541: note = Synthetic polypeptide
  source 1..1541: mol_type = other DNA

SEQ ID NO: 9697 - DNA, 1420 bp, synthetic construct
  misc_feature 1..1420: note = Synthetic polypeptide
  source 1..1420: mol_type = other DNA
gaaggccaaggcgggagcatggcttgagcccaggagttcgagaccggcctgggccacatggaacttgcttgctagaaaacaaagtgcaaggcttgacaaacacaatgacttgggatggaagttatttgggaaagcgccactccgagagaatgcccagaaggattcaaagagaatacagaaggaatatgaagacaaggctggaagacctagcaagccaccctctccaaagcagaatgtgaggaagaatcttgactttgaaccactttccaccaccgcactcatcctcgaggacagaccagcaaatctcccagcaaaaccagctgaagaagctcagaagcacagacagcagtatgaagaaatggtggttcaggccaaaaagcgagagctgaaagaagcccagcgaaggaagaagcagctggaagaaagatgcagagtcgaggaaagcattggaaacgctgtgctcacctggaataatgagatcttacctaactgggaaacaatgtggtgctctagaaaagttcgagatttatggtggcagggaatccctccaagtgtgagaggcaaagtctggagcttagccattggcaacgagttaaatatcacccacgagctctttgacatctgtcttgcccgagccaaggagaggtggcggtcccttagcacaggaggctctgaagtggagaacgaagatgctggtttttcagcagcagacagagaagccagtctggagcttattaaactggacatttctagaacatttcctaatctctgcattttccagcaaggtggtccatatcatgacatgttgcacagtattttgggcgcttatacttgttaccggccagatgtgggttatgtccagggcatgtccttcatagcagcagtgttgatcttgaacttagatactgcagatgcctttattgccttttctaaccttctgaataaaccctgtcaaatggcgttttttagagtggaccatggccttatgttgacttattttgctgcatttgaagtattctttgaagaaaatttgccgaaattatttgcgcatttcaagaagaacaacctaactccagatatctacctaattgattggatctttaccttatatagtaaatctctgcccctcgacctggcctgtcgtatctgggacgtgttctgtcgcgatggggaagagttcctgttccgcacggccctgggcatcctgaagctgttcgaggacatcctgaccaagatggacttcattcacatggcccagttcctgacccggctgcccgaggacctgcccgccgaggagctgtttgcctccatcgccacgatccagatgcagagccgaaacaagaagtgggctcaggtactgactgcattgcagaaagacagccgggaaatggagaagggaagtccgtccctccgacactga

SEQ ID NO: 9698 - DNA, 1033 bp, synthetic construct
  misc_feature 1..1033: note = Synthetic polypeptide
  source 1..1033: mol_type = other DNA
gaggtcatgggaacccagacactttcagatgctgatggtgggagcattcaatcggaggaaacgaaactccatctatgtcaccgtgactttgcttattgtgtccgtgttaattctcacagtgggccttgctgcaaccaccaggacccagaatgtgactgtaggaggttattaccccggagttattctcggctttggatcgttccttggaatcattggatcaaaccttattgagaacaaaaggcagatgctggtggcttctatcgtgtttatcagctttggtgtgattgcggctttttgttgtgccatagttgacggggtctttgctgccagacacattgatctgaaaccactctacgctaaccggtgccattatgttcccaagacatcacagaaggaagctgaggaggtcataagttcctcaaccaaaaattctccttccacgagggttatgaggaaccttacccaggcagctagagaggttaactgccctcacctcagccgtgaattctgcacacctcgcatccggggcaacacctgcttctgctgtgacctctacaactgtggcaaccgggtggagatcactggtgggtactacgaatacatcgatgtcagcagttgccaagatatcatccacctctaccacctgctctggtctgccaccatcctcaacattgttggcctgttcctgggcatcatcactgccgctgtccttggaggctttaaggacatgaacccaactctcccagcactgaactgttctgttgaaaatacccatccaacagtttcttactatgctcatccccaagtggcatcctacaatacctactaccatagccctcctcacctgccaccatattctgcttatgactttcagcattccggtgtctttccatcctcccctccctctggactttctgatgagccccagtctgcctctccctcacccagctacatgtggtcctcaagtgcaccgccccgttactctccaccctactatccaccttttgaaaagccaccaccttacagtccctaa

SEQ ID NO: 9699 - DNA, 961 bp, synthetic construct
  misc_feature 1..961: note = Synthetic polypeptide
  source 1..961: mol_type = other DNA
gaggtcatgggaacccagacactttcagatgctgatggtgggagcattcaatcggaggaaacgaaactccatctatgtcaccgtgactttgcttattgtgtccgtgttaattctcacagtgggccttgctgcaaccaccaggacccagaatgtgactgtaggaggttattaccccggagttattctcggctttggatcgttccttggaatcattggatcaaaccttattgagaacaaaaggcagatgctggtggcttctatcgtgtttatcagctttggtgtgattgcggctttttgttgtgccatagttgacggggtctttgctgccagacacattgatctgaaaccactctacgctaaccggtgccattatgttcccaagacatcacagaaggaagctgaggaggttaactgccctcacctcagccgtgaattctgcacacctcgcatccggggcaacacctgcttctgctgtgacctctacaactgtggcaaccgggtggagatcactggtgggtactacgaatacatcgatgtcagcagttgccaagatatcatccacctctaccacctgctctggtctgccaccatcctcaacattgttggcctgttcctgggcatcatcactgccgctgtccttggaggctttaaggacatgaacccaactctcccagcactgaactgttctgttgaaaatacccatccaacagtttcttactatgctcatccccaagtggcatcctacaatacctactaccatagccctcctcacctgccaccatattctgcttatgactttcagcattccggtgtctttccatcctcccctccctctggactttctgatgagccccagtctgcctctccctcacccagctacatgtggtcctcaagtgcaccgccccgttactctccaccctactatccaccttttgaaaagccaccaccttacagtccctaa

SEQ ID NO: 9700 - DNA, 709 bp, synthetic construct
  misc_feature 1..709: note = Synthetic polypeptide
  source 1..709: mol_type = other DNA
gaggtcatgggaacccagacactttcagatgctgatggtgggagcattcaatcggaggaaacgaaactccatctatgtcaccgtgactttgcttattgtgtccgtgttaattctcacagtgggccttgctgcaaccaccaggacccagaatgtgactgtaggaggttattaccccggagttattctcggctttggatcgttccttggaatcattggatcaaaccttattgagaacaaaaggcagatgctggtggcttctatcgtgtttatcagctttggtgtgattgcggctttttgttgtgccatagttgacggggtctttgctgccagacacattgatctgaaaccactctacgctaaccggtgccattatgttcccaagacatcacagaaggaagctgaggagaacccaactctcccagcactgaactgttctgttgaaaatacccatccaacagtttcttactatgctcatccccaagtggcatcctacaatacctactaccatagccctcctcacctgccaccatattctgcttatgactttcagcattccggtgtctttccatcctcccctccctctggactttctgatgagccccagtctgcctctccctcacccagctacatgtggtcctcaagtgcaccgccccgttactctccaccctactatccaccttttgaaaagccaccaccttacagtccctaa

SEQ ID NO: 9701 - DNA, 431 bp, synthetic construct
  misc_feature 1..431: note = Synthetic polypeptide
  source 1..431: mol_type = other DNA
gaggtcatgggaacccagacactttcagatgctgatggtgggagcattcaatcggaggaaacgaaactccatctatgtcaccgtgactttgcttattgtgtccgtgttaattctcacagtgggccttgctgcaaccaccaggacccagaatgtgactgtaggaggttattaccccggagttattctcggctttggatcgttccttggaatcattggatcaaaccttattgagaacaaaaggcagatgctggtggcttctatcgtgtttatcagctttggtgtgattgcggctttttgttgtgccatagttgacggggtctttgctgccagacacattgatctgaaaccactctacgctaaccggtgccattatgttcccaagacatcacagaaggaagctgaggagaacccaactctcccagcactgaact

SEQ ID NO: 9702 - DNA, 1537 bp, synthetic construct
  misc_feature 1..1537: note = Synthetic polypeptide
  source 1..1537: mol_type = other DNA
atctctcgcctggaccccagcatccaaacagatccccctgccccaggtcttgttccctctaatcctccctcaactgcagccagagtgatttaattgtatcaccacccccactcctacttaaaccccccactagccaagaagctgatccaaattcctttgtatggcattaagcgccctgctttccagcctggctgacctcatctctctccggccctcccctcctgctttgttccagagccaggtggaatgaaactgcctgtctctggactgtgtttattgcattccatccgccaggaatgccacccccacccttcctctcctgccccctgaatccgttctcctgactaacttctgatccttcaagactgagcttcaacttcacctttgtgaagctttccctgaacatcttcctccagggaacgacctcttcctggtggctgtgcatgagctgggccacgcgctgggactggagcactccagcgaccccagcgccatcatggcgcccttctaccagtacatggagacgcacaacttcaagctgccccaggacgatctccagggcatccagaagatctatggacccccagccgagcctctggagcccacaaggccactccctacactccccgtccgcaggatccactcaccatcggagaggaaacacgagcgccagcccaggccccctcggccgcccctcggggaccggccatccacaccaggcaccaaacccaacatctgtgacggcaacttcaacacagtggccctcttccggggcgagatgtttgtctttaaggatcgctggttctggcgtctgcgcaataaccgagtgcaggagggctaccccatgcagatcgagcagttctggaagggcctgcctgcccgcatcgacgcagcctatgaaagggccgatgggagatttgtcttcttcaaaggtgacaagtattgggtgtttaaggaggtgacggtggagcctgggtacccccacagcctgggggagctgggcagctgtttgccccgtgaaggcattgacacagctctgcgctgggaacctgtgggcaagacctactttttcaaaggcgagcggtactggcgctacagcgaggagcggcgggccacggaccctggctaccctaagcccatcaccgtgtggaagggcatcccacaggctccccaaggagccttcatcagcaaggaaggatattacacctatttctacaagggccgggactactggaagtttgacaaccagaaactgagcgtggagccaggctacccgcgcaacatcctgcgtgactggatgggctgcaaccagaaggaggtggagcggcggaaggagcggcggctgccccaggacgacgtggacatcatggtgaccatcaacgatgtgccgggctccgtgaacgccgtggccgtggtcatcccctgcatcctgtccctctgcatcctggtgctggtctacaccatcttccagttcaagaacaagacaggccctcagcctgtcacctactataagcggccagtccaggaatgggtgtga

SEQ ID NO: 9703 - DNA, 856 bp, synthetic construct
  misc_feature 1..856: note = Synthetic polypeptide
  source 1..856: mol_type = other DNA
gccgggcgcagtggctcacgcctgtaatcctagcactttgggaggccgaggcaggcagatcacaaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagaaattgcaggtgctgcagtgtctgaaatttccgggcctttctcaacagaggatgtag

SEQ ID NO: 9704 - DNA, 1222 bp, synthetic construct
  misc_feature 1..1222: note = Synthetic polypeptide
  source 1..1222: mol_type = other DNA
gccgggcgcagtggctcacgcctgtaatcctagcactttgggaggccgaggcaggcagatcacaaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatga

SEQ ID NO: 9705 - DNA, 1072 bp, synthetic construct
  misc_feature 1..1072: note = Synthetic polypeptide
  source 1..1072: mol_type = other DNA
gccgggcgcagtggctcacgcctgtaatcctagcactttgggaggccgaggcaggcagatcacaaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatga

SEQ ID NO: 9706 - DNA, 1073 bp, synthetic construct
  misc_feature 1..1073: note = Synthetic polypeptide
  source 1..1073: mol_type = other DNA
ttagagccctagacttctttgtttgaaagatacctgctggactagcagtctttcttcctgtctctctctgtctggagggaggattgatccctgacttcctgggttggtagtttttcttcctggctctcagtcttgagtgggaaatttttcttggctctttgtgaggcctctccattctctctattttatcctgtttctctcatggaaaattctcagttggctgaaactcccttcttgaactcctactgactatatgctctaccaatctgtccacctccttcctgttggcataaatttgcagagaataatttggaacttcattgtcctctttgggaaacttatgatctccccaaactggcttctgtaaggcctctcccttcccattcctcctttgttctttaaccacttttgatcttcccttcagcgaccttgaagcctttgatatatcccccttttaactctaccaccttcatccctctgttcattctgccaggcttttcatttcccacttcaacctctcagctcccaacagtcacttgaactatagaccccttggcctccattgggggctctccttaagagactgagggatccctgagggatccccaaaagcaatgattagaggctgaaaacagaaaaaaaactttggaaacagactggatgttttgtacactcaggtgagtgttggatacacacaaacagcttcataataattcaccaaaattttagcccacaacttccctaagatgacaaagaaagtcttaaaaatgtctgctacaaatgttggtgaacagatatccttaatttgtcctatttgccagaaacgtgatttggataaaaatataaagtagaagaaagagaatccgacaacagctgctccagctgacacgtatccagctactggtcctgctgatgatgaagcccctgatgctgaaaccactgctgctgcaaccactgcaaccactgctgctcctaccactgcaaccaccgctgcttctaccactgctcgtaaagacattccagttttacccaaatgggttggggatctcccgaatggtagagtgtgtccctga

SEQ ID NO: 9707 - DNA, 2087 bp, synthetic construct
  misc_feature 1..2087: note = Synthetic polypeptide
  source 1..2087: mol_type = other DNA
tggaggaaaagttaaatattaaatctgaattcaattgaacctggacacaaacaatagtcaccaagtcctggaacaagttttgtgagtcccttgaggctttcatccagcgctgtttcagagaaatctctatttcaatctattcctatacattagttattgaaaaacaatagacaatagcaaaaacaagttgacctttttgtgttccttgagcctggttgtgaagggcccttgtgactgggcctcatgccaaacaacttgttacaaaaagagctagggtcccaggcccagccgaagcttcaggagacctatcctcatctgtgcaaggaggagtggccaactctggagcccaggctgttgcttcctggtctggtggtgaatcctccatagtctggtgagtgtagtgcccaactctggagcccaggatgttgcttcccggtctggtggtgaatcctccatagtctggagatctcagccctgctgagctgatgatgctgactataggagatgttattaaacaactgattgaagcccacgagcaggggaaagacatcgatctaaataaggtgaaaaccaagacagctgccaaatatggcctttctgcccagccccgcctggtggatatcattgctgccgtccctcctcagtatcgcaaggtcttgatgcccaagttaaaggcgaaacccatcagaactgctagtgggattgctgtcgtggctgtgatgtgcaaaccccacagatgtccacacatcagttttacaggaaatatatgtgtatactgccctggtggacctgattctgattttgagtattccacccagtcttacactggctatgagccaacctccatgagagctatccgtgccagatatgaccctttcctacagacaagacaccgaatagaacagttaaaacaacttggtcatagtgtggataaagtggagtttattgtgatgggtggaacgtttatggcccttccagaagaatacagagattattttattcgaaatttacatgatgccttatcaggacatacttccaacaatatttacgaggcagtcaagtattctgagagaagcctcacaaagtgtattggaattactattgaaaccagaccagattactgcatgaagcgacatttaagtgacatgttgacctatggctgcacaaggctggagattggggtgcagagtgtttatgaagatgtggctagagacaccaacaggggccacactgtgaaggcagtgtgtgagtcatttcacctggccaaagattccggttttaaagtggtggcccatatgatgcctgacctgccaaacgtgggactagaaagagacattgaacagttcacagagttttttgagaaccctgcttttcgtcccgatgggctgaaactctatcctaccctggtgattcgtgggaccgggctttatgagctttggaaatcaggaagatataagagttactctcctagtgacctggttgaattggtggctcggatcctagccctcgtgcctccatggactcgagtgtaccgagtacagagggatattccaatgcctttagttagctcaggagtagagcatggtaacctgagagagctggcacttgcaagaatgaaagacctcggaatacagtgtcgagatgtgagaaccagagaagttggaatccaagaaattcatcacaaagtacggccataccaggttgaattggtaaggagagattatgttgcaaatggtggctgggaaacattcttgtcatacgaagacccagatcaagacattttgattggcctcctacgattacgcaagtgttcagaagaaactttccgtttcgaattgggtggaggtgtctccatagtacgagagctgcatgtgtatgggagtgtggtccctgtgagcagccgggatcctactaaatttcagcatcagggatttggcatgctgctgatggaggaagcagaaagaatagctagagaagaacatgggtctgggaaaatcgctgtgatatcaggggtcggcaccaggaattattatagaaagatcggctacagattacaaggcccgtacatggtgaagatgctgaaataa

SEQ ID NO: 9708 - DNA, 581 bp, synthetic construct
  misc_feature 1..581: note = Synthetic polypeptide
  source 1..581: mol_type = other DNA
tggaggaaaagttaaatattaaatctgaattcaattgaacctggacacaaacaatagtcaccaagtcctggaacaagttttgtgagtcccttgaggctttcatccagcgctgtttcagagaaatctctatttcaatctattcctatacattagttattgaaaaacaatagacaatagcaaaaacaagttgacctttttgtgttccttgagcctggttgtgaagggcccttgtgactgggcctcatgccaaacaacttgttacaaaaagagctagggtcccaggcccagccgaagcttcaggagacctatcctcatctgtgcaaggaggagtggccaactctggagcccaggctgttgcttcctggtctggtggtgaatcctccatagtctggtgagtgtagtgcccaactctggagcccaggatgttgcttcccggtctggtggtgaatcctccatagtctggagatctcagccctgctgagctgatgatgctgactataggagatgttattaaacaactgattgaagcccacgagcaggggaaagacatcgatctaaataaattgctgtcgtggctgtga

SEQ ID NO: 9709 - DNA, 624 bp, synthetic construct
  misc_feature 1..624: note = Synthetic polypeptide
  source 1..624: mol_type = other DNA
gtaccagtccatggcctgttaggaagtgggctgtacagcagggggtgtacagtggggagcaagcaatgcttcatctgcatttatggccactccccatggttggcactactgcctgagctccgcctcctgtcagatcagtggtagcatgagattctcctaggagcacaaaccctattgtgaactgagcatgcaaaggatctgggctgcatgctccttatgagaatctaatgcctgatgatctgtcactgtctcctatcacccccagatgagaccatctaattacaggaaaacaagctagggcccgcactgattctaaattacggactattccctgatataaccaggccctttaaaaagtcatttgatgtcaagcatggagtggcacatcaaatttgggattttggtgattgttttccgacacctccaaattatggaaaatactgtgtgagacctaaaaagccagcacaggaggccctgataaactacagtcgacgagggaaaggtgtcctaaagcatcttcatggacggtgcgattctgaaagcaaggtttgctcatctgaggattcagaagctgatcgatactccgattatggctggggaggaccctcatcgccatttaactga

SEQ ID NO: 9710 - DNA, 294 bp, synthetic construct; identical to SEQ ID NO: 6413
  misc_feature 1..294: note = Synthetic polypeptide
  source 1..294: mol_type = other DNA

SEQ ID NO: 9711 - DNA, 462 bp, synthetic construct; identical to SEQ ID NO: 6414
  misc_feature 1..462: note = Synthetic polypeptide
  source 1..462: mol_type = other DNA

SEQ ID NO: 9712 - DNA, 522 bp, synthetic construct; identical to SEQ ID NO: 6415
  misc_feature 1..522: note = Synthetic polypeptide
  source 1..522: mol_type = other DNA

SEQ ID NO: 9713 - DNA, 414 bp, synthetic construct; identical to SEQ ID NO: 6416
  misc_feature 1..414: note = Synthetic polypeptide
  source 1..414: mol_type = other DNA

SEQ ID NO: 9714 - DNA, 405 bp, synthetic construct; identical to SEQ ID NO: 6417
  misc_feature 1..405: note = Synthetic polypeptide
  source 1..405: mol_type = other DNA

SEQ ID NO: 9715 - DNA, 2016 bp, synthetic construct
  misc_feature 1..2016: note = Synthetic polypeptide
  source 1..2016: mol_type = other DNA
tggaggaaaagttaaatattaaatctgaattcaattgaacctggacacaaacaatagtcaccaagtcctggaacaagttttgtgagtcccttgaggctttcatccagcgctgtttcagagaaatctctatttcaatctattcctatacattagttattgaaaaacaatagacaatagcaaaaacaagttgacctttttgtgttccttgagcctggttgtgaagggcccttgtgactgggcctcatgccaaacaacttgttacaaaaagagctagggtcccaggcccagccgaagcttcaggagacctatcctcatctgtgcaaggaggagtggccaactctggagcccaggctgttgcttcctggtctggtggtgaatcctccatagtctggagatctcagccctgctgagctgatgatgctgactataggagatgttattaaacaactgattgaagcccacgagcaggggaaagacatcgatctaaataaggtgaaaaccaagacagctgccaaatatggcctttctgcccagccccgcctggtggatatcattgctgccgtccctcctcagtatcgcaaggtcttgatgcccaagttaaaggcgaaacccatcagaactgctagtgggattgctgtcgtggctgtgatgtgcaaaccccacagatgtccacacatcagttttacaggaaatatatgtgtatactgccctggtggacctgattctgattttgagtattccacccagtcttacactggctatgagccaacctccatgagagctatccgtgccagatatgaccctttcctacagacaagacaccgaatagaacagttaaaacaacttggtcatagtgtggataaagtggagtttattgtgatgggtggaacgtttatggcccttccagaagaatacagagattattttattcgaaatttacatgatgccttatcaggacatacttccaacaatatttacgaggcagtcaagtattctgagagaagcctcacaaagtgtattggaattactattgaaaccagaccagattactgcatgaagcgacatttaagtgacatgttgacctatggctgcacaaggctggagattggggtgcagagtgtttatgaagatgtggctagagacaccaacaggggccacactgtgaaggcagtgtgtgagtcatttcacctggccaaagattccggttttaaagtggtggcccatatgatgcctgacctgccaaacgtgggactagaaagagacattgaacagttcacagagttttttgagaaccctgcttttcgtcccgatgggctgaaactctatcctaccctggtgattcgtgggaccgggctttatgagctttggaaatcaggaagatataagagttactctcctagtgacctggttgaattggtggctcggatcctagccctcgtgcctccatggactcgagtgtaccgagtacagagggatattccaatgcctttagttagctcaggagtagagcatggtaacctgagagagctggcacttgcaagaatgaaagacctcggaatacagtgtcgagatgtgagaaccagagaagttggaatccaagaaattcatcacaaagtacggccataccaggttgaattggtaaggagagattatgttgcaaatggtggctgggaaacattcttgtcatacgaagacccagatcaagacattttgattggcctcctacgattacgcaagtgttcagaagaaactttccgtttcgaattgggtggaggtgtctccatagtacgagagctgcatgtgtatgggagtgtggtccctgtgagcagccgggatcctactaaatttcagcatcagggatttggcatgctgctgatggaggaagcagaaagaatagctagagaagaacatgggtctgggaaaatcgctgtgatatcaggggtcggcaccaggaattattatagaaagatcggctacagattacaaggcccgtacatggtgaagatgctgaaataa

SEQ ID NO: 9716 - DNA, 510 bp, synthetic construct
  misc_feature 1..510: note = Synthetic polypeptide
  source 1..510: mol_type = other DNA
tggaggaaaagttaaatattaaatctgaattcaattgaacctggacacaaacaatagtcaccaagtcctggaacaagttttgtgagtcccttgaggctttcatccagcgctgtttcagagaaatctctatttcaatctattcctatacattagttattgaaaaacaatagacaatagcaaaaacaagttgacctttttgtgttccttgagcctggttgtgaagggcccttgtgactgggcctcatgccaaacaacttgttacaaaaagagctagggtcccaggcccagccgaagcttcaggagacctatcctcatctgtgcaaggaggagtggccaactctggagcccaggctgttgcttcctggtctggtggtgaatcctccatagtctggagatctcagccctgctgagctgatgatgctgactataggagatgttattaaacaactgattgaagcccacgagcaggggaaagacatcgatctaaataaattgctgtcgtggctgtga

SEQ ID NO: 9717 - DNA, 613 bp, synthetic construct
  misc_feature 1..613: note = Synthetic polypeptide
  source 1..613: mol_type = other DNA
cagtatcactgtttgattaagtaaggggggcacctgccttgggccccacaatttagagatacctgctctggtccttctgctgcctgcacccctccccacagagtgaggaatccatagggctaagaatatgcctacctagatcccttctgttgcttgcttgggtacctgaaacccagaattctctgtccacatggtccaaaatgtatttccagggtctccatgcatctttttctgggctccattcttttgagggcgggtcccgtctctgatatgtatacctctaggcctgagagtttgctgatggcagctgtttctgagggcatgtggacattacccaaagtgtccacactcgtatgtgagacctcttgaggtgcagggtggatggggttggaaaagcagggaggttttctgagggctaggcacctggggctggctttcctcatgtcactactttccagtgcagaatcctgaggagtctggagaattctaagtttgaatctgttctcctggtcgctgtgaaagtatatttgttaaggaattcaaccttattgatagaagagaacttgcaccactccaagaactgattgaaaaactcacctcaaaagacagataa

SEQ ID NO: 9718 - DNA, 820 bp, synthetic construct
  misc_feature 1..820: note = Synthetic polypeptide
  source 1..820: mol_type = other DNA
tgtttcagggcgctgggtctggatccagacagcatgggtgcagatctctgttccactacttactattttgggagaccctggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctga

SEQ ID NO: 9719 - DNA, 307 bp, synthetic construct
  misc_feature 1..307: note = Synthetic polypeptide
  source 1..307: mol_type = other DNA
tgtttcagggcgctgggtctggatccagacagcatgggtgcagatctctgttccactacttactattttgggagaccctggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggccaggtga

SEQ ID NO: 9720 - DNA, 622 bp, synthetic construct
  misc_feature 1..622: note = Synthetic polypeptide
  source 1..622: mol_type = other DNA
tgtttcagggcgctgggtctggatccagacagcatgggtgcagatctctgttccactacttactattttgggagaccctggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgtgggtcattctgatcaccgaactgaccatgccagccctgccgatggtcctccatggctccctagtgccctggagaggaggtgtctag

SEQ ID NO: 9721 - DNA, 718 bp, synthetic construct
  misc_feature 1..718: note = Synthetic polypeptide
  source 1..718: mol_type = other DNA
tgtttcagggcgctgggtctggatccagacagcatgggtgcagatctctgttccactacttactattttgggagaccctggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcggtgagtcatccctactcccaagatcttgaggggaaaggtgagtggggaccttaa

SEQ ID NO: 9722 - DNA, 409 bp, synthetic construct
  misc_feature 1..409: note = Synthetic polypeptide
  source 1..409: mol_type = other DNA
tgtttcagggcgctgggtctggatccagacagcatgggtgcagatctctgttccactacttactattttgggagaccctggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccacattgaaccagaggagttcttga

SEQ ID NO: 9723 - DNA, 691 bp, synthetic construct
  misc_feature 1..691: note = Synthetic polypeptide
  source 1..691: mol_type = other DNA
tgtttcagggcgctgggtctggatccagacagcatgggtgcagatctctgttccactacttactattttgggagaccctggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctga

SEQ ID NO: 9724 - DNA, 751 bp, synthetic construct
  misc_feature 1..751: note = Synthetic polypeptide
  source 1..751: mol_type = other DNA
tgtttcagggcgctgggtctggatccagacagcatgggtgcagatctctgttccactacttactattttgggagaccctggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgtgggtcattctgatcaccgaactgaccatgccagccctgccgatggtcctccatggctccctagtgccctggagaggaggtgtctag

SEQ ID NO: 9725 - DNA, 838 bp, synthetic construct
  misc_feature 1..838: note = Synthetic polypeptide
  source 1..838: mol_type = other DNA
tgtttcagggcgctgggtctggatccagacagcatgggtgcagatctctgttccactacttactattttgggagaccctggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagtgtacgcctgggccagatgtcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctga

SEQ ID NO: 9726 - DNA, 2105 bp, synthetic construct
  misc_feature 1..2105: note = Synthetic polypeptide
  source 1..2105: mol_type = other DNA
ggctgggtgcagtggctcatgcctgtactcccagcactttgggaggctgaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccagggaagccatctttgacaccctttgcaccgatgacagctctgaagaggcaaagacactcacaatggacatattgacattggctcacacctccacagaagctaagggcctgtcctcagagagcagcgcctcttccgacagcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcctccatccagtcatcaccccgtcacgggcctcagagagcagcgcctcttccgacggcccccatccagtcatcaccccgtcacgggcctcagagagcagcgcctcttccgacggcccccatccagtcatcaccccctcatggtccccgggatctgacgtcactctcctcgctgaagccctggtgactgtcacaaacatcgaggttattaattgcagcatcacagaaatagaaacaacgacttccagcatccctggggcctcagacacagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctgatgccacggttgggaccccactccccactaacagcgccacagaaagagaagtgacagcacccggggccacgaccctcagtggagctctggtcacagttagcaggaatccccttgaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagctccaccgggaactccacgcccacgcgcctcacttccaggtctccttactgcgtgtcaggagaggctaa

SEQ ID NO: 9727 - DNA, 1592 bp, synthetic construct
  misc_feature 1..1592: note = Synthetic polypeptide
  source 1..1592: mol_type = other DNA
ggctgggtgcagtggctcatgcctgtactcccagcactttgggaggctgaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccagggaagccatctttgacaccctttgcaccgatgacagctctgaagaggcaaagacactcacaatggacatattgacattggctcacacctccacagaagctaagggcctgtcctcagagagcagcgcctcttccgacagcccccatccagtcatcaccccgtcacgggcctcagagagcagcgcctcttccgacggcccccatccagtcatcaccccgtcacgggcctcagagagcagcgcctcttccgacggcccccatccagtcatcaccccctcatggtccccgggatctgacgtcactctcctcgctgaagccctggtgactgtcacaaacatcgaggttattaattgcagcatcacagaaatagaaacaacgacttccagcatccctggggcctcagacacagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctgatgccacggttgggaccccactccccactaacagcgccacagaaagagaagtgacagcacccggggccacgaccctcagtggagctctggtcacagttagcaggaatccccttgaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagctccaccgggaactccacgcccacgcgcctcacttccaggtctccttactgcgtgtcaggagaggctaa

SEQ ID NO: 9728 - DNA, 2147 bp, synthetic construct
  misc_feature 1..2147: note = Synthetic polypeptide
  source 1..2147: mol_type = other DNA
ggctgggtgcagtggctcatgcctgtactcccagcactttgggaggctgaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccagggaagccatctttgacaccctttgcaccgatgacagctctgaagaggcaaagacactcacaatggacatattgacattggctcacacctccacagaagctaagggcctgtcctcagagagcagcgcctcttccgacagcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcctccatccagtcatcaccccgtcacgggcctcagagagcagcgcctcttccgacggcccccatccagtcatcaccccgtcacgggcctcagagagcagcgcctcttccgacggcccccatccagtcatcaccccctcatggtccccgggatctgacgtcactctcctcgctgaagccctggtgactgtcacaaacatcgaggttattaattgcagcatcacagaaatagaaacaacgacttccagcatccctggggcctcagacacagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctgatgccacggttgggaccccactccccactaacagcgccacagaaagagaagtgacagcacccggggccacgaccctcagtggagctctggtcacagttagcaggaatccccttgaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagatggaaaggagcctggctctgtcacccaggctggagtgcagtggcgtgatctcagctcactgcaagctccacctcttgggttcacgtgattctcctgcctcagcctcctga

SEQ ID NO: 9729 - DNA, 352 bp, synthetic construct
  misc_feature 1..352: note = Synthetic polypeptide
  source 1..352: mol_type = other DNA
caaaggagaaggaatgagccaggcggctaccatatgcaagtccaattttaagtacatgtactggacgatgctgcagcagctcactcaccactctgtcaacggctgcaacctgcggccgggggacctcctggcttctgggaccatcagcgggccggagccagaaaacttcggctccatgttggaactgtcgtggaagggaacgaagcccatagacctggggaatggtcagaccaggaagtttctgctggacggggatgaagtcatcataacagggtactgccagggggatggttaccgcatcggctttggccagtgtgctggaaaagtgctgcctgctctcctgccatcatga

SEQ ID NO: 9730 - DNA, 175 bp, synthetic construct
  misc_feature 1..175: note = Synthetic polypeptide
  source 1..175: mol_type = other DNA
caaaggagaaggaatgagccaggcggctaccatatgcaagtccaattttaagtacatgtactggacgatgctgcagcagctcactcaccactctgtcaacggctgcaacctgcggccgggggacctcctggcttctgggaccatcagcgggccggtgagtatctggctgcactga

SEQ ID NO: 9731 - DNA, 1077 bp, synthetic construct
  misc_feature 1..1077: note = Synthetic polypeptide
  source 1..1077: mol_type = other DNA
tgatatggtttggctctgtgtccccactgaaaaatcatgtcaaattgtaattcccagtgttggaggaggggcctagtgggaagagattgaatcacgggggctgactttcctcttactgttgtcataatagaattctcataagatctggttgtttgaaagcatgtagcacctccaccttctttctctctctctctctgcctctctctctctctctctctctacctccccctctcctgccagccaagtgaagacatgcttgcttccccttcaccttcctccatcatggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 9732 - DNA, 717 bp, synthetic construct
  misc_feature 1..717: note = Synthetic polypeptide
  source 1..717: mol_type = other DNA
tgatatggtttggctctgtgtccccactgaaaaatcatgtcaaattgtaattcccagtgttggaggaggggcctagtgggaagagattgaatcacgggggctgactttcctcttactgttgtcataatagaattctcataagatctggttgtttgaaagcatgtagcacctccaccttctttctctctctctctctgcctctctctctctctctctctctacctccccctctcctgccagccaagtgaagacatgcttgcttccccttcaccttcctccatcatggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccagcctagagataattccatcttttccttgagtcctgactggtga

SEQ ID NO: 9733 - DNA, 949 bp, synthetic construct
  misc_feature 1..949: note = Synthetic polypeptide
  source 1..949: mol_type = other DNA
tgatatggtttggctctgtgtccccactgaaaaatcatgtcaaattgtaattcccagtgttggaggaggggcctagtgggaagagattgaatcacgggggctgactttcctcttactgttgtcataatagaattctcataagatctggttgtttgaaagcatgtagcacctccaccttctttctctctctctctctgcctctctctctctctctctctctacctccccctctcctgccagccaagtgaagacatgcttgcttccccttcaccttcctccatcatggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgc

SEQ ID NO: 9734 - DNA, 279 bp, synthetic construct
  misc_feature 1..279: note = Synthetic polypeptide
  source 1..279: mol_type = other DNA
gcaatggctaccgactccttcgaccacaaaaagttcttccaaatggtcggcctgaagaaaaagagtgcggatgatgtgaagaaggtgtttcacatgctggacaaggacaaaagtggcttcatcgaggaggatgagctgggattcatcctaaaaggcttctccccagatgccagagacctgtctgctaaagaaaccaagatgctgatggctgctggagacaaagatggggacggcaaaattggggttgacgaattctccactctggtggctgaaagctaa

SEQ ID NO: 9735 - DNA, 270 bp, synthetic construct
  misc_feature 1..270: note = Synthetic polypeptide
  source 1..270: mol_type = other DNA
gcaatggctaccgactccttcgaccacaaaaagttcttccaaatggtcggcctgaagaaaaagagtgcggatgatgtgaagaaggtgtttcacatgctggacaaggacaaaagtggcttcatcgaggaggatgagctgggattcatcctaaaaggcttctccccagatgccagagacctgtctgctaaagaaaccaagatgctgatggctgctggagacaaagatggggacggcaaaattggggttgacgatccagcagatgttgactga

SEQ ID NO: 9736 - DNA, 250 bp, synthetic construct
  misc_feature 1..250: note = Synthetic polypeptide
  source 1..250: mol_type = other DNA
gcaatggctaccgactccttcgaccacaaaaagttcttccaaatggtcggcctgaagaaaaagagtgcggatgatgtgaagaaggtgtttcacatgctggacaaggacaaaagtggcttcatcgaggaggatgagctgggattcatcctaaaaggcttctccccagatgccagagacctgtctgctaaagaaaccaagatgctgatggctgctggagacaaagatggggacggcaaaattggggttgacg

SEQ ID NO: 9737 - DNA, 396 bp, synthetic construct; identical to SEQ ID NO: 6456
  misc_feature 1..396: note = Synthetic polypeptide
  source 1..396: mol_type = other DNA

SEQ ID NO: 9738 - DNA, 564 bp, synthetic construct; identical to SEQ ID NO: 6457
  misc_feature 1..564: note = Synthetic polypeptide
  source 1..564: mol_type = other DNA

SEQ ID NO: 9739 - DNA, 624 bp, synthetic construct; identical to SEQ ID NO: 6458
  misc_feature 1..624: note = Synthetic polypeptide
  source 1..624: mol_type = other DNA

SEQ ID NO: 9740 - DNA, 516 bp, synthetic construct; identical to SEQ ID NO: 6459
  misc_feature 1..516: note = Synthetic polypeptide
  source 1..516: mol_type = other DNA

SEQ ID NO: 9741 - DNA, 507 bp, synthetic construct; identical to SEQ ID NO: 6460
  misc_feature 1..507: note = Synthetic polypeptide
  source 1..507: mol_type = other DNA

SEQ ID NO: 9742 - DNA, 116 bp, synthetic construct
  misc_feature 1..116: note = Synthetic polypeptide
  source 1..116: mol_type = other DNA
aggagaaccctgcagtgtccagctaagctgatgacttgaagataaatctgcctaaccctgggatgaagtatctgtgaactattttgacagcagatgaggaattttggggaaattaa

SEQ ID NO: 9743 - DNA, 877 bp, synthetic construct
  misc_feature 1..877: note = Synthetic polypeptide
  source 1..877: mol_type = other DNA
aggaaccacacagtttggcggggggtgcccaggctttggagtcagaccaacctggatttgaactctggcttgactgcttacgagccatgagaatctagtgaagctgaacctgccctcggacatgcacatccagggcctccagtctcgctacagtgccacgcagctgcacctgcactgggggaacccgaatgacccgcacggctctgagcacaccgtcagcggacagcacttcgccgccgagctgcacattgtccattataactcagacctttatcctgacgccagcactgccagcaacaagtcagaaggcctcgctgtcctggctgttctcattgagatgggctccttcaatccgtcctatgacaagatcttcagtcaccttcaacatgtaaagtacaaaggccaggaagcattcgtcccgggattcaacattgaagagctgcttccggagaggaccgctgaatattaccgctaccgggggtccctgaccacacccccttgcaaccccactgtgctctggacagttttccgaaaccccgtgcaaatttcccaggagcagctgctggctttggagacagccctgtactgcacacacatggacgacccttcccccagagaaatgatcaacaacttccggcaggtccagaagttcgatgagaggctggtatacacctccttctcccaagtgcaagtctgtactgcggcaggactgagtctgggcatcatcctctcactggccctggctggcattcttggcatctgtattgtggtggtggtgtccatttggcttttcagaaggaagagtatcaaaaaaggtgataacaagggagtcatttacaagccagccaccaagatggagactgaggcccacgcttga

SEQ ID NO: 9744 - DNA, 844 bp, synthetic construct
  misc_feature 1..844: note = Synthetic polypeptide
  source 1..844: mol_type = other DNA
aggaaccacacagtttggcggggggtgcccaggctttggagtcagaccaacctggatttgaactctggcttgactgcttacgagccatgagaatctagtgaagctgaacctgccctcggacatgcacatccagggcctccagtctcgctacagtgccacgcagctgcacctgcactgggggaacccgaatgacccgcacggctctgagcacaccgtcagcggacagcacttcgccgccgagctgcacattgtccattataactcagacctttatcctgacgccagcactgccagcaacaagtcagaaggcctcgctgtcctggctgttctcattgagatgggctccttcaatccgtcctatgacaagatcttcagtcaccttcaacatgtaaagtacaaaggccaggaagcattcgtcccgggattcaacattgaagagctgcttccggagaggaccgctgaatattaccgctaccgggggtccctgaccacacccccttgcaaccccactgtgctctggacagttttccgaaaccccgtgcaaatttcccaggagcagctgctggctttggagacagccctgtactgcacacacatggacgacccttcccccagagaaatgatcaacaacttccggcaggtccagaagttcgatgagaggctggtatacacctccttctcccaaggcatcatcctctcactggccctggctggcattcttggcatctgtattgtggtggtggtgtccatttggcttttcagaaggaagagtatcaaaaaaggtgataacaagggagtcatttacaagccagccaccaagatggagactgaggcccacgcttga

SEQ ID NO: 9745 - DNA, 1325 bp, synthetic construct
  misc_feature 1..1325: note = Synthetic polypeptide
  source 1..1325: mol_type = other DNA
ggccaggcatggtggctcatgcctgtaattctagcactttgggaggccaaagtgggcggatcacttgaggtcgggagttcaagaccagcctggccaacatggcgaaaccccatctctactaaaaatacaaaaatttgctgggcgtggtggcgcacgcctgtaatcccagctactcgggaggctgaggcaggagagtcacttgaacccaggaggtggaggctgcggtgagaggagatcatgctcctacctgggtctctcggctgctgggggcattccacaacccaaaacaggtgaccagaggttttactggtggtgttcagacagtaactttaattccaggagatggtattggcccagaaatttcagctgcagttatgaagatttttgatgctgccaaagcacctattcagtgggaggagcggaacgtcactgccattcaaggacctggaggaaagtggatgatcccttcagaggctaaagagtccatggataagaacaagatgggcttgaaaggccctttgaagaccccaatagcagccggtcacccatctatgaatttactgctgcgcaaaacatttgacctttacgcgaatgtccgaccatgtgtctctatcgaaggctataaaaccccttacaccgatgtaaatattgtgaccattcgagagaacacagaaggagaatacagtggaattgagcatgtgattgttgatggagtcgtgcagagtatcaagctcatcaccgagggggcgagcaagcgcattgctgagtttgcctttgagtatgcccggaacaaccaccggagcaacgtcacggcggtgcacaaagccaacatcatgcggatgtcagatgggctttttctacaaaaatgcagggaagttgcagaaagctgtaaagatattaaatttaatgagatgtaccttgatacagtatgtttgaatatggtacaagatccttcccaatttgatgttcttgttatgccaaatttgtatggagacatccttagtgacttgtgtgcaggattgatcggaggtctcggtgtgacaccaagtggcaacattggagccaatggggttgcaatttttgagtcggttcatgggacggctccagacattgcaggcaaggacatggcgaatcccacagccctcctgctcagtgccgtgatgatgctgcgccacatgggactttttgaccatgctgcaagaattgaggctgcgtgttttgctacaattaaggacggaaagagcttgacaaaagatttgggaggcaatgcaaaatgctcagacttcacagaggaaatctgtcgccgagtaaaagatttagattaa

SEQ ID NO: 9746 - DNA, 407 bp, synthetic construct
  misc_feature 1..407: note = Synthetic polypeptide
  source 1..407: mol_type = other DNA
ggccaggcatggtggctcatgcctgtaattctagcactttgggaggccaaagtgggcggatcacttgaggtcgggagttcaagaccagcctggccaacatggcgaaaccccatctctactaaaaatacaaaaatttgctgggcgtggtggcgcacgcctgtaatcccagctactcgggaggctgaggcaggagagtcacttgaacccaggaggtggaggctgcggtgagaggagatcatgctcctacctgggtctctcggctgctgggggcattccacaacccaaaacaggtgaccagaggttttactggtggtgttcagacagtaactttaattccaggagatggtattggcccagaaatttcagctgcagttatgaagatttttgatgctgccaaagccctttga

SEQ ID NO: 9747 - DNA, 1220 bp, synthetic construct
  misc_feature 1..1220: note = Synthetic polypeptide
  source 1..1220: mol_type = other DNA
ggccaggcatggtggctcatgcctgtaattctagcactttgggaggccaaagtgggcggatcacttgaggtcgggagttcaagaccagcctggccaacatggcgaaaccccatctctactaaaaatacaaaaatttgctgggcgtggtggcgcacgcctgtaatcccagctactcgggaggctgaggcaggagagtcacttgaacccaggaggtggaggctgcggtgagaggagatcatgctcctacctgggtctctcggctgctgggggcattccacaacccaaaacaggtgaccagaggttttactggtggtgttcagacagtaactttaattccaggagatggtattggcccagaaatttcagctgcagttatgaagatttttgatgctgccaaagcacctattcagtgggaggagcggaacgtcactgccattcaaggacctggaggaaagtggatgatcccttcagaggctaaagagtccatggataagaacaagatgggcttgaaaggctataaaaccccttacaccgatgtaaatattgtgaccattcgagagaacacagaaggagaatacagtggaattgagcatgtgattgttgatggagtcgtgcagagtatcaagctcatcaccgagggggcgagcaagcgcattgctgagtttgcctttgagtatgcccggaacaaccaccggagcaacgtcacggcggtgcacaaagccaacatcatgcggatgtcagatgggctttttctacaaaaatgcagggaagttgcagaaagctgtaaagatattaaatttaatgagatgtaccttgatacagtatgtttgaatatggtacaagatccttcccaatttgatgttcttgttatgccaaatttgtatggagacatccttagtgacttgtgtgcaggattgatcggaggtctcggtgtgacaccaagtggcaacattggagccaatggggttgcaatttttgagtcggttcatgggacggctccagacattgcaggcaaggacatggcgaatcccacagccctcctgctcagtgccgtgatgatgctgcgccacatgggactttttgaccatgctgcaagaattgaggctgcgtgttttgctacaattaaggacggaaagagcttgacaaaagatttgggaggcaatgcaaaatgctcagacttcacagaggaaatctgtcgccgagtaaaagatttagattaa

SEQ ID NO: 9748 - DNA, 338 bp, synthetic construct
  misc_feature 1..338: note = Synthetic polypeptide
  source 1..338: mol_type = other DNA
ggccaggcatggtggctcatgcctgtaattctagcactttgggaggccaaagtgggcggatcacttgaggtcgggagttcaagaccagcctggccaacatggcgaaaccccatctctactaaaaatacaaaaatttgctgggcgtggtggcgcacgcctgtaatcccagctactcgggaggctgaggcaggagagtcacttgaacccaggaggtggaggctgcggtgagaggagatcatgctcctacctgggtctctcggctgctgggggcattccacaacccaaaacaggtgaccagaggttttactggtggtatcaactttgccaagcttatgtag

SEQ ID NO: 9749 - DNA, 751 bp, synthetic construct
  misc_feature 1..751: note = Synthetic polypeptide
  source 1..751: mol_type = other DNA
ggccaggcatggtggctcatgcctgtaattctagcactttgggaggccaaagtgggcggatcacttgaggtcgggagttcaagaccagcctggccaacatggcgaaaccccatctctactaaaaatacaaaaatttgctgggcgtggtggcgcacgcctgtaatcccagctactcgggaggctgaggcaggagagtcacttgaacccaggaggtggaggctgcggtgagaggagatcatgctcctacctgggtctctcggctgctgggggcattccacaacccaaaacaggtgaccagaggttttactggtggtgcacctattcagtgggaggagcggaacgtcactgccattcaaggacctggaggaaagtggatgatcccttcagaggctaaagagtccatggataagaacaagatgggcttgaaaggccctttgaagaccccaatagcagccggtcacccatctatgaatttactgctgcgcaaaacatttgacctttacgcgaatgtccgaccatgtgtctctatcgaaggctataaaaccccttacaccgatgtaaatattgtgaccattcgagagaacacagaaggagaatacagtggaattgagcatgtgattgttgatggagtcgtgcagagtatcaagctcatcaccgagggggcgagcaagcgcattgctgagtttgcctttgagtatgcccggaacaaccaccggagcaacgtcacggcggtgcacaaagccaacatcat

SEQ ID NO: 9750 - DNA, 353 bp, synthetic construct
  misc_feature 1..353: note = Synthetic polypeptide
  source 1..353: mol_type = other DNA
ggccaggcatggtggctcatgcctgtaattctagcactttgggaggccaaagtgggcggatcacttgaggtcgggagttcaagaccagcctggccaacatggcgaaaccccatctctactaaaaatacaaaaatttgctgggcgtggtggcgcacgcctgtaatcccagctactcgggaggctgaggcaggagagtcacttgaacccaggaggtggaggctgcggtgagaggagatcatgctcctacctgggtctctcggctgctgggggcattccacaacccaaaacaggtgaccagaggttttactggtggtgagatggtattggcccagaaatttcagctgcagttatga

SEQ ID NO: 9751 - DNA, 473 bp, synthetic construct
  misc_feature 1..473: note = Synthetic polypeptide
  source 1..473: mol_type = other DNA
agacaggcctgagcagaatctggtttacctggctctgggatcttgagaagataatttcatctcttggatcctagatctacccccccatcaacgtgctcccttccctgtcgcggctgatgaagtcagccattggggaaggcatgacaagaaaggaccatggagatgtctccaaccagctgtacgcctgctatgccatcgggaaggacgtgcaggccatgaaggcagtagttggggaggaggcgctcacctctgaggacctgctctacctggaattcctgcagaagtttgagaagaacttcatcaatcagggcccctacgagaaccgctcggtgttcgagtcgctggacctgggctggaagctgctgcgcatcttccccaaggagatgctgaagcgcattccgcaggccgtgatcgacgagttctattcccgcgagggggcgctgcaggacctcgcgcctgacactgcgctctag

SEQ ID NO: 9752 - DNA, 1477 bp, synthetic construct
  misc_feature 1..1477: note = Synthetic polypeptide
  source 1..1477: mol_type = other DNA
tgaaataatacagaaaaagtactcaagacagtccctgattcatagtaagttccagaatgtggttagaaagaagttttacagagatgctttattgcttcgaatcccttcatgtttatatcaagatgaaagttaccatgtagcagttactgataataaatttaggaggccatggacgagagtctcagctgtttcagttccgggaatgacagatacctcagtcttggaccaatggaaagcaagtttctttgtggaggatttccttgagaaaaaaacaattacaagaatggtgacccagattaattgtgaatttgaggaagttgttccaagttcaaatccagactcccaaattgaagtagaggaggtcagtttatacacccacatggactacaatgaagtctttacccctgtcagttgtttagaaaaatgttcagcacttcaaaaccagaaccaagatttatttattgatgataaaggaatactttttgtaagtagtagaaaacacctaccaactttgcctactctcttgagtagactaaaactgtttttggtaaaggatcctcttttagatttcaaaggacagatcttcacagaagctaatttttccagggaatgtttctctcttcaagaaactttggaagcttttgtgaaagaagatttttgtatggataaagtgaacttttgtcaagagaaactagaagatacaatatgtttaaatgagccgtcaagttttcttattgagtatgaattcttaatacctccaagcctcaaaccagaaattgatattccatcactctcagaactgaaggagttattaaacccagtgccagaaataataaactatgtagatgaaaaggaaaagctttttgaaagagatcttactaacaagcatggaattgaggatatcggggatataaaattcagctccacagagattttgaccattcaaagccagagtgaaccagaagagtgcagtaaaccaggagagttagaaatgccactaactcctctattcctaacatgccaacattcttcagtgaattcattacgtacagaacttcagacatttccattatctccggtttgtaaaattaatttgcttactgctgaagaatcagctaatgaatactacatgatgtggcaattagaaagatgtagaagccctttgaacccatttttgcttacagtgccaagaattcaagagccccacagccaatattcagttacagatttgaaaaagatattttctgttaaagaagaaagccttgtgattaatctggaaaaggcagagtggtggaaacaagcaggactaaatctgaaaatgatggaaacattggaacatctgaatacatatttatgtcatgataatttgtcttctaatgacactaaaattgagatatttttgcctacgaaagtgcttcaattagaatgtaagtacatcacagtaaatattagttatgtaaacattttcagaatgtga

SEQ ID NO: 9753 - DNA, 795 bp, synthetic construct
  misc_feature 1..795: note = Synthetic polypeptide
  source 1..795: mol_type = other DNA
ggccgggcatggtggctcatccctgtaatcccagtactttgggaggctgaagcaggcagatcacttaaagtcaagagttcgagatgagcctgggcacagaccatcatgaaggctcgtttaaagggagcacagacaggtcgaaacctcctgaagaaaaaatctgatgccttaactcttcgatttcgacagatcctaaagaagataatagagactaaaatgttgatgggcgaagtgatgagagaagctgccttttcactagctgaagccaagttcacagcaggtgacttcagcactacagttatccaaaatgtcaataaagcgcaagtgaagattcgagcgaagaaagataatgtagcaggtgttactttgccagtatttgaacattaccatgaaggaactgacagttatgaactgactggtttagccagaggtggggaacagttggctaaattaaagaggaattatgccaaagcagtggaactactggtggaactagcttctctgcagacttcttttgttactttggatgaagctattaagataaccaacaggcgtgtaaatgccattgaacatgtcatcattccccggattgaacgtactcttgcttatatcatcacagagctggatgagagagagcgagaagagttctataggttaaagaaaatacaagagaagaaaaagattctaaaggaaaaatctgagaaggacttggagcaaaggagagcagctggagaggtgttggagcctgctaatcttctggctgaagagaaggacgaggatcttctatttgaataa

SEQ ID NO: 9754 - DNA, 498 bp, synthetic construct
  misc_feature 1..498: note = Synthetic polypeptide
  source 1..498: mol_type = other DNA
ggccgggcatggtggctcatccctgtaatcccagtactttgggaggctgaagcaggcagatcacttaaagtcaagagttcgagatgagcctgggcacagaccatcatgaaggctcgtttaaagggagcacagacaggtcgaaacctcctgaagaaaaaatctgatgccttaactcttcgatttcgacagatcctaaagaagataatagagacttcttttgttactttggatgaagctattaagataaccaacaggcgtgtaaatgccattgaacatgtcatcattccccggattgaacgtactcttgcttatatcatcacagagctggatgagagagagcgagaagagttctataggttaaagaaaatacaagagaagaaaaagattctaaaggaaaaatctgagaaggacttggagcaaaggagagcagctggagaggtgttggagcctgctaatcttctggctgaagagaaggacgaggatcttctatttgaataa

SEQ ID NO: 9755 - DNA, 591 bp, synthetic construct
  misc_feature 1..591: note = Synthetic polypeptide
  source 1..591: mol_type = other DNA
ggccgggcatggtggctcatccctgtaatcccagtactttgggaggctgaagcaggcagatcacttaaagtcaagagttcgagatgagcctgggcacagaccatcatgaaggctcgtttaaagggagcacagacaggtcgaaacctcctgaagaaaaaatctgatgccttaactcttcgatttcgacagatcctaaagaagataatagagactaaaatgttgatgggcgaagtgatgagagaagctgccttttcactagctgaagccaagttcacagcaggtgacttcagcactacagttatccaaaatgtcaataaagcgcaagtgaagattcgagcgaagaaagataatgtagcaggtgttactttgccagtatttgaacattaccatgaaggaactgacagttatgaactgactggtttagccagaggtggggaacagttggctaaattaaagaggaattatgccaaagcagtggaactactggtggaactagcttctctgcagtcatcattccccggattgaacgtactcttgcttatatcatcacagagctggatgagagagagcgagaagagttctataggttaa

SEQ ID NO: 9756 - DNA, 312 bp, synthetic construct
  misc_feature 1..312: note = Synthetic polypeptide
  source 1..312: mol_type = other DNA
ggccgggcatggtggctcatccctgtaatcccagtactttgggaggctgaagcaggcagatcacttaaagtcaagagttcgagatgagcctgggcacagaccatcatgaaggctcgtttaaagggagcacagacaggtcgaaacctcctgaagaaaaaatctgatgccttaactcttcgatttcgacagatcctaaagaagataatagagactaaaatgttgatgggcgaagtgatgagagaagctgccttttcactagctgaagccaagttcacagcaggtgacttcaggtgttactttgccagtatttga

SEQ ID NO: 9757 - DNA, 269 bp, synthetic construct
  misc_feature 1..269: note = Synthetic polypeptide
  source 1..269: mol_type = other DNA
ggccgggcatggtggctcatccctgtaatcccagtactttgggaggctgaagcaggcagatcacttaaagtcaagagttcgagatgagcctgggcacagaccatcatgaaggctcgtttaaagggagcacagacaggtcgaaacctcctgaagaaaaaatctgatgccttaactcttcgatttcgacagatcctaaagaagataatagagactaaaatgttgatgggcgaagtgatgagagaagctgccttttcactagctgaagccaa

SEQ ID NO: 9758 - DNA, 317 bp, synthetic construct
  misc_feature 1..317: note = Synthetic polypeptide
  source 1..317: mol_type = other DNA
ccttgagaggtgctttctctccctgaaggtcacagctgcaggcataccagtctaagattgatcgagacaagtcttttatacttgaggaacacatggacaaaataaacagttgtttttcagccaatactgtggaagaaattattgaaaacttacagcaagatggttcatcttttgccctagagcaattgaaggtaattaataaaatgtctccaacatctctaaagatcacactaaggcaactcatggaggggtcttcaaagaccttgcaagaagtactaactatggagtatcggctaagtcaagcttgtatgttttaa

SEQ ID NO: 9759 - DNA, 461 bp, synthetic construct
  misc_feature 1..461: note = Synthetic polypeptide
  source 1..461: mol_type = other DNA
ccttgagaggtgctttctctccctgaaggtcacagctgcaggcataccagtctaagattgatcgagacaagtcttttatacttgaggaacacatggacaaaataaacagttgtttttcagccaatactgtggaagaaattattgaaaacttacagcaagatggttcatcttttgccctagagcaattgaaggtaattaataaaatgtctccaacatctctaaagatcacactaaggcaactcatggaggggtcttcaaagaccttgcaagaagtactaactatggagtatcggctaagtcaagcttgtatgagaggtcatgactttcatgaaggcgttagagctgttttaattgataaagaccagagtccaaaatggaaaccagctgatctaaaagaagttactgaggaagatttgaataatcactttaagtctttgggaagcagtgatttgaaattttga

SEQ ID NO: 9760 - DNA, 345 bp, synthetic construct
  misc_feature 1..345: note = Synthetic polypeptide
  source 1..345: mol_type = other DNA
ccttgagaggtgctttctctccctgaaggtcacagctgcaggcataccagtctaagattgatcgagacaagtcttttatacttgaggaacacatggacaaaataaacagttgtttttcagccaatactgtggaagaaattattgaaaacttacagcaagatggttcatcttttgccctagagcaattgaaggtaattaataaaatgtctccaacatctctaaagatcacactaaggcaactcatggaggggtcttcaaagaccttgcaagaagtactaactatggagtatcggctaagtcaagcttgtatgagaggtcatgactttcatgaaggcgttagagctg

SEQ ID NO: 9761 - DNA, 407 bp, synthetic construct
  misc_feature 1..407: note = Synthetic polypeptide
  source 1..407: mol_type = other DNA
ccttgagaggtgctttctctccctgaaggtcacagctgcaggcataccagtctaagattgatcgagacaagtcttttatacttgaggaacacatggacaaaataaacagttgtttttcagccaatactgtggaagaaattattgaaaacttacagcaagatggttcatcttttgccctagagcaattgaaggtaattaataaaatgtctccaacatctctaaagatcacactaaggcaactcatggaggggtcttcaaagaccttgcaagaagtactaactatggagtatcggctaagtcaagcttgtatgagaggtcatgactttcatgaaggcgttagagctggtaagtggcaaatgggaacttaccattttggggaaatgggatttgtgagcatatgctgttaa

SEQ ID NO: 9762 - DNA, 3012 bp, synthetic construct
  misc_feature 1..3012: note = Synthetic polypeptide
  source 1..3012: mol_type = other DNA
gatgttctatttcttgatctggatgctgcttcttcagtttgtggacgtttatcagaaagcaagagatatcccttggagtctaccagtttgccatactgctcccttaatgaaggagatggccttgttttacctgttataaattccatctctgccctgcttcagaatcttcaggaatctagccagtgggagctagccctaagatttgtggttggttcatttggtacctgtcttcagcactctgtgtcaaacttcatgaatgccactttgagtgaaaagttatttggagagactacattagttaaatcaaggcatgttgttatggaattgaaagaaaaagctgttatatttatcagggaaaatgctacaacactactgcacaaagtatttaattgtcgcttggtagatcttgacctggcgttgggttactgcactctcttacctcaaaaagatgtgtttgaaaatctctggaagctcatagataaagcatggcagaattacgacaaaatcttggcaatatctctggtgggctctgagctggcaagtctctatcaggaaatagaaatggggcttaagttccgtgaactcagtactgatgcccagtggggcattcgtcttggtaaacttggtatttcttttcaaccagttttcaggcaacattttctcaccaagaaagacctcattaaagctcttgtggagaatatagatatggacacaagcctcattttggaatattgcagcacatttcagttggactgcgatgcagttcttcagctcttcattgaaacgctgctccacaacacaaatgccggccaaggccagggagatgcaagcatggactctgcaaagcggcggcatcccaaactcctggccaaagcccttgagatggttcctttactgacgagcacaaaagatttggtcatcagtcttagtggaatactacataagttggatccttatgactatgaaatgattgaagttgtcttgaaagttatagaacgagctgatgaaaagataaccaatattaatattaatcaggcattgagtattctgaaacatttgaagtcatacagaagaatttctcctcccgtggatctagaatatcagtatatgttggaacatgtcataactttgccatcagctgcccaaactagactgccttttcacctgatattctttggcacagcacagaacttctggaaaattctctctacagaactcagtgaagaatctttcccaacattgctcttaatttcgaaattaatgaagttctctctggacactctgtacgtgtctacagcaaaacacgttttcgaaaaaaaactgaagccaaagctcctgaagttaacacaagctaaatcctcaacactgattaacaaggaaataactaagatcacgcagaccatcgaatcctgcttactctctatagtcaacccagagtgggctgtagctattgccatcagccttgcccaggatatccctgaaggttccttcaagatatctgctttgaaattctgcctttatttagctgagagatggctacagaatatcccatcgcaggacgaaaaacgtgaaaaagccgaggctttgttgaagaagcttcatatccagtaccggcgatcgggcacagaagctgtgctcatagcccacaagctgaacactgaggaatatttaagagtgatcggaaagccagcacatcttattgtcagtctctacgaacatcctagcatcaatcaaagaattcagaattcatctggcacagattatcctgatattcatgcagcagctaaagaaatagccgaagtcaatgaaattaatttggaaaaagtctgggacatgttgttggaaaaatggctatgcccttcaacaaaacctggtgaaaaaccatcagaattatttgaacttcaagaagatgaagccctacgaagagtgcagtatctcctcctgtctcgtccaattgattatagttcaagaatgctgtttgtatttgcaacatcaactacaaccacattaggtatgcatcagttaacttttgcccatagaactcgagctcttcagtgtctcttctatttggctgacaaggaaactatagaatctctctttaaaaaacccattgaagaagtgaaatcttatttgagatgtataacttttctggcatcatttgagactttgaatatccccatcacatatgaattattttgcagcagtcctaaagaaggaatgattaagggtctgtggaaaaaccacagccacgagtccatggcagtaagattggtgactgagctgtgtttagaatacaaaatctatgacctgcagctttggaatggactcttgcaaaagcttctgggcttcaatatgattccttatctaaggaaagttttaaaagccatctccagtatccattctttatggcaggttccctacttcagcaaagcgtggcagcgtgtgatacagataccactgctttcagcctcttgtcctttaagtcctgatcagctgtcagattgttctgagagtctcatcgctgtcctcgaatgtccagtctcaggtgatcttgacctgatcggagtcgccaggcagtatatccagttagaacttccggcttttgcattagcttgtctgatgctcatgccccactcagagaaaagacaccagcaaattaagaattttctgggttcctgtgaccctcaggttattttaaagcaattggaagagcatatgaacacgggccagctagcaggattttcacatcaaattagaagtctgattttgaataatatcatcaataagaaggagtttgggattttggcaaagaccaaatactttcaaatgttgaagatgcatgcgatgaataccaacaatatcactgagctagtgaactatttggcaaatgacttaagtttagatgaagcttcagtcttgataactgaatattcaaagcactgcgggaaacctgtgcctccagacactgctccctgtgaaattctgaagatgtttcttagtggattatcgtaa

SEQ ID NO: 9763 - DNA, 2528 bp, synthetic construct
  misc_feature 1..2528: note = Synthetic polypeptide
  source 1..2528: mol_type = other DNA
taaactattttatgatctttccgttgaaactttttgtcagtgttaagggaaatgagagaaagtaccctattttcagacatctatgttgatacataaccaagaggttaaaggaaataaactaatggtgcaccacttggaaaaagtttgtcctgactcccagggagagaaagaaaaggagctagagagtcagcagttgttaaatgtgcttaacccacttgaaactggtgccacattacttagtcaagaggtggaggaaccaccatccctggagtataaagaggctgcaaacatagtctctccctcctgaactaggcaaggcactgattttggctggagatctaccaagctggggcagggcaatttcccctctgacaatatcccatgggaattaatcagcaagggacttcagctcgatattattgggcatacaggccttttcctacatctgatgtactgaattggaaaacttccaatcctttctacagggaagatcctcagaagatgactgaattgtttaccactatttttgccagccatcaccctacttaggctaatttgcaagccctcctaaatattatgcttactgcagacaagagaaagcaagcattaggcaatggaaaggaggaagcatggtgtcttcatgaaaaaagcccagatgataccccagaccctgataagattctacatgctgacccaaactgggtcccaagtgaggaggatggggcctggacaaatcatctggagtattctaaagggtgataggtcaggggtgccgagacctaaaagtctgaaaaaagtgcaggagcttcagcagaagcctaacaaggattccctcagagttcatggatgtatctgtcaaacatatagaaagcatacagacttagacctgcaggatcctgaaaatgtcagaatgataaacatgacttttatagagcaaaatgccccagacatcacaaagaagttacaaaagctggaggggagctattggaatgaacacttctcaattaattgacattgtgttcaaggccttataatagcagagaagccaaggaaaccaaggcactactgaaggcagagatactcatagctgccatgggaggaaacctgaagagaaaggaacccccaaggtggaaagggaaagtagaaaaagatcaatgggcttactgtagggtgacagtgctttggaagaaagactgccccaagctgagtcagggggagcccaagtcacttatggctgttaagtttggaaaaaatccaaggaggaccgagggtgcccaaagttcccaaaagctccaaccctgtccagcattaggatttcaccacaggacattcgggtaaaactgacagtagggaaacaaaaattggacttcttaattgatacgggtgatactgacatcccaaagtgtggactttctgacacctatgtcaatatggttggggtgaatggagagctaaaactggttggggggggggggttgtgacccttatcctgcaaggtgggcaatgaggtattgataatagctaatcaattattttatgtgtgggactgcccaacctctgtgcttggtagagatctcttgtgtaagttagaggcattaattgtctttgaaccagagaaacgtccaatgtgcctccaggtacccccagaatccagattgcagctacaggccctcctgatgaaatcaaaaactccacagcttgaagtagagatgattccaccggaagtcctcaataaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 9764 - DNA, 2400 bp, synthetic construct
  misc_feature 1..2400: note = Synthetic polypeptide
  source 1..2400: mol_type = other DNA
taaactattttatgatctttccgttgaaactttttgtcagtgttaagggaaatgagagaaagtaccctattttcagacatctatgttgatacataaccaagaggttaaaggaaataaactaatggtgcaccacttggaaaaagtttgtcctgactcccagggagagaaagaaaaggagctagagagtcagcagttgttaaatgtgcttaacccacttgaaactggtgccacattacttagtcaagaggtggaggaaccaccatccctggagtataaagaggctgcaaacatagtctctccctcctgaactaggcaaggcactgattttggctggagatctaccaagctggggcagggcaatttcccctctgacaatatcccatgggaattaatcagcaagggacttcagctcgatattattgggcatacaggccttttcctacatctgatgtactgaattggaaaacttccaatcctttctacagggaagatcctcagaagatgactgaattgtttaccactatttttgccagccatcaccctacttaggctaatttgcaagccctcctaaatattatgcttactgcagacaagagaaagcaagcattaggcaatggaaaggaggaagcatggtgtcttcatgaaaaaagcccagatgataccccagaccctgataagattctacatgctgacccaaactgggtcccaagtgaggaggatggggcctggacaaatcatctggagtattctaaagggtgataggtcaggggtgccgagacctaaaagtctgaaaaaagtgcaggagcttcagcagaagcctaacaaggattccctcagagttcatggatgtatctgtcaaacatatagaaagcatacagacttagacctgcaggatcctgaaaatgtcagaatgataaacatgacttttatagagcaaaatgccccagacatcacaaagaagttacaaaagctggaggggagctattggaatgaacacttctcaattaattgacattgtgttcaaggccttataatagcagagaagccaaggaaaccaaggcactactgaaggcagagatactcatagctgccatgggaggaaacctgaagagaaaggaacccccaaggtggaaagggaaagtagaaaaagatcaatgggcttactgtagggtgacagtgctttggaagaaagactgccccaagctgagtcagggggagcccaagtcacttatggctgttaagtttggaaaaaatccaaggaggaccgagggtgcccaaagttcccaaaagctccaaccctgtccagcattaggatttcaccacaggacattcgggtaaaactgacagtagggaaacaaaaattggacttcttaattgatacgggtgatactgacatcccaaagtgtggactttctgacacctatgtcaatatggttggggtgaatggagagctaaaactggttggggggggggggttgtgacccttatcctgcaaggtgggcaatgaggtattgataatagctaatcaattattttatgtgtgggactgcccaacctctgtgcttggtagagatctcttgtgtaagttagaggcattaattgtctttgaaccagagaaacgtccaatgtgcctccaggtacccccagaatccagattgcagctacaggccctcctgatgaaatcaaaaactccacagcttgaagtagagatgattccaccggaagtcctcaataaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgc

SEQ ID NO: 9765 - DNA, 2168 bp, synthetic construct
  misc_feature 1..2168: note = Synthetic polypeptide
  source 1..2168: mol_type = other DNA
taaactattttatgatctttccgttgaaactttttgtcagtgttaagggaaatgagagaaagtaccctattttcagacatctatgttgatacataaccaagaggttaaaggaaataaactaatggtgcaccacttggaaaaagtttgtcctgactcccagggagagaaagaaaaggagctagagagtcagcagttgttaaatgtgcttaacccacttgaaactggtgccacattacttagtcaagaggtggaggaaccaccatccctggagtataaagaggctgcaaacatagtctctccctcctgaactaggcaaggcactgattttggctggagatctaccaagctggggcagggcaatttcccctctgacaatatcccatgggaattaatcagcaagggacttcagctcgatattattgggcatacaggccttttcctacatctgatgtactgaattggaaaacttccaatcctttctacagggaagatcctcagaagatgactgaattgtttaccactatttttgccagccatcaccctacttaggctaatttgcaagccctcctaaatattatgcttactgcagacaagagaaagcaagcattaggcaatggaaaggaggaagcatggtgtcttcatgaaaaaagcccagatgataccccagaccctgataagattctacatgctgacccaaactgggtcccaagtgaggaggatggggcctggacaaatcatctggagtattctaaagggtgataggtcaggggtgccgagacctaaaagtctgaaaaaagtgcaggagcttcagcagaagcctaacaaggattccctcagagttcatggatgtatctgtcaaacatatagaaagcatacagacttagacctgcaggatcctgaaaatgtcagaatgataaacatgacttttatagagcaaaatgccccagacatcacaaagaagttacaaaagctggaggggagctattggaatgaacacttctcaattaattgacattgtgttcaaggccttataatagcagagaagccaaggaaaccaaggcactactgaaggcagagatactcatagctgccatgggaggaaacctgaagagaaaggaacccccaaggtggaaagggaaagtagaaaaagatcaatgggcttactgtagggtgacagtgctttggaagaaagactgccccaagctgagtcagggggagcccaagtcacttatggctgttaagtttggaaaaaatccaaggaggaccgagggtgcccaaagttcccaaaagctccaaccctgtccagcattaggatttcaccacaggacattcgggtaaaactgacagtagggaaacaaaaattggacttcttaattgatacgggtgatactgacatcccaaagtgtggactttctgacacctatgtcaatatggttggggtgaatggagagctaaaactggttggggggggggggttgtgacccttatcctgcaaggtgggcaatgaggtattgataatagctaatcaattattttatgtgtgggactgcccaacctctgtgcttggtagagatctcttgtgtaagttagaggcattaattgtctttgaaccagagaaacgtccaatgtgcctccaggtacccccagaatccagattgcagctacaggccctcctgatgaaatcaaaaactccacagcttgaagtagagatgattccaccggaagtcctcaataaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccagcctagagataattccatcttttccttgagtcctgactggtga

SEQ ID NO: 9766 - DNA, 96 bp, synthetic construct
  misc_feature 1..96: note = Synthetic polypeptide
  source 1..96: mol_type = other DNA
agtgtttcccgcccaggctgcattttagaatcacagaggaggtggcccgaggcagccgggatgacagctctccccaggaatcctgctgcctgctga

SEQ ID NO: 9767 - DNA, 848 bp, synthetic construct
  misc_feature 1..848: note = Synthetic polypeptide
  source 1..848: mol_type = other DNA
tatacatgtccccctaggtctacaggatgctttccaagggttatggagacaggagtgattataagatgaccactttccagatcctgagtgcctatatgtgcagttatatgatagacaatgtgattctgctgatgaatggtgcattgcagaaaaaatctgtgaaagaaattctggggaagtgccaccccttgggccgtttcacagaaatggaagctgtcaacattgcagagacaccttcagatctctttaatgccattctgatcgaaacgccattagctccattcttccaagactgcatgtctgaaaatgctctagatgaactgaatattgaattgctacgcaataaactatacaagtcttaccttgaggcattctataaattctgtaagaatcatggtgatgtcacagcagaagttatgtgtcccattcttgagtttgaggccgacagacgtgcttttatcatcactcttaactcctttggcactgaattgagcaaagaagaccgagagaccctctatccaaccttcggcaaactctatcctgaggggttgcggctgttggctcaagcagaagactttgaccagatgaagaacgtagcggatcattacggagtatacaaacctttatttgaagctgtaggtggcagtgggggaaagacattggaggacgtgttttacgagcgtgaggtacaaatgaatgtgctggcattcaacagacagttccactacggtgtgttttatgcatatgtaaagctgaaggaacaggaaattagaaatattgtgtggatagcagaatgtatttcacagaggcatcgaactaaaatcaacagttacattccaattttataa

SEQ ID NO: 9768 - DNA, 1083 bp, synthetic construct
  misc_feature 1..1083: note = Synthetic polypeptide
  source 1..1083: mol_type = other DNA
tgatatggtttggctctgtgtccccactgaaaaatcatgtcaaattgtaattcccagtgttggaggaggggcctagtgggaagagattgaatcacgggggctgactttcctcttactgttgtcataatagaattctcataagatctggttgtttgaaagcatgtagcacctccaccttctttctctctctctctctgcctctctctctctctctctctctacctccccctctcctgccagccaagtgaagacatgcttgcttccccttcaccttcctccatcatggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 9769 - DNA, 723 bp, synthetic construct
  misc_feature 1..723: note = Synthetic polypeptide
  source 1..723: mol_type = other DNA
tgatatggtttggctctgtgtccccactgaaaaatcatgtcaaattgtaattcccagtgttggaggaggggcctagtgggaagagattgaatcacgggggctgactttcctcttactgttgtcataatagaattctcataagatctggttgtttgaaagcatgtagcacctccaccttctttctctctctctctctgcctctctctctctctctctctctacctccccctctcctgccagccaagtgaagacatgcttgcttccccttcaccttcctccatcatggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccagcctagagataattccatcttttccttgagtcctgactggtga

SEQ ID NO: 9770 - DNA, 2509 bp, synthetic construct
  misc_feature 1..2509: note = Synthetic polypeptide
  source 1..2509: mol_type = other DNA
cactcagccctttgtatctgtgggttatgcatcaagggattcaattatctgagaatcaaaaatatttgaaaaaacataataaaacaataaaaataattaaaaagtaatatagtataattatttacatagtgtttacatagtattagtattataaataacatagagatgatttaaagtatgcaggaggatgtatgtaggttatatgcaaatactatgctattttatatgcaggacttgagcatctgaagattttggtttctgcagagggtgggaaaggttgaaccaatcccccatggataccaaggcctctgaggaaacactacattccagtaatgaagaggaagaccctttccgcggaatggaaccctatcttgtccggagactttcatgtcgcaatattcagcttccccctctcgccttcagacagttggaacaagctgacttgaaaagtgaatcagagaacattcaacgaccaaccagcctccccctgaagattctgccgctgattgctatcacttctgcagaatccagtggttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatacacggagatgacttgattgtgactccatttgctcaggtcttggccagtctgcgaactgtacgaaacaactttgctgcattaactaatttgcaagatcgagcacctagcaaaagatcacccatgtgcaaccaaccatccatcaacaaagccaccataacagaggaggcctaccagaaactggccagcgagaccctggaggagctggactggtgtctggaccagctagagaccctacagaccaggcactccgtcagtgagatggcctccaacaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaa

SEQ ID NO: 9771 - DNA, 505 bp, synthetic construct
  misc_feature 1..505: note = Synthetic polypeptide
  source 1..505: mol_type = other DNA
cactcagccctttgtatctgtgggttatgcatcaagggattcaattatctgagaatcaaaaatatttgaaaaaacataataaaacaataaaaataattaaaaagtaatatagtataattatttacatagtgtttacatagtattagtattataaataacatagagatgatttaaagtatgcaggaggatgtatgtaggttatatgcaaatactatgctattttatatgcaggacttgagcatctgaagattttggtttctgcagagggtgggaaaggttgaaccaatcccccatggataccaaggcctctgaggaaacactacattccagtaatgaagaggaagaccctttccgcggaatggaaccctatcttgtccggagactttcatgtcgcaatattcagcttccccctctcgccttcagacagttggaacaagctgacttgaaaagtgaatcagagaacattcaacgaccaaccagcctccccctgaagattctgccgctg

SEQ ID NO: 9772 - DNA, 486 bp, synthetic construct
  misc_feature 1..486: note = Synthetic polypeptide
  source 1..486: mol_type = other DNA
cactcagccctttgtatctgtgggttatgcatcaagggattcaattatctgagaatcaaaaatatttgaaaaaacataataaaacaataaaaataattaaaaagtaatatagtataattatttacatagtgtttacatagtattagtattataaataacatagagatgatttaaagtatgcaggaggatgtatgtaggttatatgcaaatactatgctattttatatgcaggacttgagcatctgaagattttggtttctgcagagggtgggaaaggttgaaccaatcccccatggataccaaggcctctgaggaaacactacattccagtaatgaagaggaagaccctttccgcggaatggaaccctatcttgtccggagactttcatgtcgcaatattcagcttccccctctcgccttcagacagttggaacaagctgacttgaaaagtgaatcagagaacattcaacgaccaaccagcctccc

SEQ ID NO: 9773 - DNA, 490 bp, synthetic construct
  misc_feature 1..490: note = Synthetic polypeptide
  source 1..490: mol_type = other DNA
ggtttggctctgtgttcccacccaaatctcatcttgaattgtaattcccacatattgagggagggacccgtgatccccacatgttgagggagggaggtgattgaatcatgggggtggtttcccccatactgttctcatgatagtgagtgagttctcatgagatctggtggtttttataagtgtttcaatagttcctctcttgctcccttctctctcctgctgccttctgaaaaaggtgcttgcttcctcttcaccttctgccacgattgtaagtttcctgaggcctccccagccatgcagaactcacgcactcctggctttaaagtttatacttgcatttgccatacctgataagccacggcatatccagatgaaactagccagactggaatttgagtctttggaggcactcaagcagcagcaaatgaagctcgtgaccgagaacctgaaggaggaaccaatggaaagcgggaaggagaaggcaacctga

SEQ ID NO: 9774 - DNA, 1116 bp, synthetic construct
  misc_feature 1..1116: note = Synthetic polypeptide
  source 1..1116: mol_type = other DNA
cagggctcctcaacttcctggccacggaccactggtccgtggcctgttggaactgagccacactgcaggaggtgagcggagggcgagtgagctaagcttcagctgtgcttacagctgctccgcatcattgccattaccaactgagctccacctgcctttcagatcagctgcggcattagagacccttaggagcgctaaccctagtgtgaactgcgcatgcgaggtttgaatgctccttatgagattctaatgcctgatgctgtgtcacattctcccatccctcccaagatgggacatctagttgcaggaaaacaggatcagggctcctactgattccacattatgagtgcagacatgagtccagcaagcagtaccacgtcacttcctgttagtcctcttactgaagagccagtgcctttcaaggatataatgaaagatgaatgctcgatgctcaagctgcagctgaaagagaaggatgaactcatttcccaacttcaggaagagctgggaaaagtccggcatttacagaaggcttttgcttcaagagtagataaatccacacagactgaactactatgctatgatggtttaaacttgaaaagactagagacagtacaaggagggagagaggctacatatcgaaatcgaattgtgagccaaaatctcagcacaagggacagaaaagcaatacatactcccaccgaggaccgttttaggtattcggcagcggaccagacaagcccctacaaaaacaagacctgtcaactcccaagtctctgtttaagtaatttcctgaaggacaaggaactagcagaagttatcaaacattcaagaggaacttatgaaaccctcacttcagacgttacacagaacttacgggccaccgttgggcagagctctctgaagccaacagctaagacagaagggctctccacgttcttagagaaaccaaaggaccaagttgctacggcccgacagcattcgacctttacaggcaggtttggacagccacccagagggccaatctctttacacatgtacagcaggaagaatgtgtttctccaccacaatttacacagcactgagctgcaaactctaggccagcaggatgggtaa

SEQ ID NO: 9775 - DNA, 447 bp, synthetic construct
  misc_feature 1..447: note = Synthetic polypeptide
  source 1..447: mol_type = other DNA
cagggctcctcaacttcctggccacggaccactggtccgtggcctgttggaactgagccacactgcaggaggtgagcggagggcgagtgagctaagcttcagctgtgcttacagctgctccgcatcattgccattaccaactgagctccacctgcctttcagatcagctgcggcattagagacccttaggagcgctaaccctagtgtgaactgcgcatgcgaggtttgaatgctccttatgagattctaatgcctgatgctgtgtcacattctcccatccctcccaagatgggacatctagttgcaggaaaacaggatcagggctcctactgattccacattatgagtgcagacatgagtccagcaagcagtaccacgtcacttcctgttagtcctcttactgaagagccagtgcctttcaagaccacataccctagggaattctga

SEQ ID NO: 9776 - DNA, 645 bp, synthetic construct
  misc_feature 1..645: note = Synthetic polypeptide
  source 1..645: mol_type = other DNA
cagggctcctcaacttcctggccacggaccactggtccgtggcctgttggaactgagccacactgcaggaggtgagcggagggcgagtgagctaagcttcagctgtgcttacagctgctccgcatcattgccattaccaactgagctccacctgcctttcagatcagctgcggcattagagacccttaggagcgctaaccctagtgtgaactgcgcatgcgaggtttgaatgctccttatgagattctaatgcctgatgctgtgtcacattctcccatccctcccaagatgggacatctagttgcaggaaaacaggatcagggctcctactgattccacattatgagtgcagacatgagtccagcaagcagtaccacgtcacttcctgttagtcctcttactgaagagccagtgcctttcaaggatataatgaaagatgaatgctcgatgctcaagctgcagctgaaagagaaggatgaactcatttcccaacttcaggaagagctgggaaaagtccggcatttacagaaggcttttgcttcaagagtagataaatccacacagactgaactactatgctatgatgccctgtggaatcctacatgcactgaaggtttatttaaaccagtacttatttcaacttag

SEQ ID NO: 9777 - DNA, 756 bp, synthetic construct; identical to SEQ ID NO: 8739
  misc_feature 1..756: note = Synthetic polypeptide
  source 1..756: mol_type = other DNA

SEQ ID NO: 9778 - DNA, 918 bp, synthetic construct
  misc_feature 1..918: note = Synthetic polypeptide
  source 1..918: mol_type = other DNA
cttgtccgagcctcagttttctcttcgaggaaatgggagtttggaggtgggcttctggcctgcttttcctcacctcgtggttaggagggcgcatgcgaggaagacctccgtgtggatggccgtggctgtgaggactaccgatgtgtcgaagtggaaactgatgtggtgtccaacactagtgggtccgccagggtcaagctgggtcacacagacatcttggtgggagtgaaagcagaaatggggacgccgaagctggagaaaccaaatgaaggctacttggagttctttgttgactgttcagccagtgctacccctgaatttgaaggtagaggaggtgatgaccttggcaccgagatcgctaacaccctctatcggatatttaacaataaaagcagtgtcgacttaaagaccctctgcattagtcctcgggagcactgctgggttctctatgtggatgtgctgcttctggaatgtggtggaaatttgtttgatgccatttccattgctgtaaaggctgctctcttcaatacaaggataccaagggttcgagttttggaggatgaagaggggtcgaaggacattgaattgtcagatgacccttatgactgcatacgactaagtgtggagaatgtcccctgcattgtcactctgtgcaagattggctatcggcatgtggtggatgctactcttcaggaggaggcctgctcgctggccagcttgctggtgtcggtgaccagcaagggagttgtgacgtgcatgaggaaagtggggaagggcagcctggacccagagagcatcttcgagatgatggagactggcaagcgtgtgggcaaggtactgcatgcctccttgcagagtgttgtgcacaaggaagaaagcctggggcccaagagacagaaagttggattcctgggatga

SEQ ID NO: 9779 - DNA, 956 bp, synthetic construct
  misc_feature 1..956: note = Synthetic polypeptide
  source 1..956: mol_type = other DNA
ctgaacagtggaaagcctggagctagcaattaggagaccttttgtattcagactcttctaactcagaaaaatctaagctgttgtctgatataagtgctcgtctatggtttacatacagaaggaaattttcaccaattggtggaacgggcccttcatcagatgctggttggggatgtatgctacgctgtggacagatgatgctggctcaagcccttatctgtagacacttgggaagggactggagctgggagaaacaaaaagaacaacccaaagaataccaacgcatcctacagtgcttcttagatagaaaagattgttgctactctatccatcaaatggcacaaatgggtgtaggagaagggaaatcaattggagaatggtttggaccaaatacagttgcacaggtgttaaaaaaacttgctttatttgacgaatggaattccttggctgtttatgtttcaatggataacacagtggtcattgaagatatcaaaaaaatgtgccgtgtccttcccttgagtgctgacacagctggtgacaggcctcccgattctttaactgcttcaaaccagagtgacgagctcatcttcttggaccctcatacaacccagacctttgttgacactgaagagaatggaacggttaatgaccagactttccattgcctgcagtccccacagcgaatgaacatcctaaacctggatccttcagttgcattgggatttttctgcaaagaagaaaaagactttgataactggtgtagccttgttcagaaggaaattctaaaggagaatttaaggatgtttgaattagttcagaaacatccatcacactggcctccctttgtacctccagccaagccagaagtgacaaccactggggcagaattcattgactctactgagcaactggaggagtttgatctggaggaagattttgagattctgagtgtgtag

SEQ ID NO: 9780 - DNA, 1142 bp, synthetic construct
  misc_feature 1..1142: note = Synthetic polypeptide
  source 1..1142: mol_type = other DNA
ctgaacagtggaaagcctggagctagcaattaggagaccttttgtattcagactcttctaactcagaaaaatctaagctgttgtctgatataagtgctcgtctatggtttacatacagaaggaaattttcaccaattggtggaacgggcccttcatcagatgctggttggggatgtatgctacgctgtggacagatgatgctggctcaagcccttatctgtagacacttgggaagggactggagctgggagaaacaaaaagaacaacccaaagaataccaacgcatcctacagtgcttcttagatagaaaagattgttgctactctatccatcaaatggcacaaatgggtgtaggagaagggaaatcaattggagaatggtttggaccaaatacagttgcacaggtgttaaaaaaacttgctttatttgacgaatggaattccttggctgtttatgtttcaatggataacacagtggtcattgaagatatcaaaaaaatgtgccgtgtccttcccttgagtgctgacacagctggtgacaggcctcccgattctttaactgcttcaaaccagagtaagggcacctctgcctactgctcagcctggaaacccctgctgctcattgtgccccttcgcctgggcataaaccaaatcaatcctgtctatgttgatgcattcaaagagtgttttaagatgccacagtctttaggggcattaggaggaaaaccaaataacgcgtattatttcataggattcttaggtgacgagctcatcttcttggaccctcatacaacccagacctttgttgacactgaagagaatggaacggttaatgaccagactttccattgcctgcagtccccacagcgaatgaacatcctaaacctggatccttcagttgcattgggatttttctgcaaagaagaaaaagactttgataactggtgtagccttgttcagaaggaaattctaaaggagaatttaaggatgtttgaattagttcagaaacatccatcacactggcctccctttgtacctccagccaagccagaagtgacaaccactggggcagaattcattgactctactgagcaactggaggagtttgatctggaggaagattttgagattctgagtgtgtag

SEQ ID NO: 9781 - DNA, 641 bp, synthetic construct
  misc_feature 1..641: note = Synthetic polypeptide
  source 1..641: mol_type = other DNA
ctgaacagtggaaagcctggagctagcaattaggagaccttttgtattcagactcttctaactcagaaaaatctaagctgttgtctgatataagtgctcgtctatggtttacatacagaaggaaattttcaccaattggtggaacgggcccttcatcagatgctggttggggatgtatgctacgctgtggacagatgatgctggctcaagcccttatctgtagacacttgggaagggactggagctgggagaaacaaaaagaacaacccaaagaataccaacgcatcctacagtgcttcttagatagaaaagattgttgctactctatccatcaaatggaaaaaatgtgccgtgtccttcccttgagtgctgacacagctggtgacaggcctcccgattctttaactgcttcaaaccagagtaagggcacctctgcctactgctcagcctggaaacccctgctgctcattgtgccccttcgcctgggcataaaccaaatcaatcctgtctatgttgatgcattcaaagtgacgagctcatcttcttggaccctcatacaacccagacctttgttgacactgaagagaatggaacggttaatgaccagactttccattgcctgcagtccccacagcgaatga

SEQ ID NO: 9782 - DNA, 632 bp, synthetic construct
  misc_feature 1..632: note = Synthetic polypeptide
  source 1..632: mol_type = other DNA
caggcgcggtagctcacgcctgtaatcccagcactttgggaagccgaggcgggtcgatcacgaggtcaggagattgagaccatcctggctaacacagtgaaaccccgtctctactaaaaatacaaaaaaaaaaaaaaaaaaaaatttagcccagcgtggtggctgtcccagcctgaagtcccagctactcaggaggctgaggcaggagaatggtgtgaatccgggaggcggagcttgcagtgagccaagatcgcaccactacactccagcctgggcaacagagcattctggaatttatcagtatagcagtgggcctggtcagcattcgaggcgtggacagtggactctacctcgggatgaatgagaagggggagctgtatggatcagaaaaactaacccaagagtgtgtattcagagaacagttcgaagaaaactggtataatacgtactcatcaaacctatataagcacgtggacactggaaggcgatactatgttgcattaaataaagatgggaccccgagagaagggactaggactaaacggcaccagaaattcacacattttttacctagaccagtggaccccgacaaagtacctgaactgtataaggatattctaagccaaagttga

SEQ ID NO: 9783 - DNA, 775 bp, synthetic construct
  misc_feature 1..775: note = Synthetic polypeptide
  source 1..775: mol_type = other DNA
tggagagaggccaacccgggactctattccttatgagctgtgtggccatagccaagtagctgtttctctctgagactcaatgtcctcatctgtaaaatgcggaaaagaaagctgacctgatgggactgttgggagggatagctttgcaggcatctctcgcagcaccacgattgtgacagcgtatgtgatgactgtgacggggctaggctggcgggacgtgcttgaagccatcaaggccaccaggcccatcgccaaccccaacccaggctttaggcagcagcttgaagagtttggctgggccagttcccagaagggtgccagacataggacctcaaaaacctctggtgcccaatgccctccgatgacttcagcaacctgcctgctggctgcacgtgtggctcttctctccgcagcgctggtgcgcgaagccaccgggcgcacagcccagcgctgtcgtctgagtccgcgggcggccgccgagcgcctgctggggccgccacctcacgttgcagcaggatggtcaccggacccaaagtaccagatctgtctgtgcttcggtgaggaggacccgggccccacacagcaccccaaggagcagctcatcatggcggacgtgcaggtgcagcttcggcctgggagctcgtcctgcactctaagtgcctcaaccgagcgcccagatgggtcctcaacccctggcaaccccgatggcatcactcaccttcaatgcagctgcctccatcctaagcgagccgcttcctcttcttgtacccgctga

SEQ ID NO: 9784 - DNA, 586 bp, synthetic construct
  misc_feature 1..586: note = Synthetic polypeptide
  source 1..586: mol_type = other DNA
tggagagaggccaacccgggactctattccttatgagctgtgtggccatagccaagtagctgtttctctctgagactcaatgtcctcatctgtaaaatgcggaaaagaaagctgacctgatgggactgttgggagggatagctttgcaggcatctctcgcagcaccacgattgtgacagcgtatgtgatgactgtgacggggctaggctggcgggacgtgcttgaagccatcaaggccaccaggcccatcgccaaccccaacccaggctttaggcagcagcttgaagagtttggctgggccagttcccagaagcttcgccggcagctggaggagcgcttcggcgagagccccttccgcgacgaggaggagttgcgcgcgctgctgccgctgtgcaagcgctgccggcagggctccgcgacctcggcctcctccgccgggccgcactcagcagcctccgagggaaccgtgcagcgcctggtgccgcgcacgccccgggaagcccaccggccgctgccgctgctggcgcgcgtcaagcagactttctcttgcctcccccggtgtctgtcccgcaagggcggcaagtga

SEQ ID NO: 9785 - DNA, 731 bp, synthetic construct
  misc_feature 1..731: note = Synthetic polypeptide
  source 1..731: mol_type = other DNA
ggagtagtatattgcagtggttaaaggcataggcttgggagtcacagaagtctacatttgaatctatactctgctacttcctacaaccatcctattggacaggttgtttgatctctctgaatctgttttcttcatttataaaataattacacttatttcatagagttgtgaagattaaaggaaataaaagcctgtaatctagagcctggcacagtcagcattaatggcataattatgataagacatttctcatctggataaatgaggaggatcacaccagggtaatctcaatggaaaaaggaggcaatatgaaacgagtatttgagcgattctgtcgtggactaaaagaagtagaacggttaatccaagaacgaggctgggagttcatgtggaatgagcgcctaggatacattttgacctgtccttcgaaccttggaacaggactacgagctggtgtccacgttaggatcccaaagctcagcaaggacccacgcttttctaagatcctggaaaacctaagactccagaagcgtggcacaggtggtgtggacactgccgcggtcgcagatgtgtacgacatttccaacatagatagaattggtcgatcagaggttgagcttgttcagatagtcatcgatggagtcaattacctggtggattgtgaaaagaagttggagagaggccaagatattaaggtgccaccccctctgcctcagtttggcaaaaagtaa

SEQ ID NO: 9786 - DNA, 1500 bp, synthetic construct
  misc_feature 1..1500: note = Synthetic polypeptide
  source 1..1500: mol_type = other DNA
ggccaggcacagtggctcacacctgtaatcccagcactttgggaggccaaggcaggtagatcacctgaggtccggagttcaagaccagcctagtcaacatggtgaaaccccgtctctactaaaaatacaaaaattagctggtcgtggtggtgcatgcctgtagtcccagttactcgggaggctgacgcaggagaatcacttgaacccgggaggcagaggttgcagtgagccgagatcgcgccactgcactccagcctgggctacagaggccggctcccaggcctcagggtccgctgcatcttcctggcctggctgggcgtctttgcaggcagctggctggtgtacgtgcactactcgtcctactcggagcgctgtcgcggccatgtctgccaggtggtcatttgtgaccagtaccgcaaggggatcatctcgggctccgtctgccaggacctgtgtgagctgcatatggtggagtggaggacctgcctctcggtggccccgggccagcaggtgtacagcgggctctggcgggacaaggatgtaaccatcaagtgtggcattgaggagaccctcgactccaaggcccggtcggatgcggccccccggcgggagctggtactgtttgacaagcccacccggggcacctccatcaaggaattccgggagatgaccctcagcttcctcaaggcgaacctgggagacctgccttccctgccggcgctggttggccaggtcctgctcatggctgacttcaacaaggacaaccgggtgtccctggcggaagccaagtccgtgtgggccctgctgcagcgtaacgagttcctgctgctgctgtccctgcaggagaaggagcacgcctccagactgctgggctactgtggggacctctacctcaccgagggcgtgccgcatggcgcctggcacgcggccgcccttccacccctgttgcgcccactgctgccgcctgccctgcagggtgctctccagcagtggctggggcctgcgtggccttggcgggccaagatcgccatcggcctgctggagttcgtggaggagctcttccacggctcttacgggactttctacatgtgtgagaccacactggccaacgtgggctacacagccacctacgacttcaagatggccgacctgcagcaggtggcacccgaggccaccgtgcgccgcttcctgcagggccgccgctgcgagcacagcaccgactgcacctacgggcgcgactgcagggccccgtgtgacaggctcatgaggcagtgcaagggcgacctcatccagcccaacctggccaaggtgtgcgcactgctacggggctacctgctgcctggcgcgcccgccgacctccgcgaggagctgggcacacagctgcgcacctgtaccacgctgagcgggctggccagccaggtggaggcccatcactcgctggtgctcagccacctcaagactctgctctggaagaagatctccaacaccaagtactcttga

SEQ ID NO: 9787 - DNA, 1304 bp, synthetic construct
  misc_feature 1..1304: note = Synthetic polypeptide
  source 1..1304: mol_type = other DNA
tgccccaggcccccagctgtgctcctcctccttcctctgcactcatcccccacccacctcagggcctttgcacttgccatggcctctgcctggactgccctcccccttctctacctgcagaacgtcgtttagccttcatcgttcacctcaaatatcacctctgcagagattttcctcactccctgtgccacctagcagaaactggtccttcctcctcctgctgcccgtggcatgcacgtcttcttcaggctccacattgccatcatggtgtggacgacccccaccagcatgggcgaggtgtcgccctggctgacttcaaccgtgatggcaaagtggacatcgtctatggcaactggaatggcccccaccgcctctatctgcaaatgagcacccatgggaaggtccgcttccgggacatcgcctcacccaagttctccatgccctcccctgtccgcacggtcatcaccgccgactttgacaatgaccaggagctggagatcttcttcaacaacattgcctaccgcagctcctcagccaaccgcctcttccgcgtcatccgtagagagcacggagaccccctcatcgaggagctcaatcccggcgacgccttggagcctgagggccggggcacagggggtgtggtgaccgacttcgacggagacgggatgctggacctcatcttgtcccatggagagtccatggctcagccgctgtccgtcttccggggcaatcagggcttcaacaacaactggctgcgagtggtgccacgcacccggtttggggcctttgccaggggagctaaggtcgtgctctacaccaagaagagtggggcccacctgaggatcatcgacgggggctcaggctacctgtgtgagatggagcccgtggcacactttggcctggggaaggatgaagccagcagtgtggaggtgacgtggccagatggcaagatggtgagccggaacgtggccagcggggagatgaactcagtgctggagatcctctacccccgggatgaggacacacttcaggacccagccccactggagacaccaatgaatgcatccagttcccattcgtgtgccctcgagacaagcccgtatgtgtcaacacctatggaagctacaggtgccggaccaacaagaagtgcagtcggggctacgagcccaacgaggatggcacagcctgcgtggggactctcggccagtcaccgggcccccgccccaccacccccaccgctgctgctgccactgccgctgctgctgccgctgctggagctgccactgctgcaccggtcctcgtag

SEQ ID NO: 9788 - DNA, 1403 bp, synthetic construct
  misc_feature 1..1403: note = Synthetic polypeptide
  source 1..1403: mol_type = other DNA
tgccccaggcccccagctgtgctcctcctccttcctctgcactcatcccccacccacctcagggcctttgcacttgccatggcctctgcctggactgccctcccccttctctacctgcagaacgtcgtttagccttcatcgttcacctcaaatatcacctctgcagagattttcctcactccctgtgccacctagcagaaactggtccttcctcctcctgctgcccgtggcatgcacgtcttcttcaggctccacattgccatcatggtgtggacgacccccaccagcatgggcgaggtgtcgccctggctgacttcaaccgtgatggcaaagtggacatcgtctatggcaactggaatggcccccaccgcctctatctgcaaatgagcacccatgggaaggtccgcttccgggacatcgcctcacccaagttctccatgccctcccctgtccgcacggtcatcaccgccgactttgacaatgaccaggagctggagatcttcttcaacaacattgcctaccgcagctcctcagccaaccgcctcttccgcgtcatccgtagagagcacggagaccccctcatcgaggagctcaatcccggcgacgccttggagcctgagggccggggcacagggggtgtggtgaccgacttcgacggagacgggatgctggacctcatcttgtcccatggagagtccatggctcagccgctgtccgtcttccggggcaatcagggcttcaacaacaactggctgcgagtggtgccacgcacccggtttggggcctttgccaggggagctaaggtcgtgctctacaccaagaagagtggggcccacctgaggatcatcgacgggggctcaggctacctgtgtgagatggagcccgtggcacactttggcctggggaaggatgaagccagcagtgtggaggtgacgtggccagatggcaagatggtgagccggaacgtggccagcggggagatgaactcagtgctggagatcctctacccccgggatgaggacacacttcaggacccagccccactggagtgtggccaaggattctcccagcaggaaaatggccattgcatggacaccaatgaatgcatccagttcccattcgtgtgccctcgagacaagcccgtatgtgtcaacacctatggaagctacaggtgccggaccaacaagaagtgcagtcggggctacgagcccaacgaggatggcacagcctgcgtggggactctcggccagtcaccgggcccccgccccaccacccccaccgctgctgctgccactgccgctgctgctgccgctgctggagctgccactgctgcaccggtcctcgtagatggagatctcaatctggggtcggtggttaaggagagctgcgagcccagctgctga

SEQ ID NO: 9789 - DNA, 1355 bp, synthetic construct
  misc_feature 1..1355: note = Synthetic polypeptide
  source 1..1355: mol_type = other DNA
tgccccaggcccccagctgtgctcctcctccttcctctgcactcatcccccacccacctcagggcctttgcacttgccatggcctctgcctggactgccctcccccttctctacctgcagaacgtcgtttagccttcatcgttcacctcaaatatcacctctgcagagattttcctcactccctgtgccacctagcagaaactggtccttcctcctcctgctgcccgtggcatgcacgtcttcttcaggctccacattgccatcatggtgtggacgacccccaccagcatgggcgaggtgtcgccctggctgacttcaaccgtgatggcaaagtggacatcgtctatggcaactggaatggcccccaccgcctctatctgcaaatgagcacccatgggaaggtccgcttccgggacatcgcctcacccaagttctccatgccctcccctgtccgcacggtcatcaccgccgactttgacaatgaccaggagctggagatcttcttcaacaacattgcctaccgcagctcctcagccaaccgcctcttccgcgtcatccgtagagagcacggagaccccctcatcgaggagctcaatcccggcgacgccttggagcctgagggccggggcacagggggtgtggtgaccgacttcgacggagacgggatgctggacctcatcttgtcccatggagagtccatggctcagccgctgtccgtcttccggggcaatcagggcttcaacaacaactggctgcgagtggtgccacgcacccggtttggggcctttgccaggggagctaaggtcgtgctctacaccaagaagagtggggcccacctgaggatcatcgacgggggctcaggctacctgtgtgagatggagcccgtggcacactttggcctggggaaggatgaagccagcagtgtggaggtgacgtggccagatggcaagatggtgagccggaacgtggccagcggggagatgaactcagtgctggagatcctctacccccgggatgaggacacacttcaggacccagccccactggagtgtggccaaggattctcccagcaggaaaatggccattgcatggacaccaatgaatgcatccagttcccattcgtgtgccctcgagacaagcccgtatgtgtcaacacctatggaagctacaggtgccggaccaacaagaagtgcagtcggggctacgagcccaacgaggatggcacagcctgcgtggctcaagtggcctttttaggtgggtattcttcagccgcctctagaatctctgagcctctctctcgggcctcatatctttctctaggccttggactttgccttcagttatatgcactttaa

SEQ ID NO: 9790 - DNA, 2438 bp, synthetic construct
  misc_feature 1..2438: note = Synthetic polypeptide
  source 1..2438: mol_type = other DNA
cggggctgcggggcgaacggcgcggctaggatccggcggctcagcccggggcggcgaggctcggcacggagatggcggcgcgctcggcgcaggaggccctgtcggcccccacctgctccccaacctctgactccgagaacctcagccccgatgagctggagctgctggccaagctcgaagagcagaaccggctcctggaggccgactccaagtccatgcgctccatgaatggctcgcggcggaacagtggctcctcgctagtgtccagctcctcggcctcctccaacctgagccacctggaggaggacacgtggatcctgtggggccggatcgccaacgagtgggaggagtggcggcgcaggaaggagaagctgctcaaggagctgatccgcaagggcatcccccaccacttccgggccatcgtgtggcagcttctgtgcagcgccacggacatgcccgtcaagaaccagtactccgagctgctcaagatgtcctcgccgtgcgagaagctgatccgcagggacatcgcccgcacctacccggaacatgagttcttcaagggccaggacagcctgggccaggaggtcctcttcaacgtcatgaaggcatactcgctggtagaccgggaggtgggctactgccagggaagcgccttcatcgtgggcctgctcctcatgcagatgcctgaggaggaggccttctgtgtgttcgtgcggctgatgcaggagtaccggctgcgggagctcttcaaacccagcatggccgagctcgggctctgcatctatcagttcgagtacatgctgcaggagcagctcccagacctcaacacccacttccgttcccaaagcttccacacatccatgtatgcctcgtcctggttcctcacactgttcctgaccaccttcccactccccgtcgccacccgggtctttgacatcttcatgtatgaggggctggagatcgtgttccgagtgggcctcgccctgctgcaggtgaaccaggcagagctgatgcagctggacatggaggggatgtcccagtacttccagagagtgatcccccaccagttcgacagctgcccggacaagctggtcctcaaagcctaccaggtcaagtacaaccccaagaagatgaagaggctggagaaggagtacgcagccatgaagagcaaggagatggaggagcagatcgagatcaaaagacttcggacggagaaccggctcctgaaacagcggattgaaaccctagagaaggggcaagtgacacgggcgcaggaggcggaggagaactacgtcatcaagcgggagctggcggtggtgcggcagcagtgcagctcggcggccgaggacctgcagaaggcacagagcaccatccggcagctacaggagcagcaggagaacccccgcctcacagaagacttcgtgtcccacctggagaccgagctggagcagtcgaggctgcgggagacggagacactgggggcccttcgggagatgcaggacaaggttctcgacatggaaaagaggaacagctcgctgcccgacgagaacaatgtggcgcagctgcaggaggagctgaaggcgctcaaggtgcgggaaggccaggcggtggcctcgacgcgagagcttaaactgcagctgcaggagctctcggacacctggcaggcccatctggcccgcggcggccgctggaaggagtccccacggaagctggtcgtgggcgagctgcaggacgagctgatgagcgtgcgtctgcgcgaggcccaggccctggccgagggccgcgagctgcggcagcgcgtggtggaacttgagacgcaggaccacatccaccgcaaccttctgaaccgcgtggaggcggagcgcgcggcgctgcaggagaagctgcagtacctggctgcacagaacaaggggctgcagacgcagctcagcgaaagccgccgcaagcaggccgaggccgagtgcaagagcaaggaggaggtgatggctgtgcgactgcgggaggcggacagcatggctgcggtggccgagatgcggcagcgcattgccgagctggagatccagagggaggaaggccgcatccagggccagctgaaccactcggactcatcgcagtacatccgcgagctcaaggaccagatcgaggagctgaaggccgaggtgcggctgctgaagggcccgccgcccttcgaggacccgctggctttcgatgggctgagcctggcgcggcacttggacgaggactcgctgccgtcgtcggacgaggagctacttggcgtaggcgtgggcgctgccctgcaggacgcattgtatcctctgtccccgcgcgatgcgcgcttcttccgccgtctggagcggccggccaaggacagcgagggcagctcagacagcgacgccgatgagctggccgcgccctacagccagggtctggacaactga

SEQ ID NO: 9791 - DNA, 2471 bp, synthetic construct
  misc_feature 1..2471: note = Synthetic polypeptide
  source 1..2471: mol_type = other DNA
cggggctgcggggcgaacggcgcggctaggatccggcggctcagcccggggcggcgaggctcggcacggagatggcggcgcgctcggcgcaggaggccctgtcggcccccacctgctccccaacctctgactccgagaacctcagccccgatgagctggagctgctggccaagctcgaagagcagaaccggctcctggaggccgactccaagtccatgcgctccatgaatggctcgcggcggaacagtggctcctcgctagtgtccagctcctcggcctcctccaacctgagccacctggaggaggacacgtggatcctgtggggccggatcgccaacgagtgggaggagtggcggcgcaggaaggagaagctgctcaaggagctgatccgcaagggcatcccccaccacttccgggccatcgtgtggcagcttctgtgcagcgccacggacatgcccgtcaagaaccagtactccgagctgctcaagatgtcctcgccgtgcgagaagctgatccgcagggacatcgcccgcacctacccggaacatgagttcttcaagggccaggacagcctgggccaggaggtcctcttcaacgtcatgaaggcatactcgctggtagaccgggaggtgggctactgccagggaagcgccttcatcgtgggcctgctcctcatgcagatgcctgaggaggaggccttctgtgtgttcgtgcggctgatgcaggagtaccggctgcgggagctcttcaaacccagcatggccgagctcgggctctgcatctatcagttcgagtacatgctgcaggagcagctcccagacctcaacacccacttccgttcccaaagcttccacacatccatgtatgcctcgtcctggttcctcacactgttcctgaccaccttcccactccccgtcgccacccgggtctttgacatcttcatgtatgaggggctggagatcgtgttccgagtgggcctcgccctgctgcaggtgaaccaggcagagctgatgcagctggacatggaggggatgtcccagtacttccagagagtgatcccccaccagttcgacagctgcccggacaagctggtcctcaaagcctaccaggtcaagtacaaccccaagaagatgaagaggctggagaaggagtacgcagccatgaagagcaaggagatggaggagcagatcgagatcaaaagacttcggacggagaaccggctcctgaaacagcggattgaaaccctagagaaggagagcgctgctctggctgataggttaatccaggggcaagtgacacgggcgcaggaggcggaggagaactacgtcatcaagcgggagctggcggtggtgcggcagcagtgcagctcggcggccgaggacctgcagaaggcacagagcaccatccggcagctacaggagcagcaggagaacccccgcctcacagaagacttcgtgtcccacctggagaccgagctggagcagtcgaggctgcgggagacggagacactgggggcccttcgggagatgcaggacaaggttctcgacatggaaaagaggaacagctcgctgcccgacgagaacaatgtggcgcagctgcaggaggagctgaaggcgctcaaggtgcgggaaggccaggcggtggcctcgacgcgagagcttaaactgcagctgcaggagctctcggacacctggcaggcccatctggcccgcggcggccgctggaaggagtccccacggaagctggtcgtgggcgagctgcaggacgagctgatgagcgtgcgtctgcgcgaggcccaggccctggccgagggccgcgagctgcggcagcgcgtggtggaacttgagacgcaggaccacatccaccgcaaccttctgaaccgcgtggaggcggagcgcgcggcgctgcaggagaagctgcagtacctggctgcacagaacaaggggctgcagacgcagctcagcgaaagccgccgcaagcaggccgaggccgagtgcaagagcaaggaggaggtgatggctgtgcgactgcgggaggcggacagcatggctgcggtggccgagatgcggcagcgcattgccgagctggagatccagagggaggaaggccgcatccagggccagctgaaccactcggactcatcgcagtacatccgcgagctcaaggaccagatcgaggagctgaaggccgaggtgcggctgctgaagggcccgccgcccttcgaggacccgctggctttcgatgggctgagcctggcgcggcacttggacgaggactcgctgccgtcgtcggacgaggagctacttggcgtaggcgtgggcgctgccctgcaggacgcattgtatcctctgtccccgcgcgatgcgcgcttcttccgccgtctggagcggccggccaaggacagcgagggcagctcagacagcgacgccgatgagctggccgcgccctacagccagggtctggacaactga

SEQ ID NO: 9792 - DNA, 1430 bp, synthetic construct
  misc_feature 1..1430: note = Synthetic polypeptide
  source 1..1430: mol_type = other DNA
ggcggagcgcgatggctcacacctgtaatcctagcactttgggagtcagaggcaggcggatcacttgagatgaggagttcgaaaccagtctggccatcatgagattttattccctcaaagttgcccccaaagttaaagccacagctgcgcctgcaggagcaccgccacaacctcaggaccttgagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctgacgacaaaaggagcttcatctttcaagataacccgtggaattgaagcagttggtggcaaattaagtgtgaccgcaacaagggaaaacatggcttatactgtggaatgcctgcggggtgatgttgatattctaatggagttcctgctcaatgtcaccacagcaccagaatttcgtcgttgggaagtagctgaccttcagcctcagctaaagattgacaaagctgtggcctttcagaatccgcagactcatgtcattgaaaatttgcatgcagcagcttaccggaatgccttggctaatcccttgtattgtcctgactataggattggaaaagtgacatcagaggagttacattacttcgttcagaaccatttcacaagtgcaagaatggctttgattggacttggtgtgagtcatcctgttctaaagcaagttgctgaacagtttctcaacatgaggggtgggcttggtttatctggtgcaaaggccaactaccgtggaggtgaaatccgagaacagaatggagacagtcttgtccatgctgcttttgtagcagaaagtgctgtcgcgggaagtgcagaggcaaatgcatttagtgttcttcagcatgtcctcggtgctgggccacatgtcaagaggggcagcaacaccaccagccatctgcaccaggctgttgccaaggcaactcagcagccatttgatgtttctgcatttaatgccagttactcagattctggactctttgggatttatactatctcccaggccacagctgctggagatgttatcaaggctgcctataatcaagtaaaaacaatagctcaaggaaacctttccaacacagatgtccaagctgccaagaacaagctgaaagctggatacctaatgtcagtggagtcttctgagtgtttcctggaagaagtcgggtcccaggctctagttgctggttcttacatgccaccatccacagtccttcagcagattgattcagtggctaatgctgatatcataaatgcggcaaagaagtttgtttctggccagaagtcaatggcagcaagtggaaatttgggacatacaccttttgttgatgagttgtaa

SEQ ID NO: 9793 - DNA, 467 bp, synthetic construct
  misc_feature 1..467: note = Synthetic polypeptide
  source 1..467: mol_type = other DNA
ggcggagcgcgatggctcacacctgtaatcctagcactttgggagtcagaggcaggcggatcacttgagatgaggagttcgaaaccagtctggccatcatgagattttattccctcaaagttgcccccaaagttaaagccacagctgcgcctgcaggagcaccgccacaacctcaggaccttgagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctgacgacaaaaggagcttcatctttcaagataacccgtggaattgaagcagttggtggcaaattaagtgttcacagcatcttcaaccaggagcagattctatctcaagaaaccactttgtttgctcatccataa

SEQ ID NO: 9794 - DNA, 1307 bp, synthetic construct
  misc_feature 1..1307: note = Synthetic polypeptide
  source 1..1307: mol_type = other DNA
ggcggagcgcgatggctcacacctgtaatcctagcactttgggagtcagaggcaggcggatcacttgagatgaggagttcgaaaccagtctggccatcatgagattttattccctcaaagttgcccccaaagttaaagccacagctgcgcctgcaggagcaccgccacaacctcaggaccttgagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctgacgacaaaaggagcttcatctttcaagataacccgtggaattgaagcagttggtggcaaattaagtgtgaccgcaacaagggaaaacatggcttatactgtggaatgcctgcggggtgatgttgatattctaatggagttcctgctcaatgtcaccacagcaccagaatttcgtcgttgggaagtagctgaccttcagcctcagctaaagattgacaaagctgtggcctttcagaatccgcagactcatgtcattgaaaatttgcatgcagcagcttaccggaatgccttggctaatcccttgtattgtcctgactataggattggaaaagtgacatcagaggagttacattacttcgttcagaaccatttcacaagtgcaagaatggctttgattggacttggtgtgagtcatcctgttctaaagcaagttgctgaacagtttctcaacatgaggggtgggcttggtttatctggtgcaaaggccaactaccgtggaggtgaaatccgagaacagaatggagacagtcttgtccatgctgcttttgtagcagaaagtgctgtcgcgggaagtgcagaggcaaatgcatttagtgttcttcagcatgtcctcggtgctgggccacatgtcaagaggggcagcaacaccaccagccatctgcaccaggctgttgccaaggcaactcagcagccatttgatgtttctgcatttaatgccagttactcagattctggactctttgggatttatactatctcccaggccacagctgctggagatgttatcaaggctgcctataatcaagtaaaaacaatagctcaaggaaacctttccaacacagatgtccaagctgccaagcggcaaagaagtttgtttctggccagaagtcaatggcagcaagtggaaatttgggacatacaccttttgttgatgagttgtaatactgatgcacacattacaggagagagctga

SEQ ID NO: 9795 - DNA, 1079 bp, synthetic construct
  misc_feature 1..1079: note = Synthetic polypeptide
  source 1..1079: mol_type = other DNA
ggcggagcgcgatggctcacacctgtaatcctagcactttgggagtcagaggcaggcggatcacttgagatgaggagttcgaaaccagtctggccatcatgagattttattccctcaaagttgcccccaaagttaaagccacagctgcgcctgcaggagcaccgccacaacctcaggaccttgagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctgacgacaaaaggagcttcatctttcaagataacccgtggaattgaagcagttggtggcaaattaagtgtgaccgcaacaagggaaaacatggcttatactgtggaatgcctgcggggtgatgttgatattctaatggagttcctgctcaatgtcaccacagcaccagaatttcgtcgttgggaagtagctgaccttcagcctcagctaaagattgacaaagctgtggcctttcagaatccgcagactcatgtcattgaaaatttgcatgcagcagcttaccggaatgccttggctaatcccttgtattgtcctgactataggattggaaaagtgacatcagaggagttacattacttcgttcagaaccatttcacaagtgcaagaatggctttgattggacttggtgtgagtcatcctgttctaaagcaagttgctgaacagtttctcaacatgaggggtgggcttggtttatctggtgcaaaggccaactaccgtggaggtgaaatccgagaacagaatggagacagtcttgtccatgctgcttttgtagcagaaagtgctgtcgcgggaagtgcagaggcaaatgcatttagtgttcttcagcatgtcctcggtgctgggccacatgtcaagaggggcagcaacaccaccagccatctgcaccaggctgttgccaaggcaactcagcagccatttgatgaacaagctgaaagctggatacctaatgtcagtggagtcttctga

SEQ ID NO: 9796 - DNA, 419 bp, synthetic construct
  misc_feature 1..419: note = Synthetic polypeptide
  source 1..419: mol_type = other DNA
ggcggagcgcgatggctcacacctgtaatcctagcactttgggagtcagaggcaggcggatcacttgagatgaggagttcgaaaccagtctggccatcatgagattttattccctcaaagttgcccccaaagttaaagccacagctgcgcctgcaggagcaccgccacaacctcaggaccttgagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctgacgacaaaaggagcttcatctttcaagataacccgtggaattgaagcagttggtggcaaattaagggaaatgggtaaagtatga

SEQ ID NO: 9797 - DNA, 499 bp, synthetic construct
  misc_feature 1..499: note = Synthetic polypeptide
  source 1..499: mol_type = other DNA
gtggagagatccctagagatgcagtctgtggccctgggttccaacccagtgtgccaccacctggctgtgtgaccttcagcaagtgccattatttctctgagcctgtttgtttataaaatgaggaagagttggcacaagtttgaaaagatttctcaggctccacccggttctgaaattcgagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttc

SEQ ID NO: 9798 - DNA, 1050 bp, synthetic construct
  misc_feature 1..1050: note = Synthetic polypeptide
  source 1..1050: mol_type = other DNA
gtggagagatccctagagatgcagtctgtggccctgggttccaacccagtgtgccaccacctggctgtgtgaccttcagcaagtgccattatttctctgagcctgtttgtttataaaatgaggaagagttggcacaagtttgaaaagatttctcaggctccacccggttctgaaattcgagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggctt

SEQ ID NO: 9799 - DNA, 1978 bp, synthetic construct
  misc_feature 1..1978: note = Synthetic polypeptide
  source 1..1978: mol_type = other DNA
gtggagagatccctagagatgcagtctgtggccctgggttccaacccagtgtgccaccacctggctgtgtgaccttcagcaagtgccattatttctctgagcctgtttgtttataaaatgaggaagagttggcacaagtttgaaaagatttctcaggctccacccggttctgaaattcgagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaagcgcacagtgcagaaaaacgccaagtacatctgcctggctaacaaggactgccctgtggacaagaggcggcgaaaccgctgccagttctgccgcttccagaagtgcctggcggtgggcatggtgaaggaagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctga

SEQ ID NO: 9800 - DNA, 1255 bp, synthetic construct
  misc_feature 1..1255: note = Synthetic polypeptide
  source 1..1255: mol_type = other DNA
gcagggcacagtggctcacgcctgtaatcccagcactttggaaggccaacgcaggaggatcgcttgagcccaggagtttgagaccagcttggaagtggtcatagtaagtgctacaagaacacccattggatcttttttaggcagcctttccttgctgccagccactaagcttggttccattgcaattcagggagccattgaaaaggcagggattccaaaagaagaagtgaaagaagcatacatgggtaatgttctacaaggaggtgaaggacaagctcctacaaggcaggcagtattgggtgcaggcttacctatttctactccatgtaccaccataaacaaagtttgtgcttcaggaatgaaagccatcatgatggcctctcaaagtcttatgtgtggacatcaggatgtgatggtggcaggtgggatggagagcatgtccaatgttccatatgtaatgaacagaggatcaacaccatatggtggggtaaagcttgaagatttgattgtaaaagacgggctaactgatgtctacaataaaattcatatgggcagctgtgctgagaatacagcaaagaagctgaatattgcacgaaatgaacaggacgcttatgctattaattcttataccagaagtaaagcagcatgggaagctgggaaatttggaaatgaagttattcctgtcacagttacagtaaaaggtcaaccagatgtagtggtgaaagaagatgaagaatataaacgtgttgattttagcaaagttccaaagctgaagacagttttccagaaagaaaatggcacagtaacagctgccaatgccagtacactgaatgatggagcagctgctctggttctcatgacggcagatgcagcgaagaggctcaatgttacaccactggcaagaatagtagcatttgctgacgctgctgtagaacctattgattttccaattgctcctgtatatgctgcatctatggttcttaaagatgtgggattgaaaaaagaagatattgcaatgtgggaagtaaatgaagcctttagtctggttgtactagcaaacattaaaatgttggagattgatccccaaaaagtgaatatcaatggaggagctgtttctctgggacatccaattgggatgtctggagccaggattgttggtcatttgactcatgccttgaagcaaggagaatacggtcttgccagtatttgcaatggaggaggaggtgcttctgccatgctaattcagaagctgtag

SEQ ID NO: 9801 - DNA, 460 bp, synthetic construct
  misc_feature 1..460: note = Synthetic polypeptide
  source 1..460: mol_type = other DNA
gcagggcacagtggctcacgcctgtaatcccagcactttggaaggccaacgcaggaggatcgcttgagcccaggagtttgagaccagcttggaagtggtcatagtaagtgctacaagaacacccattggatcttttttaggcagcctttccttgctgccagccactaagcttggttccattgcaattcagggagccattgaaaaggcagggattccaaaagaagaagtgaaagaagcatacatgggtaatgttctacaaggaggtgaaggacaagctcctacaaggcaggcagtattgggtgcaggcttacctatttctactccatgtaccaccataaacaaagtttgtgcttcaggaatgaaagccatcatgatggcctctcaaagtcttatgtgtggacatcagatcaagcaagagacaggctccttagcaaaaatatgctgtcatgtcaggaggtga

SEQ ID NO: 9802 - DNA, 397 bp, synthetic construct
  misc_feature 1..397: note = Synthetic polypeptide
  source 1..397: mol_type = other DNA
gcagggcacagtggctcacgcctgtaatcccagcactttggaaggccaacgcaggaggatcgcttgagcccaggagtttgagaccagcttggaagtggtcatagtaagtgctacaagaacacccattggatcttttttaggcagcctttccttgctgccagccactaagcttggttccattgcaattcagggagccattgaaaaggcagggattccaaaagaagaagtgaaagaagcatacatgggtaatgttctacaaggaggtgaaggacaagctcctacaaggcaggcagtattgggtgcaggatgtgatggtggcaggtgggatggagagcatgtccaatgttccatatgtaatgaacagaggatcaacaccatatggtggggtaaagcttga

SEQ ID NO: 9803 - DNA, 306 bp, synthetic construct
  misc_feature 1..306: note = Synthetic polypeptide
  source 1..306: mol_type = other DNA
cttcctgggttcaaacaccagctctacccctgacttgctgtataactgtgggggaatttcttctctgcacttccaccctcttgtggattacaccagaatgacattgacgcctcataaggttgccataatggcggcagccccaagggggacgtggacccgttctactatgactatgagaccgttcgcaatgggggcctgatcttcgctggactggccttcatcgtggggctcctcatcctcctcagcagaagattccgctgtgggggcaataagaagcgcaggcaaatcaatgaagatgagccgtaa

SEQ ID NO: 9804 - DNA, 197 bp, synthetic construct
  misc_feature 1..197: note = Synthetic polypeptide
  source 1..197: mol_type = other DNA
cttcctgggttcaaacaccagctctacccctgacttgctgtataactgtgggggaatttcttctctgcacttccaccctcttgtggattacaccagaatgacattgacgcctcataaggttgccataatggcggcagccccaagggggacgtggacccgttctactatggcagaagattccgctgtgggggcaataa

SEQ ID NO: 9805 - DNA, 1444 bp, synthetic construct
  misc_feature 1..1444: note = Synthetic polypeptide
  source 1..1444: mol_type = other DNA
ggctgggtgcattgtctgacatctgtaatcccagcattttaggaggccaaggcaggaggatcacttggagccaggagtttgagaccagcctgggcaacaaagtgagacccccatctctacaaaaaataaaaacacttaaaaattatccgggtaccgtgcatgtgcagtcccagctactcaggaggctgaggcaggaggatcacagtgacctataatgagccgttgtgctccagcctgggcgacagaagtcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagaccactctgcttcatttttgggagaaaacttctcacactatggcagccatccatgagagtttcaaaggttatcaaccatatgaatttactactttaaagagcttacaagaccctatgaaaaaattagttgagaaagaagagaagaagaaaatcaaccagcaggaaagtacagatgcagccgtgcaggagccgagccaattaatttcattagaggaagaaaaccagcgcaaggaatcctctagttttaagactgaagatggaaaaagtattttatctgccttagacaaaggctctacacatactgcatgctcaggacccatagatgaactattagacatgaaatctgaggaaggtgcttgcctgggaccagtggcagggaccccggaacctgaaggtgctgacaaagatgacctgctgctgttgagtgagatcttcaatgcttcctccttggaagagggcgagttcagcaaagagtgggccgctgtgtttggagacggccaagtgaaggagccagtgcccactatggccctgggagagccagaccccaaggcccagacaggctcaggtttccttccttcgcagcttttagaccaaaatatgaaagacttacaggcctcgctacaagaacctgctaaggctgcctcagacctgactgcctggttcagcctcttcgctgacctcgacccactctcaaatcctgatgctgttgggaaaaccgataaagaacacgaattgctcaatgcatga

SEQ ID NO: 9806 - DNA, 766 bp, synthetic construct
  misc_feature 1..766: note = Synthetic polypeptide
  source 1..766: mol_type = other DNA
ggctgggtgcattgtctgacatctgtaatcccagcattttaggaggccaaggcaggaggatcacttggagccaggagtttgagaccagcctgggcaacaaagtgagacccccatctctacaaaaaataaaaacacttaaaaattatccgggtaccgtgcatgtgcagtcccagctactcaggaggctgaggcaggaggatcacagtgacctataatgagccgttgtgctccagcctgggcgacagaagtcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagcttgcctgggaccagtggcagggaccccggaacctgaaggtgctgacaaagatgacctgctgctgttga

SEQ ID NO: 9807 - DNA, 1531 bp, synthetic construct
  misc_feature 1..1531: note = Synthetic polypeptide
  source 1..1531: mol_type = other DNA
ggctgggtgcattgtctgacatctgtaatcccagcattttaggaggccaaggcaggaggatcacttggagccaggagtttgagaccagcctgggcaacaaagtgagacccccatctctacaaaaaataaaaacacttaaaaattatccgggtaccgtgcatgtgcagtcccagctactcaggaggctgaggcaggaggatcacagtgacctataatgagccgttgtgctccagcctgggcgacagaagtcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagaccactctgcttcatttttgggagaaaacttctcacactatggcagccatccatgagagtttcaaaggttatcaaccatatgaatttactactttaaagagcttacaagaccctatgaaaaaattagttgagaaagaagagaagaagaaaatcaaccagcaggaaagtacagatgcagccgtgcaggagccgagccaatatttacagaatatttgcctcgagatgaaagcaaattcagatattaagatgctacagaaagggaaagaaggccagcaaattggcatattaatttcattagaggaagaaaaccagcgcaaggaatcctctagttttaagactgaagatggaaaaagtattttatctgccttagacaaaggctctacacatactgcatgctcaggacccatagatgaactattagacatgaaatctgaggaaggtgcttgcctgggaccagtggcagggaccccggaacctgaaggtgctgacaaagatgacctgctgctgttgagtgagatcttcaatgcttcctccttggaagagggcgagttcagcaaagagtgggccgctgtgtttggagacggccaagtgaaggagccagtgcccactatggccctgggagagccagaccccaaggcccagacaggctcaggtttccttccttcgcagcttttagaccaaaatatgaaagacttacaggcctcgctacaagaacctgctaaggctgcctcagacctgactgcctggttcagcctcttcgctgacctcgacccactctcaaatcctgatgctgttgggaaaaccgataaagaacacgaattgctcaatgcatga

SEQ ID NO: 9808 - DNA, 1045 bp, synthetic construct
  misc_feature 1..1045: note = Synthetic polypeptide
  source 1..1045: mol_type = other DNA
ggctgggtgcattgtctgacatctgtaatcccagcattttaggaggccaaggcaggaggatcacttggagccaggagtttgagaccagcctgggcaacaaagtgagacccccatctctacaaaaaataaaaacacttaaaaattatccgggtaccgtgcatgtgcagtcccagctactcaggaggctgaggcaggaggatcacagtgacctataatgagccgttgtgctccagcctgggcgacagaagtcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagaccactctgcttcatttttgggagaaaacttctcacactatggcagccatccatgagagtttcaaaggttatcaaccatatgaatttactactttaaaggtatggaagctagaggggccactagaaaatcttgagaaaagtaaagttttgtttatatcacaagcaaagtccattgcagaaagcatcattattccaggactcagaatgctgaagagagaactgtgcccccagcagagtctttttctttctttctttctttctttttttttttttttttttttttttactgcatcaggattcaatacaatgagaatctactgcaatccaaaagcgcgaattgaaccttga

SEQ ID NO: 9809 - DNA, 796 bp, synthetic construct
  misc_feature 1..796: note = Synthetic polypeptide
  source 1..796: mol_type = other DNA
ggctgggtgcattgtctgacatctgtaatcccagcattttaggaggccaaggcaggaggatcacttggagccaggagtttgagaccagcctgggcaacaaagtgagacccccatctctacaaaaaataaaaacacttaaaaattatccgggtaccgtgcatgtgcagtcccagctactcaggaggctgaggcaggaggatcacagtgacctataatgagccgttgtgctccagcctgggcgacagaagtcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagaccactctgcttcatttttgggagaaaacttctcacactatggcagccatccatgagagtttcaaaggttatcaaccatatgaatttactactttaaag

SEQ ID NO: 9810 - DNA, 478 bp, synthetic construct
  misc_feature 1..478: note = Synthetic polypeptide
  source 1..478: mol_type = other DNA
ggctgggtgcattgtctgacatctgtaatcccagcattttaggaggccaaggcaggaggatcacttggagccaggagtttgagaccagcctgggcaacaaagtgagacccccatctctacaaaaaataaaaacacttaaaaattatccgggtaccgtgcatgtgcagtcccagctactcaggaggctgaggcaggaggatcacagtgacctataatgagccgttgtgctccagcctgggcgacagaagtcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgc

SEQ ID NO: 9811 - DNA, 397 bp, synthetic construct
  misc_feature 1..397: note = Synthetic polypeptide
  source 1..397: mol_type = other DNA
ggctgggtgcattgtctgacatctgtaatcccagcattttaggaggccaaggcaggaggatcacttggagccaggagtttgagaccagcctgggcaacaaagtgagacccccatctctacaaaaaataaaaacacttaaaaattatccgggtaccgtgcatgtgcagtcccagctactcaggaggctgaggcaggaggatcacagtgacctataatgagccgttgtgctccagcctgggcgacagaagtcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgt

SEQ ID NO: 9812 - DNA, 132 bp, synthetic construct
  misc_feature 1..132: note = Synthetic polypeptide
  source 1..132: mol_type = other DNA
atccattagtgggtaatgtgaccaatttcatgagacgtaatttttttttttgaaaaaaaataaaatacaagtaccagagtaaatcacaagctataagcatctgacagatacgtctcatggtgtaagaaataa

SEQ ID NO: 9813 - DNA, 2518 bp, synthetic construct
  misc_feature 1..2518: note = Synthetic polypeptide
  source 1..2518: mol_type = other DNA
atccattagtgggtaatgtgaccaatttcatgagacgtaatttttttttttgaaaaaaaataaaatacaagtaccagagtaaatcacaagctataagcatctgacagatacgtctcatggtgtaagaaataagtgcctgcagttacttggcaatcttggctctttggagaaaagtgtcacaaaagatgcagaaggcctagctgccagagatgtccagaagattataggggattacttcagtgaccaagacccacgtgtcagaacagcagctataaaagccatgttgcagctccatgaaagaggactgaaattacaccaaacaatttataatcaggcctgtaaattactctctgatgactatgaacaagtgcgcagtgctgcagtccagcttatctgggtcgtcagtcagctctatcctgaaagcattgtcccaattccttcttctaatgaagaaatacgcttagttgatgatgcgtttggcaaaatttgtcacatggtcagtgatggctcttgggtggttcgtgttcaggcagcaaaactgttgggctctatggagcaagtcagttctcatttcttggagcagacccttgacaagaagctgatgtcagatctgaggaggaaacgtactgcacatgagcgtgccaaggaactttacagttcgggggagttttccagtggcagaaagtggggagatgatgctcccaaggaagaagtagataccggggctgtgaacttgattgagtcaggagcttgtggagcttttgttcatgggttggaagatgagatgtatgaggttcgtattgctgctgtggaggccctctgcatgttggcccagtcttcaccctcttttgctgagaagtgccttgatttcctagttgacatgttcaacgatgaaattgaggaagtacgtctgcagtctatacataccatgagaaaaatctctaacaacatcaccctccgagaagatcagcttgacactgtcctggctgtgctagaggattcatccagagatattcgagaggctcttcatgaactcttatgctgtactaatgtttcaaccaaagaagggattcatcttgcattggtggagctgctgaaaaatttaaccaagtaccctactgatagggactccatatggaagtgcttgaagtttctgggaagtcggcatccaaccctggtgcttcccttggtgccagagcttctgagcacccacccattttttgacacagctgaaccagacatggatgatccagcttatattgcagttttggtacttattttcaatgctgctaaaacctgtccaacaatgccagcattgttctcagatcacaccttcaggcactatgcctacctccgagacagtctttctcatcttgttcctgccttgaggttaccaggtagaaaactggtgtcatcagctgtttctcccagcatcatacctcaagaggatccttcccagcagttcctgcagcagagccttgaaagagtgtatagtcttcagcacttggaccctcagggagcccaggagctgctggaattcaccatcagggatctgcaaagacttggagaacttcaatctgaattggcaggagtagctgatttctctgccacctatcttcgctgtcaactacttctcatcaaggccttgcaggaaaagttgtggaatgtagctgcccctttgtatttgaagcagagtgatttggcctcagcagcagcgaaacagattatggaagagacctacaaaatggaattcatgtacagtggtgtggagaataagcaggtggtgattatacatcacatgaggctgcaggccaaagctttgcaacttatagtaacagcacgaactacacgaggacttgaccccttatttgggatgtgtgaaaaatttttacaggaagtagacttttttcagaggtatttcatcgctgatttgccccacttgcaggacagctttgtggacaaactccttgaccttatgccccgactcatgacatccaaacctgcagaagtggtcaaaattctacagaccatgctgcgacagagtgcctttctgcatctcccgcttccagagcagatccacaaagcctcagccaccatcatcgagccagcgggcgagtcagacaaccctttgcggtttacctctgggttggtggttgccctggatgttgatgcaaccctggagcatgtgcaggatcctcagaacactgttaaggtccaggtcttatatccagatggccaggctcagatgattcaccccaagcctgcagacttccggaatcctggcccagggcggcaccggctcatcactcaggtttatctctcccacaccgcttggacagaggcatgccaggtggaagtgaggctgctgctggcctacaactccagtgctcgcattccaaaatgcccctggatggagggtggtgagatgtcaccacaggtggaaaccagcatcgagggcaccattcccttcagcaagcctgtaaaagtttatataatgcccaaacctgcacggcgctaa

SEQ ID NO: 9814 - DNA, 1144 bp, synthetic construct
  misc_feature 1..1144: note = Synthetic polypeptide
  source 1..1144: mol_type = other DNA
atccattagtgggtaatgtgaccaatttcatgagacgtaatttttttttttgaaaaaaaataaaatacaagtaccagagtaaatcacaagctataagcatctgacagatacgtctcatggtgtaagaaataagtgcctgcagttacttggcaatcttggctctttggagaaaagtgtcacaaaagatgcagaaggcctagctgccagagatgtccagaagattataggggattacttcagtgaccaagacccacgtgtcagaacagcagctataaaagccatgttgcagctccatgaaagaggactgaaattacaccaaacaatttataatcaggcctgtaaattactctctgatgactatgaacaagtgcgcagtgctgcagtccagcttatctgggtcgtcagtcagctctatcctgaaagcattgtcccaattccttcttctaatgaagaaatacgcttagttgatgatgcgtttggcaaaatttgtcacatggtcagtgatggctcttgggtggttcgtgttcaggcagcaaaactgttgggctctatggagcaagtcagttctcatttcttggagcagacccttgacaagaagctgatgtcagatctgaggaggaaacgtactgcacatgagcgtgccaaggaactttacagttcgggggagttttccagtggcagaaagtggggagatgatgctcccaaggaagaagtagataccggggctgtgaacttgattgagtcaggagcttgtggagcttttgttcatgggttggaagatgagatgtatgaggttcgtattgctgctgtggaggccctctgcatgttggcccagtcttcaccctcttttgctgagaagtgccttgatttcctagttgacatgttcaacgatgaaattgaggaagtacgtctgcagtctatacataccatgagaaaaatctctaacaacatcaccctccgagaagatcagcttgacactgtcctggctgtgctagaggattcatccagagatattcgagaggctcttcatgaactcttatgctgtactaatgtttcaaccaaagaagggattcatcttgcattggtggagctgctgaaaaatttaaccaagtaccctactgatagggactccatatggaagtaa

SEQ ID NO: 9815 - DNA, 1238 bp, synthetic construct
  misc_feature 1..1238: note = Synthetic polypeptide
  source 1..1238: mol_type = other DNA
atgaatgaataaccaaattgtgatatatccatagaatgggatattatgccatcataaaaaggcatgaaggccctttttattgcataggaaggaatgctacaacatggatgaaccttggaaacattatgccagatgaaagaagccacctgcaattgaccacatattgtatgattctgtttatatgaactatccggaagaggcaaatccatggaggcagagagcagattagtggttgcccggtgctgagagcagggagagtgggaggtgactgcttcacaggtcctgatggggagaatagctggtccaagaagtacccgtcgtgtgggggcctgctgcagtcccccatagacctgcacagtgacatcctccagtatgacgccagcctcacgcccctcgagttccaaggctacaatctgtctgccaacaagcagtttctcctgaccaacaatggccattcagtgaagctgaacctgccctcggacatgcacatccagggcctccagtctcgctacagtgccacgcagctgcacctgcactgggggaacccgaatgacccgcacggctctgagcacaccgtcagcggacagcacttcgccgccgagctgcacattgtccattataactcagacctttatcctgacgccagcactgccagcaacaagtcagaaggcctcgctgtcctggctgttctcattgagatgggctccttcaatccgtcctatgacaagatcttcagtcaccttcaacatgtaaagtacaaaggccaggaagcattcgtcccgggattcaacattgaagagctgcttccggagaggaccgctgaatattaccgctaccgggggtccctgaccacacccccttgcaaccccactgtgctctggacagttttccgaaaccccgtgcaaatttcccaggagcagctgctggctttggagacagccctgtactgcacacacatggacgacccttcccccagagaaatgatcaacaacttccggcaggtccagaagttcgatgagaggctggtatacacctccttctcccaagtgcaagtctgtactgcggcaggactgagtctgggcatcatcctctcactggccctggctggcattcttggcatctgtattgtggtggtggtgtccatttggcttttcagaaggaagagtatcaaaaaaggtgataacaagggagtcatttacaagccagccaccaagatggagactgaggcccacgcttga

SEQ ID NO: 9816 - DNA, 1205 bp, synthetic construct
  misc_feature 1..1205: note = Synthetic polypeptide
  source 1..1205: mol_type = other DNA
atgaatgaataaccaaattgtgatatatccatagaatgggatattatgccatcataaaaaggcatgaaggccctttttattgcataggaaggaatgctacaacatggatgaaccttggaaacattatgccagatgaaagaagccacctgcaattgaccacatattgtatgattctgtttatatgaactatccggaagaggcaaatccatggaggcagagagcagattagtggttgcccggtgctgagagcagggagagtgggaggtgactgcttcacaggtcctgatggggagaatagctggtccaagaagtacccgtcgtgtgggggcctgctgcagtcccccatagacctgcacagtgacatcctccagtatgacgccagcctcacgcccctcgagttccaaggctacaatctgtctgccaacaagcagtttctcctgaccaacaatggccattcagtgaagctgaacctgccctcggacatgcacatccagggcctccagtctcgctacagtgccacgcagctgcacctgcactgggggaacccgaatgacccgcacggctctgagcacaccgtcagcggacagcacttcgccgccgagctgcacattgtccattataactcagacctttatcctgacgccagcactgccagcaacaagtcagaaggcctcgctgtcctggctgttctcattgagatgggctccttcaatccgtcctatgacaagatcttcagtcaccttcaacatgtaaagtacaaaggccaggaagcattcgtcccgggattcaacattgaagagctgcttccggagaggaccgctgaatattaccgctaccgggggtccctgaccacacccccttgcaaccccactgtgctctggacagttttccgaaaccccgtgcaaatttcccaggagcagctgctggctttggagacagccctgtactgcacacacatggacgacccttcccccagagaaatgatcaacaacttccggcaggtccagaagttcgatgagaggctggtatacacctccttctcccaaggcatcatcctctcactggccctggctggcattcttggcatctgtattgtggtggtggtgtccatttggcttttcagaaggaagagtatcaaaaaaggtgataacaagggagtcatttacaagccagccaccaagatggagactgaggcccacgcttga

SEQ ID NO: 9817 - DNA, 290 bp, synthetic construct
  misc_feature 1..290: note = Synthetic polypeptide
  source 1..290: mol_type = other DNA
gcaatgggtgcagtggagctaccgactccttcgaccacaaaaagttcttccaaatggtcggcctgaagaaaaagagtgcggatgatgtgaagaaggtgtttcacatgctggacaaggacaaaagtggcttcatcgaggaggatgagctgggattcatcctaaaaggcttctccccagatgccagagacctgtctgctaaagaaaccaagatgctgatggctgctggagacaaagatggggacggcaaaattggggttgacgaattctccactctggtggctgaaagctaa

SEQ ID NO: 9818 - DNA, 281 bp, synthetic construct
  misc_feature 1..281: note = Synthetic polypeptide
  source 1..281: mol_type = other DNA
gcaatgggtgcagtggagctaccgactccttcgaccacaaaaagttcttccaaatggtcggcctgaagaaaaagagtgcggatgatgtgaagaaggtgtttcacatgctggacaaggacaaaagtggcttcatcgaggaggatgagctgggattcatcctaaaaggcttctccccagatgccagagacctgtctgctaaagaaaccaagatgctgatggctgctggagacaaagatggggacggcaaaattggggttgacgatccagcagatgttgactga

SEQ ID NO: 9819 - DNA, 261 bp, synthetic construct
  misc_feature 1..261: note = Synthetic polypeptide
  source 1..261: mol_type = other DNA
gcaatgggtgcagtggagctaccgactccttcgaccacaaaaagttcttccaaatggtcggcctgaagaaaaagagtgcggatgatgtgaagaaggtgtttcacatgctggacaaggacaaaagtggcttcatcgaggaggatgagctgggattcatcctaaaaggcttctccccagatgccagagacctgtctgctaaagaaaccaagatgctgatggctgctggagacaaagatggggacggcaaaattggggttgacg

SEQ ID NO: 9820 - DNA, 233 bp, synthetic construct
  misc_feature 1..233: note = Synthetic polypeptide
  source 1..233: mol_type = other DNA
aagaaagacttttaacttgaaagtgaccaaaacaaataggaaaaaaaggaaccatcaggaagcagaagattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaac

SEQ ID NO: 9821 - DNA, 1604 bp, synthetic construct
  misc_feature 1..1604: note = Synthetic polypeptide
  source 1..1604: mol_type = other DNA
aagaaagacttttaacttgaaagtgaccaaaacaaataggaaaaaaaggaaccatcaggaagcagaagattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcagcaggatctggggccagctcacctctcacgtccccgtcatcgccaactccaccctctacatcagggatatctgcattacctccacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaaacctgtgatcacagtgctccgaagatcggctga

SEQ ID NO: 9822 - DNA, 1415 bp, synthetic construct
  misc_feature 1..1415: note = Synthetic polypeptide
  source 1..1415: mol_type = other DNA
aagaaagacttttaacttgaaagtgaccaaaacaaataggaaaaaaaggaaccatcaggaagcagaagattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcagcaggatctggggccagctcacctctcacgtccccgtcatcgccaactccaccctctacatcagtagagcatgcaccattttga

SEQ ID NO: 9823 - DNA, 1610 bp, synthetic construct
  misc_feature 1..1610: note = Synthetic polypeptide
  source 1..1610: mol_type = other DNA
aagaaagacttttaacttgaaagtgaccaaaacaaataggaaaaaaaggaaccatcaggaagcagaagattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcaggatctggggccagctcacctctcacgtccccgtcatcgccaactccaccctctacatcagctgccttaggtttgagtaaaagatgtaaagaaagggatatctgcattacctccacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaaacctgtga

SEQ ID NO: 9824 - DNA, 293 bp, synthetic construct
  misc_feature 1..293: note = Synthetic polypeptide
  source 1..293: mol_type = other DNA
aagaaagacttttaacttgaaagtgaccaaaacaaataggaaaaaaaggaaccatcaggaagcagaagattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgcacccttacatctatcgggttacctttgccacagctaa

SEQ ID NO: 9825 - DNA, 641 bp, synthetic construct
  misc_feature 1..641: note = Synthetic polypeptide
  source 1..641: mol_type = other DNA
atctgagtttgtcagcctctttcttcagcctctcagcttccttggactttagggatcatatggtaaaggaaccagtggaagacacagaccctagcactttatcctttaatatgtcagacaaatatcccattcaagatacggaactccctaaagctgaagaatgtgatacaattactttgaactgcccacgaaattcagatatgaaaaatcagggagaagaaaatggctttccagatagcactggagatcctcttccagagatcagcaaggacaactcctgcaaagaaaactgtacttgttcctcctgcttgctccgggcccccaccataagtgacttgctcaatgatcaggacttactagacgtgatcaggataaagctggatccgtgtcacccaacggtgaaaaactggaggaattttgcaagcaaatgggggatgtcctatgacgaattgtgcttcctggagcagaggccacagagccccaccttggagttcttgctccggaacagtcagaggacggtgggccagctgatggagctctgcaggctctaccacagggccgacgtggagaaggttctgcgcaggtgggtggacgaggagtggcccaagcgggagcgtggagacccctccaggcacttctag

SEQ ID NO: 9826 - DNA, 826 bp, synthetic construct
  misc_feature 1..826: note = Synthetic polypeptide
  source 1..826: mol_type = other DNA
tatagtggaagacctccgtgtggatggccgtggctgtgaggactaccgatgtgtcgaagtggaaactgatgtggtgtccaacactagtgggtccgccagggtcaagctgggtcacacagacatcttggtgggagtgaaagcagaaatggggacgccgaagctggagaaaccaaatgaaggctacttggagttctttgttgactgttcagccagtgctacccctgaatttgaaggtagaggaggtgatgaccttggcaccgagatcgctaacaccctctatcggatatttaacaataaaagcagtgtcgacttaaagaccctctgcattagtcctcgggagcactgctgggttctctatgtggatgtgctgcttctggaatgtggtggaaatttgtttgatgccatttccattgctgtaaaggctgctctcttcaatacaaggataccaagggttcgagttttggaggatgaagaggggtcgaaggacattgaattgtcagatgacccttatgactgcatacgactaagtgtggagaatgtcccctgcattgtcactctgtgcaagattggctatcggcatgtggtggatgctactcttcaggaggaggcctgctcgctggccagcttgctggtgtcggtgaccagcaagggagttgtgacgtgcatgaggaaagtggggaagggcagcctggacccagagagcatcttcgagatgatggagactggcaagcgtgtgggcaaggtactgcatgcctccttgcagagtgttgtgcacaaggaagaaagcctggggcccaagagacagaaagttggattcctgggatga

SEQ ID NO: 9827 - DNA, 560 bp, synthetic construct; identical to SEQ ID NO: 6322
  misc_feature 1..560: note = Synthetic polypeptide
  source 1..560: mol_type = other DNA

SEQ ID NO: 9828 - DNA, 479 bp, synthetic construct; identical to SEQ ID NO: 8856
  misc_feature 1..479: note = Synthetic polypeptide
  source 1..479: mol_type = other DNA

SEQ ID NO: 9829 - DNA, 692 bp, synthetic construct; identical to SEQ ID NO: 8857
  misc_feature 1..692: note = Synthetic polypeptide
  source 1..692: mol_type = other DNA

SEQ ID NO: 9830 - DNA, 773 bp, synthetic construct; identical to SEQ ID NO: 8858
  misc_feature 1..773: note = Synthetic polypeptide
  source 1..773: mol_type = other DNA

SEQ ID NO: 9831 - DNA, 1158 bp, synthetic construct
  misc_feature 1..1158: note = Synthetic polypeptide
  source 1..1158: mol_type = other DNA
gccaggcacggaggctcatgcctataatcccagcactttgtgaggccaagataggaagatcagctgaggccaggagttcgagaccagtctgagcaacatggaaacctggacaagcatgaagaactagaggagcttgtagcaaggttcttaggagtagaagctgctatggcgtatggcatgggatttgcaacgaattcaatgaacattcctgctcttgttggcaaaggttgcctgattctgagtgatgaactgaatcatgcatcactggttctgggagccagactgtcaggagcaaccattagaatcttcaaacacaacaatatgcaaagcctagagaagctattgaaagatgccattgtttatggtcagcctcggacacgaaggccctggaagaaaattctcatccttgtggaaggaatatatagcatggagggatctattgttcgtcttcctgaagtgattgccctcaagaagaaatacaaggcatacttgtatctggatgaggctcacagcattggcgccctgggccccacaggccggggtgtggtggagtactttggcctggatcccgaggatgtggatgttatgatgggaacgttcacaaagagttttggtgcttctggaggatatattggaggcaagaaggagctgatagactacctgcgaacacattctcatagtgcagtgtatgccacgtcattgtcacctcctgtagtggagcagatcatcacctccatgaagtgcatcatggggcaggatggcaccagccttggtaaagagtgtgtacaacagttagctgaaaacaccaggtatttcaggagacgcctgaaagagatgggcttcatcatctatggaaatgaagactctccagtagtgcctttgatgctctacatgcctgccaaaattggcgcctttggacgggagatgctgaagcggaacatcggtgtcgttgtggttggatttcctgccaccccaattattgagtccagagccaggttttgcctgtcagcagctcataccaaagaaatacttgatactgctttaaaggagatagatgaagttggggacctattgcagctgaagtattcccgtcatcggttggtacctctactggacaggccctttgacgagacgacgtatgaagaaacagaagactga

SEQ ID NO: 9832 - DNA, 882 bp, synthetic construct
  misc_feature 1..882: note = Synthetic polypeptide
  source 1..882: mol_type = other DNA
gccaggcacggaggctcatgcctataatcccagcactttgtgaggccaagataggaagatcagctgaggccaggagttcgagaccagtctgagcaacatggaaacctggacaagcatgaagaactagaggagcttgtagcaaggttcttaggagtagaagctgctatggcgtatggcatgggatttgcaacgaattcaatgaacattcctgctcttgttggcaaaggttgcctgattctgagtgatgaactgaatcatgcatcactggttctgggagccagactgtcaggagcaaccattagaatcttcaaacacaacaatatgcaaagcctagagaagctattgaaagatgccattgtttatggtcagcctcggacacgaaggccctggaagaaaattctcatccttgtggaaggaatatatagcatggagggatctattgttcgtcttcctgaagtgattgccctcaagaagaaatacaaggcatacttgtatctggatgaggctcacagcattggcgccctgggccccacaggccggggtgtggtggagtactttggcctggatcccgaggatgtggatgttatgatgggaacgttcacaaagagttttggtgcttctggaggatatattggaggcaagaaggagctgatagactacctgcgaacacattctcatagtgcagtgtatgccacgtcattgtcacctcctgtagtggagcagatcatcacctccatgaagtgcatcatggggcaggatggcaccagccttggtaatggcatcactattcatgaagttgtccaaacaagaaatacctatcatcgtttctctcctttatcccctgtatttagtcaccagtgcctatggatcatgcttccttaa

SEQ ID NO: 9833 - DNA, 1225 bp, synthetic construct
  misc_feature 1..1225: note = Synthetic polypeptide
  source 1..1225: mol_type = other DNA
tgatatggtttggctctgtgtccccactgaaaaatcatgtcaaattgtaattcccagtgttggaggaggggcctagtgggaagagattgaatcacgggggctgactttcctcttactgttgtcataatagaattctcataagatctggttgtttgaaagcatgtagcacctccaccttctttctctctctctctctgcctctctctctctctctctctctacctccccctctcctgccagccaagtgaagacatgcttgcttccccttcaccttcctccatcatggtaagtttcctgaggcctcccctgccatgcctcctgtgcagcctgcagaactgttcctaaaagtaaagctttagaggccaccaaattggcaattgaagctggcttccgccatattgattctgctcatttatacaataatgaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 9834 - DNA, 865 bp, synthetic construct
  misc_feature 1..865: note = Synthetic polypeptide
  source 1..865: mol_type = other DNA
tgatatggtttggctctgtgtccccactgaaaaatcatgtcaaattgtaattcccagtgttggaggaggggcctagtgggaagagattgaatcacgggggctgactttcctcttactgttgtcataatagaattctcataagatctggttgtttgaaagcatgtagcacctccaccttctttctctctctctctctgcctctctctctctctctctctctacctccccctctcctgccagccaagtgaagacatgcttgcttccccttcaccttcctccatcatggtaagtttcctgaggcctcccctgccatgcctcctgtgcagcctgcagaactgttcctaaaagtaaagctttagaggccaccaaattggcaattgaagctggcttccgccatattgattctgctcatttatacaataatgaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccagcctagagataattccatcttttccttgagtcctgactggtga

SEQ ID NO: 9835 - DNA, 885 bp, synthetic construct
  misc_feature 1..885: note = Synthetic polypeptide
  source 1..885: mol_type = other DNA
ggccaggtgcagtggctcacgcctgtaatcccagcactttgggaggccgaggtgggcggatcacctgaggtcaggggttcaagatcagcctgaccaacatgaagaaaccccatctctacaaaaaatacaaaattagccaggtgtggtggcgcatgcctgtaatcccagccacgctactcgggaggctgaggaaggagaatcgcttgaacccaggaggcagaggttacggtccttgaagcagaaaaagttcctcataaccagaggaagcctgaatcaactcatctgttagaaaaccaaaatactcaagagattccacttgccattagcagttcttcattcacgacaagcaaccacagtgtgcaaaacagagatcatagaggaggcatgcagccctgttctcctcagagatgccagcctccagccagctgcagccctcacgaaaatatactgccctataaatacacaagctggagaccacctttccccaaaaggtctgatagaaaggatgtccagcacaatgaatggtacattggagaatacagccgccaggcagtggaagaggcattcatgaaggagaacaaggatggtagtttcttggtccgagattgttccacaaaatccaaggaagagccctatgttttggctgtgttttatgagaacaaagtctacaatgtaaaaatacgcttcctggagaggaatcagcagtttgccctggggacaggactcagaggagatgagaagtttgattcagtagaagacatcatcgaacactacaagaattttcccattatactaattgatgggaaagataaaactggggtccacaggaaacagtgtcacctcactcagccactccctctcaccagacacctcttgcctctgtag

SEQ ID NO: 9836 - DNA, 979 bp, synthetic construct
  misc_feature 1..979: note = Synthetic polypeptide
  source 1..979: mol_type = other DNA
cagtggttcctggatggcagtccttaaacaggtgctacacatgaggacgttttcaccagcccacggtgagatgaggaaaatcaggacaacgaaaggaggtgtttacaaagaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccatgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattctcaatgcagggtctaaaagctggtgttattgctgttattgtggttgtggtgatagcagttgttgctggaattgttgtgctggttatttccagaaagaagagaatggcaaagtatgagaaggctgagataaaggagatgggtgagatgcatagggaactcaatgcataa

SEQ ID NO: 9837 - DNA, 404 bp, synthetic construct
  misc_feature 1..404: note = Synthetic polypeptide
  source 1..404: mol_type = other DNA
cagtggttcctggatggcagtccttaaacaggtgctacacatgaggacgttttcaccagcccacggtgagatgaggaaaatcaggacaacgaaaggaggtgtttacaaagaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccatgtgctggtgtgtgaacactgctgggg

SEQ ID NO: 9838 - DNA, 186 bp, synthetic construct; identical to SEQ ID NO: 7638
  misc_feature 1..186: note = Synthetic polypeptide
  source 1..186: mol_type = other DNA

SEQ ID NO: 9839 - DNA, 2194 bp, synthetic construct
  misc_feature 1..2194: note = Synthetic polypeptide
  source 1..2194: mol_type = other DNA
ggtggcccgtacagggagcccattctcctctggggaggggtctccagtactttcccgtgtggaggcgcgcccagtcaccttgttgcggtagcctcaagattttgatagtttacctgtgcaaattacagttccggagaaaatacggtcaataataaaggaaggaattgaatcgcaggcatcctacaaaattgtaattgaagggaaaccatatactgtgaatttaatgcaaaaaaactttttaccccataattttagagtttacagttatagtggcacaggaattatgaaaccacttgaccaagattttcagaatttctgccactaccaagggtatattgaaggttatccaaaatctgtggtgatggttagcacatgtactggactcaggggcgtactacagtttgaaaatgttagttatggaatagaacccctggagtcttcagttggctttgaacatgtaatttaccaagtaaaacataagaaagcagatgtttccttatataatgagaaggatattgaatcaagagatctgtcctttaaattacaaagcgtagagtataatcatatggggtctgatacaactgttgtcgctcaaaaagttttccagttgattggattgacgaatgctatttttgtttcatttaatattacaattattctgtcttcattggagctttggatagatgaaaataaaattgcaaccactggagaagctaatgagttattacacacatttttaagatggaaaacatcttatcttgttttacgtcctcatgatgtggcatttttacttgtttacagagaaaagtcaaattatgttggtgcaacctttcaagggaagatgtgtgatgcaaactatgcaggaggtgttgttctgcaccccagaaccataagtctggaatcacttgcagttattttagctcaattattgagccttagtatggggatcacttatgatgacattaacaaatgccagtgctcaggagctgtctgcattatgaatccagaagcaattcatttcagtggtgtgaagatctttagtaactgcagcttcgaagactttgcacattttatttcaaagcagaagtcccagtgtcttcacaatcagcctcgcttagatccttttttcaaacagcaagcagtgtgtggtaatgcaaagctggaagcaggagaggagtgtgactgtgggactgaacaggattgtgcccttattggagaaacatgctgtgatattgccacatgtagatttaaagccggttcaaactgtgctgaaggaccatgctgcgaaaactgtctatttatgtcaaaagaaagaatgtgtaggccttcctttgaagaatgcgacctccctgaatattgcaatggatcatctgcatcatgcccagaaaaccactatgttcagactgggcatccgtgtggactgaatcaatggatctgtatagatggagtttgtatgagtggggataaacaatgtacagacacatttggcaaagaagtagagtttggcccttcagaatgttattctcaccttaattcaaagactgatgtatctggaaactgtggtataagtgattcaggatacacacagtgtgaagctgacaatctgcagtgcggaaaattaatatgtaaatatgtaggtaaatttttattacaaattccaagagccactattatttatgccaacataagtggacatctctgcattgctgtggaatttgccagtgatcatgcagacagccaaaagatgtggataaaagatggaacttcttgtggttcaaataaggtttgcaggaatcaaagatgtgtgagttcttcatacttgggttatgattgtactactgacaaatgcaatgatagaggtgtatgcaataacaaaaagcactgtcactgtagtgcttcatatttacctccagattgctcagttcaatcagatctatggcctggtgggagtattgacagtggcaattttccacctgtagctataccagccagactccctgaaaggcgctacattgagaacatttaccattccaaaccaatgagatggccatttttcttattcattcctttctttattattttctgtgtactgattgctataatggtgaaagttaatttccaaaggaaaaaatggagaactgaggactattcaagcgatgagcaacctgaaagtgagagtgaacctaaagggtag

SEQ ID NO: 9840 - DNA, 1783 bp, synthetic construct
  misc_feature 1..1783: note = Synthetic polypeptide
  source 1..1783: mol_type = other DNA
ggtggcccgtacagggagcccattctcctctggggaggggtctccagtactttcccgtgtggaggcgcgcccagtcaccttgttgcggtagcctcaagattttgatagtttacctgtgcaaattacagttccggagaaaatacggtcaataataaaggaaggaattgaatcgcaggcatcctacaaaattgtaattgaagggaaaccatatactgtgaatttaatgcaaaaaaactttttaccccataattttagagtttacagttatagtggcacaggaattatgaaaccacttgaccaagattttcagaatttctgccactaccaagggtatattgaaggttatccaaaatctgtggtgatggttagcacatgtactggactcaggggcgtactacagtttgaaaatgttagttatggaatagaacccctggagtcttcagttggctttgaacatgtaatttaccaagtaaaacataagaaagcagatgtttccttatataatgagaaggatattgaatcaagagatctgtcctttaaattacaaagcgtagagcaccccagaaccataagtctggaatcacttgcagttattttagctcaattattgagccttagtatggggatcacttatgatgacattaacaaatgccagtgctcaggagctgtctgcattatgaatccagaagcaattcatttcagtggtgtgaagatctttagtaactgcagcttcgaagactttgcacattttatttcaaagcagaagtcccagtgtcttcacaatcagcctcgcttagatccttttttcaaacagcaagcagtgtgtggtaatgcaaagctggaagcaggagaggagtgtgactgtgggactgaacaggattgtgcccttattggagaaacatgctgtgatattgccacatgtagatttaaagccggttcaaactgtgctgaaggaccatgctgcgaaaactgtctatttatgtcaaaagaaagaatgtgtaggccttcctttgaagaatgcgacctccctgaatattgcaatggatcatctgcatcatgcccagaaaaccactatgttcagactgggcatccgtgtggactgaatcaatggatctgtatagatggagtttgtatgagtggggataaacaatgtacagacacatttggcaaagaagtagagtttggcccttcagaatgttattctcaccttaattcaaagactgatgtatctggaaactgtggtataagtgattcaggatacacacagtgtgaagctgatggacatctctgcattgctgtggaatttgccagtgatcatgcagacagccaaaagatgtggataaaagatggaacttcttgtggttcaaataaggtttgcaggaatcaaagatgtgtgagttcttcatacttgggttatgattgtactactgacaaatgcaatgatagaggtgtatgcaataacaaaaagcactgtcactgtagtgcttcatatttacctccagattgctcagttcaatcagatctatggcctggtgggagtattgacagtggcaattttccacctgtagctataccagccagactccctgaaaggcgctacattgagaacatttaccattccaaaccaatgagatggccatttttcttattcattcctttctttattattttctgtgtactgattgctataatggtgaaagttaatttccaaaggaaaaaatggagaactgaggactattcaagcgatgagcaacctgaaagtgagagtgaacctaaagggtag

SEQ ID NO: 9841 - DNA, 2251 bp, synthetic construct
  misc_feature 1..2251: note = Synthetic polypeptide
  source 1..2251: mol_type = other DNA
ggtggcccgtacagggagcccattctcctctggggaggggtctccagtactttcccgtgtggaggcgcgcccagtcaccttgttgcggtagcctcaagattttgatagtttacctgtgcaaattacagttccggagaaaatacggtcaataataaaggaaggaattgaatcgcaggcatcctacaaaattgtaattgaagggaaaccatatactgtgaatttaatgcaaaaaaactttttaccccataattttagagtttacagttatagtggcacaggaattatgaaaccacttgaccaagattttcagaatttctgccactaccaagggtatattgaaggttatccaaaatctgtggtgatggttagcacatgtactggactcaggggcgtactacagtttgaaaatgttagttatggaatagaacccctggagtcttcagttggctttgaacatgtaatttaccaagtaaaacataagaaagcagatgtttccttatataatgagaaggatattgaatcaagagatctgtcctttaaattacaaagcgtagagccacagcaagattttgcaaagtatatagaaatgcatgttatagttgaaaaacaattgtataatcatatggggtctgatacaactgttgtcgctcaaaaagttttccagttgattggattgacgaatgctatttttgtttcatttaatattacaattattctgtcttcattggagctttggatagatgaaaataaaattgcaaccactggagaagctaatgagttattacacacatttttaagatggaaaacatcttatcttgttttacgtcctcatgatgtggcatttttacttgtttacagagaaaagtcaaattatgttggtgcaacctttcaagggaagatgtgtgatgcaaactatgcaggaggtgttgttctgcaccccagaaccataagtctggaatcacttgcagttattttagctcaattattgagccttagtatggggatcacttatgatgacattaacaaatgccagtgctcaggagctgtctgcattatgaatccagaagcaattcatttcagtggtgtgaagatctttagtaactgcagcttcgaagactttgcacattttatttcaaagcagaagtcccagtgtcttcacaatcagcctcgcttagatccttttttcaaacagcaagcagtgtgtggtaatgcaaagctggaagcaggagaggagtgtgactgtgggactgaacaggattgtgcccttattggagaaacatgctgtgatattgccacatgtagatttaaagccggttcaaactgtgctgaaggaccatgctgcgaaaactgtctatttatgtcaaaagaaagaatgtgtaggccttcctttgaagaatgcgacctccctgaatattgcaatggatcatctgcatcatgcccagaaaaccactatgttcagactgggcatccgtgtggactgaatcaatggatctgtatagatggagtttgtatgagtggggataaacaatgtacagacacatttggcaaagaagtagagtttggcccttcagaatgttattctcaccttaattcaaagactgatgtatctggaaactgtggtataagtgattcaggatacacacagtgtgaagctgacaatctgcagtgcggaaaattaatatgtaaatatgtaggtaaatttttattacaaattccaagagccactattatttatgccaacataagtggacatctctgcattgctgtggaatttgccagtgatcatgcagacagccaaaagatgtggataaaagatggaacttcttgtggttcaaataaggtttgcaggaatcaaagatgtgtgagttcttcatacttgggttatgattgtactactgacaaatgcaatgatagaggtgtatgcaataacaaaaagcactgtcactgtagtgcttcatatttacctccagattgctcagttcaatcagatctatggcctggtgggagtattgacagtggcaattttccacctgtagctataccagccagactccctgaaaggcgctacattgagaacatttaccattccaaaccaatgagatggccatttttcttattcattcctttctttattattttctgtgtactgattgctataatggtgaaagttaatttccaaaggaaaaaatggagaactgaggactattcaagcgatgagcaacctgaaagtgagagtgaacctaaagggtag

SEQ ID NO: 9842 - DNA, 2062 bp, synthetic construct
  misc_feature 1..2062: note = Synthetic polypeptide
  source 1..2062: mol_type = other DNA
ggtggcccgtacagggagcccattctcctctggggaggggtctccagtactttcccgtgtggaggcgcgcccagtcaccttgttgcggtagcctcaagattttgatagtttacctgtgcaaattacagttccggagaaaatacggtcaataataaaggaaggaattgaatcgcaggcatcctacaaaattgtaattgaagggaaaccatatactgtgaatttaatgcaaaaaaactttttaccccataattttagagtttacagttatagtggcacaggaattatgaaaccacttgaccaagattttcagaatttctgccactaccaagggtatattgaaggttatccaaaatctgtggtgatggttagcacatgtactggactcaggggcgtactacagtttgaaaatgttagttatggaatagaacccctggagtcttcagttggctttgaacatgtaatttaccaagtaaaacataagaaagcagatgtttccttatataatgagaaggatattgaatcaagagatctgtcctttaaattacaaagcgtagagccacagcaagattttgcaaagtatatagaaatgcatgttatagttgaaaaacaattgtataatcatatggggtctgatacaactgttgtcgctcaaaaagttttccagttgattggattgacgaatgctatttttgtttcatttaatattacaattattctgtcttcattggagctttggatagatgaaaataaaattgcaaccactggagaagctaatgagttattacacacatttttaagatggaaaacatcttatcttgttttacgtcctcatgatgtggcatttttacttgtttacagagaaaagtcaaattatgttggtgcaacctttcaagggaagatgtgtgatgcaaactatgcaggaggtgttgttctgcaccccagaaccataagtctggaatcacttgcagttattttagctcaattattgagccttagtatggggatcacttatgatgacattaacaaatgccagtgctcaggagctgtctgcattatgaatccagaagcaattcatttcagtggtgtgaagatctttagtaactgcagcttcgaagactttgcacattttatttcaaagcagaagtcccagtgtcttcacaatcagcctcgcttagatccttttttcaaacagcaagcagtgtgtggtaatgcaaagctggaagcaggagaggagtgtgactgtgggactgaacaggattgtgcccttattggagaaacatgctgtgatattgccacatgtagatttaaagccggttcaaactgtgctgaaggaccatgctgcgaaaactgtctatttatgtcaaaagaaagaatgtgtaggccttcctttgaagaatgcgacctccctgaatattgcaatggatcatctgcatcatgcccagaaaaccactatgttcagactgggcatccgtgtggactgaatcaatggatctgtatagatggagtttgtatgagtggggataaacaatgtacagacacatttggcaaagaagtagagtttggcccttcagaatgttattctcaccttaattcaaagactgatgtatctggaaactgtggtataagtgattcaggatacacacagtgtgaagtttgcaggaatcaaagatgtgtgagttcttcatacttgggttatgattgtactactgacaaatgcaatgatagaggtgtatgcaataacaaaaagcactgtcactgtagtgcttcatatttacctccagattgctcagttcaatcagatctatggcctggtgggagtattgacagtggcaattttccacctgtagctataccagccagactccctgaaaggcgctacattgagaacatttaccattccaaaccaatgagatggccatttttcttattcattcctttctttattattttctgtgtactgattgctataatggtgaaagttaatttccaaaggaaaaaatggagaactgaggactattcaagcgatgagcaacctgaaagtgagagtgaacctaaagggtag

SEQ ID NO: 9843 - DNA, 677 bp, synthetic construct; identical to SEQ ID NO: 747
  misc_feature 1..677: note = Synthetic polypeptide
  source 1..677: mol_type = other DNA

SEQ ID NO: 9844 - DNA, 674 bp, synthetic construct; identical to SEQ ID NO: 748
  misc_feature 1..674: note = Synthetic polypeptide
  source 1..674: mol_type = other DNA

SEQ ID NO: 9845 - DNA, 2534 bp, synthetic construct
  misc_feature 1..2534: note = Synthetic polypeptide
  source 1..2534: mol_type = other DNA
taaactattttatgatctttccgttgaaactttttgtcagtgttaagggaaatgagagaaagtaccctattttcagacatctatgttgatacataaccaagaggttaaaggaaataaactaatggtgcaccacttggaaaaagtttgtcctgactcccagggagagaaagaaaaggagctagagagtcagcagttgttaaatgtgcttaacccacttgaaactggtgccacattacttagtcaagaggtggaggaaccaccatccctggagtataaagaggctgcaaacatagtctctccctcctgaactaggcaaggcactgattttggctggagatctaccaagctggggcagggcaatttcccctctgacaatatcccatgggaattaatcagcaagggacttcagctcgatattattgggcatacaggccttttcctacatctgatgtactgaattggaaaacttccaatcctttctacagggaagatcctcagaagatgactgaattgtttaccactatttttgccagccatcaccctacttaggctaatttgcaagccctcctaaatattatgcttactgcagacaagagaaagcaagcattaggcaatggaaaggaggaagcatggtgtcttcatgaaaaaagcccagatgataccccagaccctgataagattctacatgctgacccaaactgggtcccaagtgaggaggatggggcctggacaaatcatctggagtattctaaagggtgataggtcaggggtgccgagacctaaaagtctgaaaaaagtgcaggagcttcagcagaagcctaacaaggattccctcagagttcatggatgtatctgtcaaacatatagaaagcatacagacttagacctgcaggatcctgaaaatgtcagaatgataaacatgacttttatagagcaaaatgccccagacatcacaaagaagttacaaaagctggaggggagctattggaatgaacacttctcaattaattgacattgtgttcaaggccttataatagcagagaagccaaggaaaccaaggcactactgaaggcagagatactcatagctgccatgggaggaaacctgaagagaaaggaacccccaaggtggaaagggaaagtagaaaaagatcaatgggcttactgtagggtgacagtgctttggaagaaagactgccccaagctgagtcagggggagcccaagtcacttatggctgttaagtttggaaaaaatccaaggaggaccgagggtgcccaaagttcccaaaagctccaaccctgtccagcattaggatttcaccacaggacattcgggtaaaactgacagtagggaaacaaaaattggacttcttaattgatacgggtgatactgacatcccaaagtgtggactttctgacacctatgtcaatatggttggggtgaatggagagctaaaactggttggggggggggggttgtgacccttatcctgcaaggtgggcaatgaggtattgataatagctaatcaattattttatgtgtgggactgcccaacctctgtgcttggtagagatctcttgtgtaagttagaggcattaattgtctttgaaccagagaaacgtccaatgtgcctccaggtacccccagaatccagattgcagctacaggccctcctgatgaaatcaaaaactccacagcttgaagtagagatgattccaccggaagtcctcaataaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 9846 - DNA, 2174 bp, synthetic construct
  misc_feature 1..2174: note = Synthetic polypeptide
  source 1..2174: mol_type = other DNA
taaactattttatgatctttccgttgaaactttttgtcagtgttaagggaaatgagagaaagtaccctattttcagacatctatgttgatacataaccaagaggttaaaggaaataaactaatggtgcaccacttggaaaaagtttgtcctgactcccagggagagaaagaaaaggagctagagagtcagcagttgttaaatgtgcttaacccacttgaaactggtgccacattacttagtcaagaggtggaggaaccaccatccctggagtataaagaggctgcaaacatagtctctccctcctgaactaggcaaggcactgattttggctggagatctaccaagctggggcagggcaatttcccctctgacaatatcccatgggaattaatcagcaagggacttcagctcgatattattgggcatacaggccttttcctacatctgatgtactgaattggaaaacttccaatcctttctacagggaagatcctcagaagatgactgaattgtttaccactatttttgccagccatcaccctacttaggctaatttgcaagccctcctaaatattatgcttactgcagacaagagaaagcaagcattaggcaatggaaaggaggaagcatggtgtcttcatgaaaaaagcccagatgataccccagaccctgataagattctacatgctgacccaaactgggtcccaagtgaggaggatggggcctggacaaatcatctggagtattctaaagggtgataggtcaggggtgccgagacctaaaagtctgaaaaaagtgcaggagcttcagcagaagcctaacaaggattccctcagagttcatggatgtatctgtcaaacatatagaaagcatacagacttagacctgcaggatcctgaaaatgtcagaatgataaacatgacttttatagagcaaaatgccccagacatcacaaagaagttacaaaagctggaggggagctattggaatgaacacttctcaattaattgacattgtgttcaaggccttataatagcagagaagccaaggaaaccaaggcactactgaaggcagagatactcatagctgccatgggaggaaacctgaagagaaaggaacccccaaggtggaaagggaaagtagaaaaagatcaatgggcttactgtagggtgacagtgctttggaagaaagactgccccaagctgagtcagggggagcccaagtcacttatggctgttaagtttggaaaaaatccaaggaggaccgagggtgcccaaagttcccaaaagctccaaccctgtccagcattaggatttcaccacaggacattcgggtaaaactgacagtagggaaacaaaaattggacttcttaattgatacgggtgatactgacatcccaaagtgtggactttctgacacctatgtcaatatggttggggtgaatggagagctaaaactggttggggggggggggttgtgacccttatcctgcaaggtgggcaatgaggtattgataatagctaatcaattattttatgtgtgggactgcccaacctctgtgcttggtagagatctcttgtgtaagttagaggcattaattgtctttgaaccagagaaacgtccaatgtgcctccaggtacccccagaatccagattgcagctacaggccctcctgatgaaatcaaaaactccacagcttgaagtagagatgattccaccggaagtcctcaataaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccagcctagagataattccatcttttccttgagtcctgactggtga

SEQ ID NO: 9847 - DNA, 491 bp, synthetic construct
  misc_feature 1..491: note = Synthetic polypeptide
  source 1..491: mol_type = other DNA
aggtagacaatgaacaactgaatttagaggacgaagacattgaaagcattgatgccaccaaattgagccgtttcattgagatcaacagcctccacatggtgacagagtacaaccctgtgactgtgattgggttattcaacagcgtaattcagattcatctcctcctgataatgaacaaggcctccccagagtatgaagagaacatgcacagataccagaaggcagccaagctcttccaggggaagattctctttattctggtggacagtggtatgaaagaaaatgggaaggtgatatcatttttcaaactaaaggagtctcaactgccagctttggcaatttaccagactctagatgacgagtgggatacactgcccacagcagaagtttccgtagagcatgtgcaaaacttttgtgatggattcctaagtggaaaattgttgaaagaaaatcgtgaatcagaaggaaagactccaaaggtggaactctga

SEQ ID NO: 9848 - DNA, 377 bp, synthetic construct
  misc_feature 1..377: note = Synthetic polypeptide
  source 1..377: mol_type = other DNA
tctggcagtaagaggcctgctttccatcagggtagcaattccctggatttgagtaggagccgttccttttgcatggaacatggaccatctactttgctgctgacgttcctcagggagtgattcgagtgcaagctccccatctttcgaaagtttccatggcaatacagctaactgaagaactaaaagccagtgatgtacttgccaggtttctcagccaagaaagtggggttgcccagactctcaagaaaggagaagtttttttgtatgaaattggaggaaatattggggaacgctgccttgatgatgacacttacatgaaggatttatatcagcttaacccaaatgctgagtgggttataaagtcaaagccattgtag

SEQ ID NO: 9849 - DNA, 538 bp, synthetic construct
  misc_feature 1..538: note = Synthetic polypeptide
  source 1..538: mol_type = other DNA
ctggatcggctttgccatcgcccgacgtctggcccgggacggggcccacgtggtcatcagcagccggaagcagcagaacgtggaccgggccatggccaagctgcagggggaggggctgagtgtggcgggcattgtgtgccacgtggggaaggctgaggaccgggagcagctggtggccaaggccctggagcactgtgggggcgtcgacttcctggtgtgcagcgcaggggtcaaccctctggtagggagcactctggggaccagtgagcagatctgggacaagatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtg

SEQ ID NO: 9850 - DNA, 706 bp, synthetic construct
  misc_feature 1..706: note = Synthetic polypeptide
  source 1..706: mol_type = other DNA
ctggatcggctttgccatcgcccgacgtctggcccgggacggggcccacgtggtcatcagcagccggaagcagcagaacgtggaccgggccatggccaagctgcagggggaggggctgagtgtggcgggcattgtgtgccacgtggggaaggctgaggaccgggagcagctggtggccaaggccctggagcactgtgggggcgtcgacttcctggtgtgcagcgcaggggtcaaccctctggtagggagcactctggggaccagtgagcagatctgggacaagatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctga

SEQ ID NO: 9851 - DNA, 766 bp, synthetic construct
  misc_feature 1..766: note = Synthetic polypeptide
  source 1..766: mol_type = other DNA
ctggatcggctttgccatcgcccgacgtctggcccgggacggggcccacgtggtcatcagcagccggaagcagcagaacgtggaccgggccatggccaagctgcagggggaggggctgagtgtggcgggcattgtgtgccacgtggggaaggctgaggaccgggagcagctggtggccaaggccctggagcactgtgggggcgtcgacttcctggtgtgcagcgcaggggtcaaccctctggtagggagcactctggggaccagtgagcagatctgggacaagatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtggtgaggattggtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctgagaggagtgggggcggctgcgtagctgtggtcccaggcccaggagcctga

SEQ ID NO: 9852 - DNA, 574 bp, synthetic construct
  misc_feature 1..574: note = Synthetic polypeptide
  source 1..574: mol_type = other DNA
tggacaagtggcttatccaccctgaacttcagtttgctcatctataaaatgaggccattacaaatacccctaagacaaatggaaggattacaggtttcttgaaatccagaagcccagactctgtaaggtgattcgtgtcctcgcctttgcttatccgtacacctgggactccctccccatcttctacaggctattcctgttcccaggggagagtgcacaaaatgaagccacctcgtaccaccagaagcacatgatcatgaccctcctggcctctttcttgtactctgcacatctgccagaacgcctagcccctggacgctttgactacatcggtcacagtcaccagctgtttcacgtgtgtgtgatcctggccacgcacatgcagatggaagccatacttctggacaagactctgaggaaggaatggctcctggccacctccaagcccttctctttctctcagatagctggagccatacttctgtgcatcatcttcagcctcagcaacataatttatttctcagctgctctgtatcggattcccaagccagaattacataaaaaagaaacatga

SEQ ID NO: 9853 - DNA, 2456 bp, synthetic construct
  misc_feature 1..2456: note = Synthetic polypeptide
  source 1..2456: mol_type = other DNA
taaactattttatgatctttccgttgaaactttttgtcagtgttaagggaaatgagagaaagtaccctattttcagacatctatgttgatacataaccaagaggttaaaggaaataaactaatggtgcaccacttggaaaaagtttgtcctgactcccagggagagaaagaaaaggagctagagagtcagcagttgttaaatgtgcttaacccacttgaaactggtgccacattacttagtcaagaggtggaggaaccaccatccctggagtataaagaggctgcaaacatagtctctccctcctgaactaggcaaggcactgattttggctggagatctaccaagctggggcagggcaatttcccctctgacaatatcccatgggaattaatcagcaagggacttcagctcgatattattgggcatacaggccttttcctacatctgatgtactgaattggaaaacttccaatcctttctacagggaagatcctcagaagatgactgaattgtttaccactatttttgccagccatcaccctacttaggctaatttgcaagccctcctaaatattatgcttactgcagacaagagaaagcaagcattaggcaatggaaaggaggaagcatggtgtcttcatgaaaaaagcccagatgataccccagaccctgataagattctacatgctgacccaaactgggtcccaagtgaggaggatggggcctggacaaatcatctggagtattctaaagggtgataggtcaggggtgccgagacctaaaagtctgaaaaaagtgcaggagcttcagcagaagcctaacaaggattccctcagagttcatggatgtatctgtcaaacatatagaaagcatacagacttagacctgcaggatcctgaaaatgtcagaatgataaacatgacttttatagagcaaaatgccccagacatcacaaagaagttacaaaagctggaggggagctattggaatgaacacttctcaattaattgacattgtgttcaaggccttataatagcagagaagccaaggaaaccaaggcactactgaaggcagagatactcatagctgccatgggaggaaacctgaagagaaaggaacccccaaggtggaaagggaaagtagaaaaagatcaatgggcttactgtagggtgacagtgctttggaagaaagactgccccaagctgagtcagggggagcccaagtcacttatggctgttaagtttggaaaaaatccaaggaggaccgagggtgcccaaagttcccaaaagctccaaccctgtccagcattaggatttcaccacaggacattcgggtaaaactgacagtagggaaacaaaaattggacttcttaattgatacgggtgatactgacatcccaaagtgtggactttctgacacctatgtcaatatggttggggtgaatggagagctaaaactggttggggggggggggttgtgacccttatcctgcaaggtgggcaatgaggtattgataatagctaatcaattattttatgtgtgggactgcccaacctctgtgcttggtagagatctcttgtgtaagttagaggcattaattgtctttgaaccagagaaacgtccaatgtgcctccaggtacccccagaatccagattgcagctacaggccctcctgatgaaatcaaaaactccacagcttgaagtagagatgattccaccggaagtcctcaataagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 9854 - DNA, 2328 bp, synthetic construct
  misc_feature 1..2328: note = Synthetic polypeptide
  source 1..2328: mol_type = other DNA
taaactattttatgatctttccgttgaaactttttgtcagtgttaagggaaatgagagaaagtaccctattttcagacatctatgttgatacataaccaagaggttaaaggaaataaactaatggtgcaccacttggaaaaagtttgtcctgactcccagggagagaaagaaaaggagctagagagtcagcagttgttaaatgtgcttaacccacttgaaactggtgccacattacttagtcaagaggtggaggaaccaccatccctggagtataaagaggctgcaaacatagtctctccctcctgaactaggcaaggcactgattttggctggagatctaccaagctggggcagggcaatttcccctctgacaatatcccatgggaattaatcagcaagggacttcagctcgatattattgggcatacaggccttttcctacatctgatgtactgaattggaaaacttccaatcctttctacagggaagatcctcagaagatgactgaattgtttaccactatttttgccagccatcaccctacttaggctaatttgcaagccctcctaaatattatgcttactgcagacaagagaaagcaagcattaggcaatggaaaggaggaagcatggtgtcttcatgaaaaaagcccagatgataccccagaccctgataagattctacatgctgacccaaactgggtcccaagtgaggaggatggggcctggacaaatcatctggagtattctaaagggtgataggtcaggggtgccgagacctaaaagtctgaaaaaagtgcaggagcttcagcagaagcctaacaaggattccctcagagttcatggatgtatctgtcaaacatatagaaagcatacagacttagacctgcaggatcctgaaaatgtcagaatgataaacatgacttttatagagcaaaatgccccagacatcacaaagaagttacaaaagctggaggggagctattggaatgaacacttctcaattaattgacattgtgttcaaggccttataatagcagagaagccaaggaaaccaaggcactactgaaggcagagatactcatagctgccatgggaggaaacctgaagagaaaggaacccccaaggtggaaagggaaagtagaaaaagatcaatgggcttactgtagggtgacagtgctttggaagaaagactgccccaagctgagtcagggggagcccaagtcacttatggctgttaagtttggaaaaaatccaaggaggaccgagggtgcccaaagttcccaaaagctccaaccctgtccagcattaggatttcaccacaggacattcgggtaaaactgacagtagggaaacaaaaattggacttcttaattgatacgggtgatactgacatcccaaagtgtggactttctgacacctatgtcaatatggttggggtgaatggagagctaaaactggttggggggggggggttgtgacccttatcctgcaaggtgggcaatgaggtattgataatagctaatcaattattttatgtgtgggactgcccaacctctgtgcttggtagagatctcttgtgtaagttagaggcattaattgtctttgaaccagagaaacgtccaatgtgcctccaggtacccccagaatccagattgcagctacaggccctcctgatgaaatcaaaaactccacagcttgaagtagagatgattccaccggaagtcctcaataagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgc

SEQ ID NO: 9855 - DNA, 2096 bp, synthetic construct
  misc_feature 1..2096: note = Synthetic polypeptide
  source 1..2096: mol_type = other DNA
taaactattttatgatctttccgttgaaactttttgtcagtgttaagggaaatgagagaaagtaccctattttcagacatctatgttgatacataaccaagaggttaaaggaaataaactaatggtgcaccacttggaaaaagtttgtcctgactcccagggagagaaagaaaaggagctagagagtcagcagttgttaaatgtgcttaacccacttgaaactggtgccacattacttagtcaagaggtggaggaaccaccatccctggagtataaagaggctgcaaacatagtctctccctcctgaactaggcaaggcactgattttggctggagatctaccaagctggggcagggcaatttcccctctgacaatatcccatgggaattaatcagcaagggacttcagctcgatattattgggcatacaggccttttcctacatctgatgtactgaattggaaaacttccaatcctttctacagggaagatcctcagaagatgactgaattgtttaccactatttttgccagccatcaccctacttaggctaatttgcaagccctcctaaatattatgcttactgcagacaagagaaagcaagcattaggcaatggaaaggaggaagcatggtgtcttcatgaaaaaagcccagatgataccccagaccctgataagattctacatgctgacccaaactgggtcccaagtgaggaggatggggcctggacaaatcatctggagtattctaaagggtgataggtcaggggtgccgagacctaaaagtctgaaaaaagtgcaggagcttcagcagaagcctaacaaggattccctcagagttcatggatgtatctgtcaaacatatagaaagcatacagacttagacctgcaggatcctgaaaatgtcagaatgataaacatgacttttatagagcaaaatgccccagacatcacaaagaagttacaaaagctggaggggagctattggaatgaacacttctcaattaattgacattgtgttcaaggccttataatagcagagaagccaaggaaaccaaggcactactgaaggcagagatactcatagctgccatgggaggaaacctgaagagaaaggaacccccaaggtggaaagggaaagtagaaaaagatcaatgggcttactgtagggtgacagtgctttggaagaaagactgccccaagctgagtcagggggagcccaagtcacttatggctgttaagtttggaaaaaatccaaggaggaccgagggtgcccaaagttcccaaaagctccaaccctgtccagcattaggatttcaccacaggacattcgggtaaaactgacagtagggaaacaaaaattggacttcttaattgatacgggtgatactgacatcccaaagtgtggactttctgacacctatgtcaatatggttggggtgaatggagagctaaaactggttggggggggggggttgtgacccttatcctgcaaggtgggcaatgaggtattgataatagctaatcaattattttatgtgtgggactgcccaacctctgtgcttggtagagatctcttgtgtaagttagaggcattaattgtctttgaaccagagaaacgtccaatgtgcctccaggtacccccagaatccagattgcagctacaggccctcctgatgaaatcaaaaactccacagcttgaagtagagatgattccaccggaagtcctcaataagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccagcctagagataattccatcttttccttgagtcctgactggtga

SEQ ID NO: 9856 - DNA, 798 bp, synthetic construct
  misc_feature 1..798: note = Synthetic polypeptide
  source 1..798: mol_type = other DNA
ttatctgcagtttcactttctacgatttcagttacctatggtcaaatgtggtctgaaaatgttaagtacaaaattcaagaaataaacaatttataagttttaaattgcatgccgttctgagtagcatgatgaaatcttgtgctgtccagctctgtcccaacctggatgtgaatcatccctttgtccagcgtctccatgctgcagacactccctggcccattagtcacttactagccgcctcagtgatcgggtgttgtgatatcgcgtgcttattttcagatgttgctgaaaaagctgacagaattattacaatgctgcccaccagtatcaatgcaatagaagcttattccggagcaaatgggattctaaaaaaagtgaagaagggctcattattaatagattccagcactattgatcctgcagtttcaaaagaattggccaaagaagttgagaaaatgggagcagttttcatggatgcccctgtttctggtggtgtaggagctgcacgatctgggaacctcacgtttatggtgggaggagttgaagatgaatttgctgctgcccaagagttgctggggtgcatgggctccaacgtggtgtactgtggagctgttgggactgggcaggcggcaaagatctgcaacaacatgctgttagctattagtatgattggaactgctgaagctatgaatcttggaatcaggttagggcttgacccaaaactactggctaaaatcctaaatatgagctcaggacggtgttggtcaagtgacacttataatcctgtacctggagtga

SEQ ID NO: 9857 - DNA, 1019 bp, synthetic construct
  misc_feature 1..1019: note = Synthetic polypeptide
  source 1..1019: mol_type = other DNA
ttatctgcagtttcactttctacgatttcagttacctatggtcaaatgtggtctgaaaatgttaagtacaaaattcaagaaataaacaatttataagttttaaattgcatgccgttctgagtagcatgatgaaatcttgtgctgtccagctctgtcccaacctggatgtgaatcatccctttgtccagcgtctccatgctgcagacactccctggcccattagtcacttactagccgcctcagtgatcgggtgttgtgatatcgcgtgcttattttcagatgttgctgaaaaagctgacagaattattacaatgctgcccaccagtatcaatgcaatagaagcttattccggagcaaatgggattctaaaaaaagtgaagaagggctcattattaatagattccagcactattgatcctgcagtttcaaaagaattggccaaagaagttgagaaaatgggagcagttttcatggatgcccctgtttctggtggtgtaggagctgcacgatctgggaacctcacgtttatggtgggaggagttgaagatgaatttgctgctgcccaagagttgctggggtgcatgggctccaacgtggtgtactgtggagctgttgggactgggcaggcggcaaagatctgcaacaacatgctgttagctattagtatgattggaactgctgaagctatgaatcttggaatcaggttagggcttgacccaaaactactggctaaaatcctaaatatgagctcaggacggtgttggtcaagtgacacttataatcctgtacctggagtgatggatggcgttccctcggctaataactatcagggtggatttggaacaacactcatggctaaggatctgggattggcacaagactctgctaccagcacaaagagcccaatccttcttggcagtctggcccatcagatctacaggatgatgtgtgcaaagggctactcaaagaaagacttctcatccgtgttccagttcctacgagaggaggagaccttctga

SEQ ID NO: 9858 - DNA, 289 bp, synthetic construct
  misc_feature 1..289: note = Synthetic polypeptide
  source 1..289: mol_type = other DNA
ttatctgcagtttcactttctacgatttcagttacctatggtcaaatgtggtctgaaaatgttaagtacaaaattcaagaaataaacaatttataagttttaaattgcatgccgttctgagtagcatgatgaaatcttgtgctgtccagctctgtcccaacctggatgtgaatcatccctttgtccagcgtctccatgctgcagacactccctggcccattagtcacttactagccgcctcagtgatcgggtgttgtgatatcgcgtgcttattttcagatgttgctga

SEQ ID NO: 9859 - DNA, 1175 bp, synthetic construct
  misc_feature 1..1175: note = Synthetic polypeptide
  source 1..1175: mol_type = other DNA
tgcagatcctcaaagacctcatgctccccaggcctctggggccttgcacagcatatcgcacggatgactgccatccctgggttttgccagtagtgaagaaagtggagcagaagattgctaatgacaatagcctaaatcacgagtatctgccaatcctgggcctggctgagttccggagctgtgcttctcgtcttgcccttggggatgacagcccagcactcaaggagaagcgggtaggaggtgtgcaatctttggggggaacaggtgcacttcgaattggagctgatttcttagcgcgttggtacaatggaacaaacaacaagaacacacctgtctatgtgtcctcaccaacctgggagaatcacaatgctgtgttttccgctgctggttttaaagacattcggtcctatcgctactgggatgcagagaagagaggattggacctccagggcttcctgaatgatctggagaatgctcctgagttctccattgttgtcctccacgcctgtgcacacaacccaactgggattgacccaactccggagcagtggaagcagattgcttctgtcatgaagcaccggtttctgttccccttctttgactcagcctatcagggcttcgcatctggaaacctggagagagatgcctgggccattcgctattttgtgtctgaaggcttcgagttcttctgtgcccagtccttctccaagaacttcgggctctacaatgagagagtcgggaatctgactgtggttggaaaagaacctgagagcatcctgcaagtcctttcccagatggagaagatcgtgcggattacttggtccaatccccccgcccagggagcacgaattgtggccagcaccctctctaaccctgagctctttgaggaatggacaggtaatgtgaagacaatggctgaccggattctgaccatgagatctgaactcagggcacgactagaagccctcaaaacccctgggacctggaaccacatcactgatcaaattggcatgttcagcttcactgggttgaaccccaagcaggttgagtatctggtcaatgaaaagcacatctacctgctgccaagtggtcgaatcaacgtgagtggcttaaccaccaaaaatctagattacgtggccacctccatccatgaagcagtcaccaaaatccagtga

SEQ ID NO: 9860 - DNA, 2216 bp, synthetic construct
  misc_feature 1..2216: note = Synthetic polypeptide
  source 1..2216: mol_type = other DNA
tctgatctcagccttccattcactccccaactcagaagaaaatccacaagagcccgcacagttggccaccacccccattacctctctgaaccacccccctaatcactctgccggtctcctcactgtttctcagacacgtcgtcacctaccaggatctttgcctgtgctgttccctctgcctgaaatgcattcccccagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtttgggctggagagtgcggagcaggctcatgagtgggtcaagtgtattgctaaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttggggactcggatatcccggtgatcgtgtaccgctgtgtggactacatcacgcagtgcggcctgacctccgagggcatctaccgcaagtgtgggcagacatcgaagacacagcggctgctggagagcctgcggcaggatgcgcgctctgtgcacctcaaggagggcgagcagcacgtggatgatgtttcctcggcgctcaagcgcttcctgcgcgacctgcctgatgggctcttcactcgcgcccagcgcctaacctggctggaggcctcagagattgaggacgaggaggagaaggtctccaggtaccgagagctgctggtgcggctgccccctgtcaaccgggccacagtgaaggcccttatcagccacctgtactgtgttcagtgcttctcagacacgaaccagatgaacgtgcacaacctggcaattgtgtttgggcccacgctcttccagacagatgggcaggactacaaggctggccgtgtggtggaagacctcattaaccactatgtggtggtgtttagtgtggatgaggaagagctcaggaagcagcgggaggagatcactgccattgtgaagatgcgcgtggctggcactgccagtgggacccagcatgccggtgacttcatctgcacagtgtatctggaagagaagaaggcagagactgagcagcatatcaaggtcccagcatccatgactgctgaggagctcaccctggagatcctggatcgccggaacgtgggcatcagggagaaggactattggacctgctttgaggtcaacgagagggaggaggcagagcgccccctgcactttgcggagaaggtgctgcccatcctgcacgggctgggcacggacagccacctggtggtgaagaagcaccaggccatggaggccatgctgctgtacctggccagccgtgtcggtgacaccaagcatggcatgatgaagttccgtgaggaccgcagcctcctgggcctgggcctgccctcaggtggcttccacgatcgctacttcatcctcaacagcagctgcttgcggctctacaaggaggtccggagtcaccggcctgagaaggagtggcctattaagagtctcaaagtctacctgggagtgaagaagaaactcaggccacccacctgctggggcttcacagtggtgcatgagacagagaaacatgagaagcagcagtggtacctctgctgtgacacacagatggagctccgggagtggttcgctacctttctgtttgtgcagcatgacggcctggtgtggccctcagagccctcacgcgtgtcccgggcagtgcctgaggtccggctgggtagtgtgtcactgatcccccttcgaggtagtgaaaatgaaatgcgccggagtgtggctgccttcaccgcggaccctctgtctcttctgcgcaacgtctga

SEQ ID NO: 9861 - DNA, 2249 bp, synthetic construct
  misc_feature 1..2249: note = Synthetic polypeptide
  source 1..2249: mol_type = other DNA
tctgatctcagccttccattcactccccaactcagaagaaaatccacaagagcccgcacagttggccaccacccccattacctctctgaaccacccccctaatcactctgccggtctcctcactgtttctcagacacgtcgtcacctaccaggatctttgcctgtgctgttccctctgcctgaaatgcattcccccagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtttgggctggagagtgcggagcaggctcatgagtgggtcaagtgtattgctaaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttggggactcggatatcccggtgatcgtgtaccgctgtgtggactacatcacgcagtgcggcctgacctccgagggcatctaccgcaagtgtgggcagacatcgaagacacagcggctgctggagagcctgcggcaggatgcgcgctctgtgcacctcaaggagggcgagcagcacgtggatgatgtttcctcggcgctcaagcgcttcctgcgcgacctgcctgatgggctcttcactcgcgcccagcgcctaacctggctggaggcctcagagattgaggacgaggaggagaaggtctccaggtaccgagagctgctggtgcggctgccccctgtcaaccgggccacagtgaaggcccttatcagccacctgtactgtgttcagtgcttctcagacacgaaccagatgaacgtgcacaacctggcaattgtgtttgggcccacgctcttccagacagatgggcaggactacaaggctggccgtgtggtggaagacctcattaaccactatgtggtggtgtttagtgtggatgaggaagagctcaggaagcagcgggaggagatcactgccattgtgaagatgcgcgtggctggcactgccagtgggacccagcatgccggtgacttcatctgcacagtgtatctggaagagaagaaggcagagactgagcagcatatcaaggtcccagcatccatgactgctgaggagctcaccctggagatcctggatcgccggaacgtgggcatcagggagaaggactattggacctgctttgaggtcaacgagagggaggaggcagagcgccccctgcactttgcggagaaggtgctgcccatcctgcacgggctgggcacggacagccacctggtggtgaagaagcaccaggccatggaggccatgctgctgtacctggccagccgtgtcggtgacaccaagcatggcatgatgaagttccgtgaggaccgcagcctcctgggcctgggcctgccctcaggtggcttccacgatcgctacttcatcctcaacagcagctgcttgcggctctacaaggaggtccggagccagaggccgtggagcggggcccctgagaccagtcaccggcctgagaaggagtggcctattaagagtctcaaagtctacctgggagtgaagaagaaactcaggccacccacctgctggggcttcacagtggtgcatgagacagagaaacatgagaagcagcagtggtacctctgctgtgacacacagatggagctccgggagtggttcgctacctttctgtttgtgcagcatgacggcctggtgtggccctcagagccctcacgcgtgtcccgggcagtgcctgaggtccggctgggtagtgtgtcactgatcccccttcgaggtagtgaaaatgaaatgcgccggagtgtggctgccttcaccgcggaccctctgtctcttctgcgcaacgtctga

SEQ ID NO: 9862 - DNA, 954 bp, synthetic construct
  misc_feature 1..954: note = Synthetic polypeptide
  source 1..954: mol_type = other DNA
tctgatctcagccttccattcactccccaactcagaagaaaatccacaagagcccgcacagttggccaccacccccattacctctctgaaccacccccctaatcactctgccggtctcctcactgtttctcagacacgtcgtcacctaccaggatctttgcctgtgctgttccctctgcctgaaatgcattcccccagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtttgggctggagagtgcggagcaggctcatgagtgggtcaagtgtattgctaaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttggggactcggatatcccggtgatcgtgtaccgctgtgtggactacatcacgcagtgcggcctgacctccgagggcatctaccgcaagtgtgggcagacatcgaagacacagcggctgctggagagcctgcggcaggatgcgcgctctgtgcacctcaaggagg

SEQ ID NO: 9863 - DNA, 796 bp, synthetic construct
  misc_feature 1..796: note = Synthetic polypeptide
  source 1..796: mol_type = other DNA
tctgatctcagccttccattcactccccaactcagaagaaaatccacaagagcccgcacagttggccaccacccccattacctctctgaaccacccccctaatcactctgccggtctcctcactgtttctcagacacgtcgtcacctaccaggatctttgcctgtgctgttccctctgcctgaaatgcattcccccagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtttgggctggagagtgcggagcaggctcatgagtgggtcaagtgtattgctaaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttgggga

SEQ ID NO: 9864 - DNA, 650 bp, synthetic construct; identical to SEQ ID NO: 9089
  misc_feature 1..650: note = Synthetic polypeptide
  source 1..650: mol_type = other DNA

SEQ ID NO: 9865 - DNA, 1052 bp, synthetic construct; identical to SEQ ID NO: 9090
  misc_feature 1..1052: note = Synthetic polypeptide
  source 1..1052: mol_type = other DNA

SEQ ID NO: 9866 - DNA, 3700 bp, synthetic construct
  misc_feature 1..3700: note = Synthetic polypeptide
  source 1..3700: mol_type = other DNA
tgtggaggaaaacttaaatattaaatttgaactcaattgaacatggacacaaacaatggccaccaagtcccagaacaggtggtgtgagccccttgaggaattcatcgagcgctgtttcaaataaatctctatttaaattcctatttgttagttattgaaacacaacagacaatcgcaaacacaagttgacctttttgtgttccttgagtccagtcgggaagggcccttgtgactgggtctcatgccaaacaacttgttacgataagagctagggtcccagaccatgaggaaacttcatgagaatcctctgtagtctggtgagtgtagtgtccgactctggagcccaggctgttgcttcccggtgtggtggtgaatcctccacagtctgatctgctttaacgttggaagtggacttcacttacaggtcttaagcacaagaaatgaaaataagctgcttcctaaacatcctcatttagtgcggcaaaagcgcgcctggatcaccgcccccgtggctcttcgggagggagaggatctgtccaagaagaatccaattgccaagatacattctgatcttgcagaagaaagaggactcaaaattacttacaaatacactggaaaagggattacagagccaccttttggtatatttgtctttaacaaagatactggagaactgaatgttaccagcattcttgatcgagaagaaacaccattttttctgctaacaggttacgctttggatgcaagaggaaacaatgtagagaaacccttagagctacgcattaaggttcttgatatcaatgacaacgaaccagtgttcacacaggatgtctttgttgggtctgttgaagagttgagtgcagcacatactcttgtgatgaaaatcaatgcaacagatgcagatgagcccaataccctgaattcgaaaatttcctatagaatcgtatctctggagcctgcttatcctccagtgttctacctaaataaagatacaggagagatttatacaaccagtgttaccttggacagagaggaacacagcagctacactttgacagtagaagcaagagatggcaatggagaagttacagacaaacctgtaaaacaagctcaagttcagattcgtattttggatgtcaatgacaatatacctgtagtagaaaataaagtgcttgaagggatggttgaagaaaatcaagtcaacgtagaagttacgcgcataaaagtgttcgatgcagatgaaataggttctgataattggctggcaaattttacatttgcatcaggaaatgaaggaggttatttccacatagaaacagatgctcaaactaacgaaggaattgtgacccttattaaggaagtagattatgaagaaatgaagaatcttgacttcagtgttattgtcgctaataaagcagcttttcacaagtcgattaggagtaaatacaagcctacacccattcccatcaaggtcaaagtgaaaaatgtgaaagaaggcattcattttaaaagcagcgtcatctcaatttatgttagcgagagcatggatagatcaagcaaaggccaaataattggaaattttcaagcttttgatgaggacactggactaccagcccatgcaagatatgtaaaattagaagatagagataattggatctctgtggattctgtcacatctgaaattaaacttgcaaaacttcctgattttgaatctagatatgttcaaaatggcacatacactgtaaagattgtggccatatcagaagattatcctagaaaaaccatcactggcacagtccttatcaatgttgaagacatcaacgacaactgtcccacactgatagagcctgtgcagacaatctgtcacgatgcagagtatgtgaatgttactgcagaggacctggatggacacccaaacagtggccctttcagtttctccgtcattgacaaaccacctggcatggcagaaaaatggaaaatagcacgccaagaaagtaccagtgtgctgctgcaacaaagtgagaaaaagcttgggagaagtgaaattcagttcctgatttcagacaatcagggttttagttgtcctgaaaagcaggtccttacactcacagtttgtgagtgtctgcatggcagcggctgcagggaagcacagcatgactcctatgtgggcctgggacccgcagcaattgcgctcatgattttggcctttctgctcctgctattggtaccacttttactgctgatgtgccattgcggaaagggcgccaaaggctttacccccatacctggcaccatagagatgctgcatccttggaataatgaaggagcaccacctgaagacaaggtggtgccatcatttctgccagtggatcaagggggcagtctagtaggaagaaatggagtaggaggtatggccaaggaagccacgatgaaaggaagtagctctgcttccattgtcaaagggcaacatgagatgtccgagatggatggaaggtgggaagaacacagaagcctgctttctggtagagctacccagtttacaggggccacaggcgctatcatgaccactgaaaccacgaagaccgcaagggccacaggggcttccagagacatggccggagctcaggcagctgctgttgcactgaacgaagaattcttaagaaattatttcactgataaagcggcctcttacactgaggaagatgaaaatcacacagccaaagattgccttctggtttattctcaggaagaaactgaatcgctgaatgcttctattggttgttgcagttttattgaaggagagctagatgaccgcttcttagatgatttgggacttaaattcaagacactagctgaagtttgcctgggtcaaaaaatagatataaataaggaaattgagcagagacaaaaacctgccacagaaacaagtatgaacacagcttcacattcactctgtgagcaaactatggttaattcagagaatacctactcctctggcagtagcttcccagttccaaaatctttgcaagaagccaatgcagagaaagtaactcaggaaatagtcactgaaagatctgtgtcttctaggcaggcgcaaaaggtagctacacctcttcctgacccaatggcttctagaaatgtgatagcaacagaaacttcctatgtcacagggtccactatgccaccaaccactgtgatcctgggtcctagccagccacagagccttattgtgacagagagggtgtatgctccagcttctaccttggtagatcagccttatgctaatgaaggtacagttgtggtcactgaaagagtaatacagcctcatgggggtggatcgaatcctctggaaggcactcagcatcttcaagatgtaccttacgtcatggtgagggaaagagagagcttccttgcccccagctcaggtgtgcagcctactctggccatgcctaatatagcagtaggacagaatgtgacagtgacagaaagagttctagcacctgcttccactctgcaatccagttaccagattcccactgaaaattctatgacggctaggaacaccacggtgtctggagctggagtccctggccctctgccagattttggtttagaggaatctggtcattctaattctaccataaccacatcttccaccagagttaccaagcatagcactgtacagcattcttactcctaa

SEQ ID NO: 9867 - DNA, 1042 bp, synthetic construct
  misc_feature 1..1042: note = Synthetic polypeptide
  source 1..1042: mol_type = other DNA
tgtggaggaaaacttaaatattaaatttgaactcaattgaacatggacacaaacaatggccaccaagtcccagaacaggtggtgtgagccccttgaggaattcatcgagcgctgtttcaaataaatctctatttaaattcctatttgttagttattgaaacacaacagacaatcgcaaacacaagttgacctttttgtgttccttgagtccagtcgggaagggcccttgtgactgggtctcatgccaaacaacttgttacgataagagctagggtcccagaccatgaggaaacttcatgagaatcctctgtagtctggtgagtgtagtgtccgactctggagcccaggctgttgcttcccggtgtggtggtgaatcctccacagtctgatctgctttaacgttggaagtggacttcacttacaggtcttaagcacaagaaatgaaaataagctgcttcctaaacatcctcatttagtgcggcaaaagcgcgcctggatcaccgcccccgtggctcttcgggagggagaggatctgtccaagaagaatccaattgccaagatacattctgatcttgcagaagaaagaggactcaaaattacttacaaatacactggaaaagggattacagagccaccttttggtatatttgtctttaacaaagatactggagaactgaatgttaccagcattcttgatcgagaagaaacaccattttttctgctaacaggttacgctttggatgcaagaggaaacaatgtagagaaacccttagagctacgcattaaggttcttgatatcaatgacaacgaaccagtgttcacacaggatgtctttgttgggtctgttgaagagttgagtgcagcacatactcttgtgatgaaaatcaatgcaacagatgcagatgagcccaataccctgaattcgaaaatttcctatagaatcgtatctctggagcctgcttatcctccagtgttctacctaaataaagatacaggagagatttatacaaccagtgttaccttggacagagaggtaagttaa

SEQ ID NO: 9868 - DNA, 523 bp, synthetic construct
  misc_feature 1..523: note = Synthetic polypeptide
  source 1..523: mol_type = other DNA
gaatgcattggatgagagggtaaaaatagaaagaaaaagaagtgatgactcctaggtcttggcatgtgtgggatataaacattcctttcaaattcagattattaaactagtgcagggcccatgcagttcccagcagccacatgcagctgtgacagggagcaccagcagctgaccagaggagctcataagcttttgccctgccctgctggtagttttaatttctgaagatcaaggagacaagaactgctaatctaatcaaggaagaactggtagttgaaacatgagagtgagaagctggatggaaaaattaaaagacaaggctggttacatgtctgggatgctggtgcctgtaggggttgggatagctggagccttgttcatcttgggagccctctacagcattaaggttatgaatcgccgaaggagaaatggcttcaaaaggcataaaagaaagcagagagaattcaacagcatgcaagatcgagtaatgctcttagccgacagctctgaagatgaattttga

SEQ ID NO: 9869 - DNA, 903 bp, synthetic construct
  misc_feature 1..903: note = Synthetic polypeptide
  source 1..903: mol_type = other DNA
gctgtggacctgagcaagtctacacctgcgctaagcctcagcctcctcctcagcacaaaagatgccaaagacctggatcagctgggccgaaataagatcacacacatcatctctatccatgagtcaccccagcctctgctgcaggatatcacctaccttcgcatcccggtcgctgatacccctgaggtacccatcaaaaagcacttcaaagaatgtatcaacttcatccactgctgccgccttaatggggggaactgccttgtgcactgctttgcaggcatctctcgcagcaccacgattgtgacagcgtatgtgatgactgtgacggggctaggctggcgggacgtgcttgaagccatcaaggccaccaggcccatcgccaaccccaacccaggctttaggcagcagcttgaagagtttggctgggccagttcccagaagggtgccagacataggacctcaaaaacctctggtgcccaatgccctccgatgacttcagcaacctgcctgctggctgcacgtgtggctcttctctccgcagcgctggtgcgcgaagccaccgggcgcacagcccagcgctgtcgtctgagtccgcgggcggccgccgagcgcctgctggggccgccacctcacgttgcagcaggatggtcaccggacccaaagtaccagatctgtctgtgcttcggtgaggaggacccgggccccacacagcaccccaaggagcagctcatcatggcggacgtgcaggtgcagcttcggcctgggagctcgtcctgcactctaagtgcctcaaccgagcgcccagatgggtcctcaacccctggcaaccccgatggcatcactcaccttcaatgcagctgcctccatcctaagcgagccgcttcctcttcttgtacccgctga

SEQ ID NO: 9870 - DNA, 714 bp, synthetic construct
  misc_feature 1..714: note = Synthetic polypeptide
  source 1..714: mol_type = other DNA
gctgtggacctgagcaagtctacacctgcgctaagcctcagcctcctcctcagcacaaaagatgccaaagacctggatcagctgggccgaaataagatcacacacatcatctctatccatgagtcaccccagcctctgctgcaggatatcacctaccttcgcatcccggtcgctgatacccctgaggtacccatcaaaaagcacttcaaagaatgtatcaacttcatccactgctgccgccttaatggggggaactgccttgtgcactgctttgcaggcatctctcgcagcaccacgattgtgacagcgtatgtgatgactgtgacggggctaggctggcgggacgtgcttgaagccatcaaggccaccaggcccatcgccaaccccaacccaggctttaggcagcagcttgaagagtttggctgggccagttcccagaagcttcgccggcagctggaggagcgcttcggcgagagccccttccgcgacgaggaggagttgcgcgcgctgctgccgctgtgcaagcgctgccggcagggctccgcgacctcggcctcctccgccgggccgcactcagcagcctccgagggaaccgtgcagcgcctggtgccgcgcacgccccgggaagcccaccggccgctgccgctgctggcgcgcgtcaagcagactttctcttgcctcccccggtgtctgtcccgcaagggcggcaagtga

SEQ ID NO: 9871 - DNA, 269 bp, synthetic construct
  misc_feature 1..269: note = Synthetic polypeptide
  source 1..269: mol_type = other DNA
gctgtggacctgagcaagtctacacctgcgctaagcctcagcctcctcctcagcacaaaagatgccaaagacctggatcagctgggccgaaataagatcacacacatcatctctatccatgagtcaccccagcctctgctgcaggatatcacctaccttcgcatcccggtcgctgatacccctgaggtacccatcaaaaagcacttcaaagaatgtatcaacttcatccactgctgccgccttaatggggggaactgccttgtgcactg

SEQ ID NO: 9872 - DNA, 884 bp, synthetic construct
  misc_feature 1..884: note = Synthetic polypeptide
  source 1..884: mol_type = other DNA
gtggtggcatgggcctgtagtcctagctactctggaggctggagtgggaggattgcttgagcccaggagttcaaggctgcagtgagccatgattgtaccactacgctccagcctgggagtatgagcattactggacagagttgagaggaactactcttttcttttataccgacaaaaagagtataatatatgttgacaaattagacatagtagacctcacatgccttactgagcagaattcaactgaaaagaactgtgcgaaattcacccttgttttgccgaaagaggaagtacaactgaagacagagaacacagaaagtggggaagaatggagaggcttcattcttacagtaacagagctgtcagttccccaaaacgtgtcactcctacctgggcaagtaattaaactgcatgaagtcctagagagagaaaagaaaaggaggattgagacagagcagagtacgtccgtggaaaaagagaaggaaccaactgaagattatgtggatgtactgaaccctatgccagcatgtttttatacagtgtcccggaaagaggcaactgagatgctccagaagaacccttctttgggaaatatgatcctgaggcctggtagtgacagtagaaactactccatcactattcggcaggagatagacattccaagaatcaagcactacaaagtgatgagcgtaggacaaaactacactattgaactggaaaaacctgtaacactcccaaaccttttcagtgtcattgattattttgtgaaggagactcgaggaaatttaagaccatttatatgttcaactgatgaaaacactggtcaagaacccagtatggaagggagaagtgaaaagttgaagaaaaatccacacattgcatga

SEQ ID NO: 9873 - DNA, 452 bp, synthetic construct
  misc_feature 1..452: note = Synthetic polypeptide
  source 1..452: mol_type = other DNA
ccatcagctgctgtgtgaccttggccgaggccctctgcctgtctgggctctgacttcctctaacacgaagttcccccaagcggcaccacttccagcggcagcgggcagccagtgagagcacggagcaggaggagggggatgccccccaggaggacttcatccagtacattgcccgggcgggcgacgccgtggccttcccgcacccccgcccctttctggccagcccgccccctgctctcggcaggtatttttcagtagatggaggtgctaggggtggacctgtgggcccttgccccccttcgcccccccctaggcggcccagggagcgctctccaggccccgtggacacgcgctcgcctgcctccagcggcaaggcccctcccagaggcggactcactggggccacctctccagcatggaccagaggagggaagcagggagagactgggtaa

SEQ ID NO: 9874 - DNA, 1208 bp, synthetic construct
  misc_feature 1..1208: note = Synthetic polypeptide
  source 1..1208: mol_type = other DNA
ccatcagctgctgtgtgaccttggccgaggccctctgcctgtctgggctctgacttcctctaacacgaagttcccccaagcggcaccacttccagcggcagcgggcagccagtgagagcacggagcaggaggagggggatgccccccaggaggacttcatccagtacattgcccgggcgggcgacgccgtggccttcccgcacccccgcccctttctggccagcccgccccctgctctcggcaggctagaggcggccgaggcagcgggaggagcgagccccgattcccccccggagcgcggcgcgggcagcgcggggcctgagcagcagcagccgccactggagccggacgccgagcgggacgcgggccccgagcaggcccagaccagctaccgcgacctgtggagcctgcgcgcctcgcttgagctgcatgcggccgcctcggaccacagcagcagcggcaacgaccgcgactcggtgcgcagcggcgacagctcgggctcaggctccgggggcgcggcgcccgccttcccgccgccctccccgcccgcgccgcggcccaaggacggcgaggcgcgccggctgctgcagatggacagtggctacgccagcatcgagggccgcggcgcaggcgacgacaccgagccacctgccgcgcccgcccggccccgcagcccgcgcgcctggccccgccgcccgcgccgcgactacagcatcgacgagaagacggacgcgctgttccacgagttcctgcgccacgacccgcacttcgacgacacgccggctgccgcgcgacaccgcgcccgcgcgcacccgcacgcccgcaaacagtggcagcgtggccggcagcacagcgaccccggcgcccgcgcggccccggccctggccggaaccccggcaccgcctgccggcgcggcccgacccgcgcgtgcgcccttgcggcgcggcgacagcgtggacggcccgcccgacggtcgcaccctgggcggcgccggcgacgaccccgccatccccgtcatcgaggaggagccgggcggcggggggtgccccggctcgggcctgtgcgtcctaccatccgggtcggtgctggacaagctggcggctggcctcgacgagagactctttccgccgcgcctcgccgagcccgtcgtggcgactcccgcgttggtcgccgccgcccccacgtcccccgaccacagcccggcctaa

SEQ ID NO: 9875 - DNA, 1052 bp, synthetic construct; identical to SEQ ID NO: 447
  misc_feature 1..1052: note = Synthetic polypeptide
  source 1..1052: mol_type = other DNA

SEQ ID NO: 9876 - DNA, 1118 bp, synthetic construct; identical to SEQ ID NO: 448
  misc_feature 1..1118: note = Synthetic polypeptide
  source 1..1118: mol_type = other DNA

SEQ ID NO: 9877 - DNA, 906 bp, synthetic construct
  misc_feature 1..906: note = Synthetic polypeptide
  source 1..906: mol_type = other DNA
tggtttgaatgtcccctccaaaactcatgctgaaacttcatccccagtgtggcagtattgagaggagatgcatccgtaagaaagaacaagattcctttaccacctcctcggcctctcataacacttccgaagaagtaccaacccttgccccctgagccggagagcagcaggccacctttatctcagagacacacctttccagaagtccagagaatgcccagtcagataagcttaagggacttaagtgaggtccttgaagcagaaaaagttcctcataaccagaggaagcctgaatcaactcatctgttagaaaaccaaaatactcaagagattccacttgccattagcagttcttcattcacgacaagcaaccacagtgtgcaaaacagagatcatagaggaggcatgcagccctgttctcctcagagatgccagcctccagccagctgcagccctcacgaaaatatactgccctataaatacacaagctggagaccacctttccccaaaaggtctgatagaaaggatgtccagcacaatgaatggtacattggagaatacagccgccaggcagtggaagaggcattcatgaaggagaacaaggatggtagtttcttggtccgagattgttccacaaaatccaaggaagagccctatgttttggctgtgttttatgagaacaaagtctacaatgtaaaaatacgcttcctggagaggaatcagcagtttgccctggggacaggactcagaggagatgagaagtttgattcagtagaagacatcatcgaacactacaagaattttcccattatactaattgatgggaaagataaaactggggtccacaggaaacagtgtcacctcactcagccactccctctcaccagacacctcttgcctctgtag

SEQ ID NO: 9878 - DNA, 255 bp, synthetic construct
  misc_feature 1..255: note = Synthetic polypeptide
  source 1..255: mol_type = other DNA
tggtttgaatgtcccctccaaaactcatgctgaaacttcatccccagtgtggcagtattgagaggagatgcatccgtaagaaagaacaagattcctttaccacctcctcggcctctcataacacttccgaagaagtaccaacccttgccccctgagccggagagcagcaggccacctttatctcagagacacacctttccagaagtccagagaatgcccagtcagataagcttaagggacttaagtgagccttga

SEQ ID NO: 9879 - DNA, 255 bp, synthetic construct
  misc_feature 1..255: note = Synthetic polypeptide
  source 1..255: mol_type = other DNA
tggtttgaatgtcccctccaaaactcatgctgaaacttcatccccagtgtggcagtattgagaggagatgcatccgtaagaaagaacaagattcctttaccacctcctcggcctctcataacacttccgaagaagtaccaacccttgccccctgagccggagagcagcaggccacctttatctcagagacacacctttccagaagtccagagaatgcccagtcagataagcttaagggacttaagtgagccataa

SEQ ID NO: 9880 - DNA, 951 bp, synthetic construct
  misc_feature 1..951: note = Synthetic polypeptide
  source 1..951: mol_type = other DNA
gaggtcatgggaacccagacactttcagatgctgatgtgggccttgctgcaaccaccaggacccagaatgtgactgtaggaggttattaccccggagttattctcggctttggatcgttccttggaatcattggatcaaaccttattgagaacaaaaggcagatgctggtggcttctatcgtgtttatcagctttggtgtgattgcggctttttgttgtgccatagttgacggggtctttgctgccagacacattgatctgaaaccactctacgctaaccggtgccattatgttcccaagacatcacagaaggaagctgaggaggtcataagttcctcaaccaaaaattctccttccacgagggttatgaggaaccttacccaggcagctagagaggttaactgccctcacctcagccgtgaattctgcacacctcgcatccggggcaacacctgcttctgctgtgacctctacaactgtggcaaccgggtggagatcactggtgggtactacgaatacatcgatgtcagcagttgccaagatatcatccacctctaccacctgctctggtctgccaccatcctcaacattgttggcctgttcctgggcatcatcactgccgctgtccttggaggctttaaggacatgaacccaactctcccagcactgaactgttctgttgaaaatacccatccaacagtttcttactatgctcatccccaagtggcatcctacaatacctactaccatagccctcctcacctgccaccatattctgcttatgactttcagcattccggtgtctttccatcctcccctccctctggactttctgatgagccccagtctgcctctccctcacccagctacatgtggtcctcaagtgcaccgccccgttactctccaccctactatccaccttttgaaaagccaccaccttacagtccctaa

SEQ ID NO: 9881 - DNA, 879 bp, synthetic construct
  misc_feature 1..879: note = Synthetic polypeptide
  source 1..879: mol_type = other DNA
gaggtcatgggaacccagacactttcagatgctgatgtgggccttgctgcaaccaccaggacccagaatgtgactgtaggaggttattaccccggagttattctcggctttggatcgttccttggaatcattggatcaaaccttattgagaacaaaaggcagatgctggtggcttctatcgtgtttatcagctttggtgtgattgcggctttttgttgtgccatagttgacggggtctttgctgccagacacattgatctgaaaccactctacgctaaccggtgccattatgttcccaagacatcacagaaggaagctgaggaggttaactgccctcacctcagccgtgaattctgcacacctcgcatccggggcaacacctgcttctgctgtgacctctacaactgtggcaaccgggtggagatcactggtgggtactacgaatacatcgatgtcagcagttgccaagatatcatccacctctaccacctgctctggtctgccaccatcctcaacattgttggcctgttcctgggcatcatcactgccgctgtccttggaggctttaaggacatgaacccaactctcccagcactgaactgttctgttgaaaatacccatccaacagtttcttactatgctcatccccaagtggcatcctacaatacctactaccatagccctcctcacctgccaccatattctgcttatgactttcagcattccggtgtctttccatcctcccctccctctggactttctgatgagccccagtctgcctctccctcacccagctacatgtggtcctcaagtgcaccgccccgttactctccaccctactatccaccttttgaaaagccaccaccttacagtccctaa

SEQ ID NO: 9882 - DNA, 627 bp, synthetic construct
  misc_feature 1..627: note = Synthetic polypeptide
  source 1..627: mol_type = other DNA
gaggtcatgggaacccagacactttcagatgctgatgtgggccttgctgcaaccaccaggacccagaatgtgactgtaggaggttattaccccggagttattctcggctttggatcgttccttggaatcattggatcaaaccttattgagaacaaaaggcagatgctggtggcttctatcgtgtttatcagctttggtgtgattgcggctttttgttgtgccatagttgacggggtctttgctgccagacacattgatctgaaaccactctacgctaaccggtgccattatgttcccaagacatcacagaaggaagctgaggagaacccaactctcccagcactgaactgttctgttgaaaatacccatccaacagtttcttactatgctcatccccaagtggcatcctacaatacctactaccatagccctcctcacctgccaccatattctgcttatgactttcagcattccggtgtctttccatcctcccctccctctggactttctgatgagccccagtctgcctctccctcacccagctacatgtggtcctcaagtgcaccgccccgttactctccaccctactatccaccttttgaaaagccaccaccttacagtccctaa

SEQ ID NO: 9883 - DNA, 349 bp, synthetic construct
  misc_feature 1..349: note = Synthetic polypeptide
  source 1..349: mol_type = other DNA
gaggtcatgggaacccagacactttcagatgctgatgtgggccttgctgcaaccaccaggacccagaatgtgactgtaggaggttattaccccggagttattctcggctttggatcgttccttggaatcattggatcaaaccttattgagaacaaaaggcagatgctggtggcttctatcgtgtttatcagctttggtgtgattgcggctttttgttgtgccatagttgacggggtctttgctgccagacacattgatctgaaaccactctacgctaaccggtgccattatgttcccaagacatcacagaaggaagctgaggagaacccaactctcccagcactgaact

SEQ ID NO: 9884 - DNA, 2484 bp, synthetic construct
  misc_feature 1..2484: note = Synthetic polypeptide
  source 1..2484: mol_type = other DNA
tttcttggttccctgaccgggaagcgaggtgactgacggccggcttaaacctgccctgtggagcgtccctgtgggggactccagacagcttgagtgacgcgatccaaagagtgctcccgggtaggcaattgccccagtggaacgcgtcgccagagcagcatgtagcaggcccccacagaggattaacacagtggctgaacaccaggaaggaactggcacttggagtccggacatctgaaacttgccctcccaggcccaatacttcaaagcatcctacctctgctcaatatatattacttggagaggattgaggaaactgccctcaagaaaggcctctcaactcaggccatctggcgccgactctgggatgaactgatgaagacaaggccttccagtttggaaagtgtgacatgttggcgagccaagtttatggaggcctttttttcccatgttctacgtgggaccattgatgtgtcttctgacaggcgtctttgtgatcagcggttctcacctcttctgcacagctcccgccatgtccgacagctcaccatctgtaacatgctgcagggtgcaaccgagctggtggctgagcccaaccgcagggttctggagaccctggccagctccctgcacactctcaagttccgccacctgctgttctctgatgtggctgctcagcagtcacttcggcagctgttgcatcagctcattcaccatggggctgtcagtcaagtgtcgctatactcctggcctgtgcctgagtcagcccttttcatccttattctcaccatgagtgctggcttctggcaaccagggcctggtggcccaccctgccgcctctgtggagaggcctcccgaggccgggccccatcccgagatgaagggtccctcttattgggctcacgtcggccccgccgggatgctgctgagcgatgtgctgcagccctgatggccagccggcgtaagagtgaagccaagcagatgcccagagctgcacctgccactcgggtaacacgccggagcacacaggagagcctgacagcaggcggaacagaccttaagagggagctgcaccccccagccacctcccatgaggctcctggcaccaagcggtcaccttctgctccagcagccacctcctctgcctcttcttctacatcctcatacaaacgggcaccagctagctcagccccacagcctaagcccctaaagcgtttcaagcgagctgcagggaagaagggtgctcgcacccgtcaggggcctggtgcagagtctgaagacctgtatgacttcgtttttattgtggctggcgagaaggaggatggcgaagagatggagattggggaagtggcttgtggagctttggatggatcagatcccagctgcctggggcttccagcactggaagcttcacaaagattccgcagcatctccaccttggagctattcacagttccactctccacagaggcagccctgacactatgccacctgctgagctcctgggtgtcactggagagcctcacactctcctacaatggcctgggctctaacatcttccgcctgctagacagcctgcgggccctgtcaggccaggctggatgtcgcctccgtgccctgcatctcagtgacctgttctcaccactgcccatcctggagctgacacgtgctatcgtgcgagcactgcccctgctacgggtcctctctattcgtgttgaccacccaagccagcgggacaaccctggtgtgccagggaatgcagggccccctagccacataataggcgatgaggagataccagaaaactgcctggagcagttggagatgggatttccacggggagcccagccagccccactgctgtgctccgttctgaaggcctcgggttctctgcagcagctgtccctggatagtgccacctttgcctctccccaggattttgggcttgttttgcaaacactcaaagagtacaacctagccctgaaaagactgagcttccatgacatgaatctcgctgactgtcagagcgaggtgctctttttgctacagaatctgactctgcaagagattaccttctccttctgccgtctgtttgagaagcgcccagcccaatttctgcctgagatggttgctgctatgaagggcaactccacactgaagggcctccggctgccagggaaccgcctggggaatgctggcctgctggccttggcagatgttttctcagaggattcatcctcctctctctgtcagctggacatcagttccaactgcatcaagccagatgggcttctggagttcgccaagcggctggagcgctggggccgtggagcctttggtcacctgcgcctcttccaaaactggctggaccaggatgcagtcacagccagggaagccatccggcggctccgggctacctgccatgtggttagcgactcatgggactcatcccaggccttcgcagattatgttagcaccatgtga

SEQ ID NO: 9885 - DNA, 712 bp, synthetic construct
  misc_feature 1..712: note = Synthetic polypeptide
  source 1..712: mol_type = other DNA
tatactcatgacggaatatgattcggccttaaaacaaaagggaatgctgatgtgggccgcagcttaggtggcctcagggacactctacagggagtaaaccagttgcagaggccccgtgccacgtgactccactgacgggaggttcccacaggagtcacattcattgagacaaaaagcagatggtgctggggcctggcgggggttgggggtcgggaggagttggcgtttcatgagggcagaatttcattttggaggatggagttctgaagatggacggtggtgacggttacacagtatgtgaatgtattgatacattatgaactctacacgtaaaaatggctaaaatggtgttgggcagttcagcgacgacatccagcagatgaccgggcagcggcccagcctgtactggcggctgtgctggaagctggtcagcccctgctttctcctgttcgtggtcgtggtcagcattgtgaccttcagacccccccactacggagcctacatcttccccgactgggccaacgcgctgggctgggtcatcgccacatcctccatggccatggtgcccatctatgcggcctacaagttctgcagcctgcctgggtcctttcgagagaaactggcctacgccattgcacccgagaaggaccgtgagctggtggacagaggggaggtgcgccagttcacgctccgccactggctcaaggtgtag

SEQ ID NO: 9886 - DNA, 1295 bp, synthetic construct
  misc_feature 1..1295: note = Synthetic polypeptide
  source 1..1295: mol_type = other DNA
gaaaaaaaagaaaagaaaaaaaattaaaccaaccacaacatcaccttaggttttggcattagctaaaaactaatacatagtaaagcgttaactattcaattgcatgaagcctcagagaggagaggaagatgcagaaaaaaagactgaagctagtagaggttgactaatgaggtttacaggaataaactgcctacatgatgcaaaagttcaatgtgaagcaataggaagtcatgcagaagacttagctaatatactcagtaaatgtggctacagtaaacaaatgattttcaatgtagacctaacagccttctgttggaagaagatgccatttaaaactttcatagctagagaagagaagtcaatgcttgtctttgaagctacaaaaaacaggctgaatctcttgtagtggctaatgcagctgatgacaaaggcccactacattatgtgagactgtgggaaaagctgagatatggctaatacgaacatattgggattttgaatttcctcaaccataccaacctaactttgagtttgttggaggattgcactgtaaacctgccaaagctttgcctaaggaaatggaaaattttgtccagagttcaggggaagatggtattgtggtgttttctctggggtcactgtttcaaaatgttacagaagaaaaggctaatatcattgcttcagcccttgcccagatcccacagaaggtgttatggaggtacaaaggaaaaaaaccatccacattaggagccaatactcggctgtatgattggataccccagaatgatcttcttggtcatcccaaaaccaaagcttttatcactcatggtggaatgaatgggatctatgaagctatttaccatggggtccctatggtgggagttcccatatttggtgatcagcttgataacatagctcacatgaaggccaaaggagcagctgtagaaataaacttcaaaactatgacaagcgaagatttactgagggctttgagaacagtcattaccgattcctcttataaagagaatgctatgagattatcaagaattcaccatgatcaacctgtaaagcccctagatcgagcagtcttctggatcgagtttgtcatgcgccacaaaggagccaagcacctgcgatcagctgcccatgacctcacctggttccagcactactctatagatgtgattgggttcctgctggcctgtgtggcaactgctatattcttgttcacaaaatgttttttattttcctgtcaaaaatttaataaaactagaaagatagaaaagagggaatag

SEQ ID NO: 9887 - DNA, 632 bp, synthetic construct
  misc_feature 1..632: note = Synthetic polypeptide
  source 1..632: mol_type = other DNA
gaaaaaaaagaaaagaaaaaaaattaaaccaaccacaacatcaccttaggttttggcattagctaaaaactaatacatagtaaagcgttaactattcaattgcatgaagcctcagagaggagaggaagatgcagaaaaaaagactgaagctagtagaggttgactaatgaggtttacaggaataaactgcctacatgatgcaaaagttcaatgtgaagcaataggaagtcatgcagaagacttagctaatatactcagtaaatgtggctacagtaaacaaatgattttcaatgtagacctaacagccttctgttggaagaagatgccatttaaaactttcatagctagagaagagaagtcaatgcttgtctttgaagctacaaaaaacaggctgaatctcttgtagtggctaatgcagctgatgacaaaggcccactacattatgtgagactgtgggaaaagctgagatatggctaatacgaacatattgggattttgaatttcctcaaccataccaacctaactttgagtttgttggaggattgcactgtaaacctgccaaagctttgcctaaggaaagttataccagaaaaccaagctctcttaagccatggcatctgtatctaaaatag

SEQ ID NO: 9888 - DNA, 638 bp, synthetic construct
  misc_feature 1..638: note = Synthetic polypeptide
  source 1..638: mol_type = other DNA
ggctgggcgtggtggctcatgcctataatcccagcactttaggagggcaaggtggttggatcacctgaggtcaggagttcgagaccagtctggccaacaagattgaatttgccaggaagaatgtgtatagtgccaatcagaaaattcaggatgctcaggataagctctacctctcatgggtagagtggaaaaggagcattggatatgatgatactgatgagtcccactgtgctgagcacattgagtcacgtactcttgcaattgcccgcaacctgactcagcagctccagaccacgtgccacaccctcctgtccaacatccaaggtgtaccacagaacatccaagatcaagccaagcacatgggggtgatggcaggcgacatctactcagtgttccgcaatgctgcctcctttaaagaagtgtctgacagcctcctcacttctagcaaggggcagctgcagaaaatgaaggaatctttagatgacgtgatggattatcttgttaacaacacgcccctcaactggctggtaggtcccttttatcctcagctgactgagtctcagaatgctcaggaccaaggtgcagagatggacaagagcagccaggagacccagcgatctgagcataaaactcattaa

SEQ ID NO: 9889 - DNA, 943 bp, synthetic construct
  misc_feature 1..943: note = Synthetic polypeptide
  source 1..943: mol_type = other DNA
tttcttggttccctgaacaggaagcgaggtaactgacggacggccaaggcagccccttgggtggcttaggcctgccctgtggagcatccctgcggtggactctggccagcctgagtgacgcgatccaaagagcgctcccgggtaggaaattccccgggtggaacgcctcgccagagcagcacgtagcaggcccccgaggaggattaacacactggctgaacactgggaaggaactggcacttggagtccggacatctgaaacttgtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctccgtcaccactctgggctctcccatgcattcaaactga

SEQ ID NO: 9890 - DNA, 694 bp, synthetic construct; identical to SEQ ID NO: 6465
  misc_feature 1..694: note = Synthetic polypeptide
  source 1..694: mol_type = other DNA

SEQ ID NO: 9891 - DNA, 238 bp, synthetic construct; identical to SEQ ID NO: 6378
  misc_feature 1..238: note = Synthetic polypeptide
  source 1..238: mol_type = other DNA

SEQ ID NO: 9892 - DNA, 416 bp, synthetic construct
  misc_feature 1..416: note = Synthetic polypeptide
  source 1..416: mol_type = other DNA
taccaatttaaaaggacgaccagaagcagtttgcttttaccaggtatttggatttgctcaaggacacgaaccttattaaaactcaggatgtgtttacagtcattcgatatatctcatataacagctatgggaagaacatggcctggaattggatacaactcaactgggactatctagtcaacagatatacactcaataacagaaaccttggccgaattgtcacaatagcagagccattcaacactgaactgcaactgtggcagatggagagcttttttgcaaaatatccacaagctggagcaggagaaaaacctagggaacaagtgctggaaacagtgaaaaacaatatagagtggctaaaacaacatagaaacaccatcagagaatggttttttaatttacttgagagtggttaa

SEQ ID NO: 9893 - DNA, 158 bp, synthetic construct; identical to SEQ ID NO: 7602
  misc_feature 1..158: note = Synthetic polypeptide
  source 1..158: mol_type = other DNA

SEQ ID NO: 9894 - DNA, 1768 bp, synthetic construct
  misc_feature 1..1768: note = Synthetic polypeptide
  source 1..1768: mol_type = other DNA
caacatagctaatcgagacagaatttgtgttttgtgcttcatggatcttttttacattcatgtccacttaaagaaggcagccagctccttcattcttttaacctcacaggaggtttgtgctgtaggacagaaaggctaattatccagcagatgatctgccttcctggcactccttgagggaattatgccagataggggaaagggagacatgtgccttgtggaaaagagaaggtgggaggggaggcatgccccagaagtccaggatgggaagagagatctgcagactcccagggaacctacagctttctccttcacagcattgcaggagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatccccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatgggcctacagcaggggcagccatttcttctcacatggatatagacaaagtagccttcacaggatcaacagaggttggcaagttgatcaaagaagctgccgggaaaagcaatctgaagagggtgaccctggagcttggaggaaagagcccttgcattgtgttagctgatgccgacttggacaatgctgttgaatttgcacaccatggggtattctaccaccagggccagtgttgtatagccgcatccaggatttttgtggaagaatcaatttatgatgagtttgttcgaaggagtgttgagcgggctaagaagtatatccttggaaatcctctgaccccaggagtcactcaaggccctcagattgacaaggaacaatatgataaaatacttgacctcattgagagtgggaagaaagaaggggccaaactggaatgtggaggaggcccgtgggggaataaaggctactttgtccagcccacagtgttctctaatgttacagatgagatgcgcattgccaaagaggagatttttggaccagtgcagcaaatcatgaagtttaaatctttagatgacgtgatcaaaagagcaaacaatactttctatggcttatcagcaggagtgtttaccaaagacattgataaagccataacaatctcctctgctctgcaggcaggaacagtgtgggtgaattgctatggcgtggtaagtgcccagtgcccctttggtggattcaagatgtctggaaatggaagagaactgggagagtacggtttccatgaatatacagaggtcaaaacagtcacagtgaaaatctctcagaagaactcataa

SEQ ID NO: 9895 - DNA, 955 bp, synthetic construct
  misc_feature 1..955: note = Synthetic polypeptide
  source 1..955: mol_type = other DNA
caacatagctaatcgagacagaatttgtgttttgtgcttcatggatcttttttacattcatgtccacttaaagaaggcagccagctccttcattcttttaacctcacaggaggtttgtgctgtaggacagaaaggctaattatccagcagatgatctgccttcctggcactccttgagggaattatgccagataggggaaagggagacatgtgccttgtggaaaagagaaggtgggaggggaggcatgccccagaagtccaggatgggaagagagatctgcagactcccagggaacctacagctttctccttcacagcattgcaggagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatccccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatggggccagtgttgtatag

SEQ ID NO: 9896 - DNA, 978 bp, synthetic construct
  misc_feature 1..978: note = Synthetic polypeptide
  source 1..978: mol_type = other DNA
caacatagctaatcgagacagaatttgtgttttgtgcttcatggatcttttttacattcatgtccacttaaagaaggcagccagctccttcattcttttaacctcacaggaggtttgtgctgtaggacagaaaggctaattatccagcagatgatctgccttcctggcactccttgagggaattatgccagataggggaaagggagacatgtgccttgtggaaaagagaaggtgggaggggaggcatgccccagaagtccaggatgggaagagagatctgcagactcccagggaacctacagctttctccttcacagcattgcaggagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatccccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatgggcctacagcaggggcagccatttcttctcacatggatat

SEQ ID NO: 9897 - DNA, 871 bp, synthetic construct
  misc_feature 1..871: note = Synthetic polypeptide
  source 1..871: mol_type = other DNA
caacatagctaatcgagacagaatttgtgttttgtgcttcatggatcttttttacattcatgtccacttaaagaaggcagccagctccttcattcttttaacctcacaggaggtttgtgctgtaggacagaaaggctaattatccagcagatgatctgccttcctggcactccttgagggaattatgccagataggggaaagggagacatgtgccttgtggaaaagagaaggtgggaggggaggcatgccccagaagtccaggatgggaagagagatctgcagactcccagggaacctacagctttctccttcacagcattgcaggagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatccccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctc

SEQ ID NO: 9898 - DNA, 277 bp, synthetic construct
  misc_feature 1..277: note = Synthetic polypeptide
  source 1..277: mol_type = other DNA
ggaggagcaatgagattactaaagcaccatttggcaactacaatagtaacagttgcttcagggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccattgatgcgctggctccctccctccgaggctacttctcagggctggaagtcccgtcagttctgctga

SEQ ID NO: 9899 - DNA, 406 bp, synthetic construct
  misc_feature 1..406: note = Synthetic polypeptide
  source 1..406: mol_type = other DNA
ggaggagcaatgagattactaaagcaccatttggcaactacaatagtaacagttgcttcagggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccagatgcgctggctccctccctccgaggctacttctcagggctggaagtcccgtcagttctgctga

SEQ ID NO: 9900 - DNA, 475 bp, synthetic construct
  misc_feature 1..475: note = Synthetic polypeptide
  source 1..475: mol_type = other DNA
ggaggagcaatgagattactaaagcaccatttggcaactacaatagtaacagttgcttcagggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccagtgtttctctcctgaggcaaagcccaacacacctgtcttttgtccacttctccagcaaattagatttgtctctgggaatgtgtttgtaacataccaacctactgcagaccagcagagggagctcccatgttga

SEQ ID NO: 9901 - DNA, 430 bp, synthetic construct
  misc_feature 1..430: note = Synthetic polypeptide
  source 1..430: mol_type = other DNA
ggaggagcaatgagattactaaagcaccatttggcaactacaatagtaacagttgcttcagggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccagctctgtgaaggtcagactgtgaggagaagccaccccttgagcgctccgtctcctgatagtgccagcctggcctggtttcctgtttga

SEQ ID NO: 9902 - DNA, 490 bp, synthetic construct
  misc_feature 1..490: note = Synthetic polypeptide
  source 1..490: mol_type = other DNA
ggaggagcaatgagattactaaagcaccatttggcaactacaatagtaacagttgcttcagggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccaggtaattgatacccatcggccaggacttcactcacttcaccaccagtcctttcaaacttggttcccgagagcacaccatacaactaacacctatccagctaacagatccaccctcaagagattaatgatcccctctaaatcaagctga

SEQ ID NO: 9903 - DNA, 247 bp, synthetic construct
  misc_feature 1..247: note = Synthetic polypeptide
  source 1..247: mol_type = other DNA
ggaggagcaatgagattactaaagcaccatttggcaactacaatagtaacagttgcttcagggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccattaggtggagctaatgaacatggagagaggcagtga

SEQ ID NO: 9904 - DNA, 355 bp, synthetic construct
  misc_feature 1..355: note = Synthetic polypeptide
  source 1..355: mol_type = other DNA
ggaggagcaatgagattactaaagcaccatttggcaactacaatagtaacagttgcttcagggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccaggaaaccctgtag

SEQ ID NO: 9905 - DNA, 2309 bp, synthetic construct; identical to SEQ ID NO: 7608
  misc_feature 1..2309: note = Synthetic polypeptide
  source 1..2309: mol_type = other DNA

SEQ ID NO: 9906 - DNA, 2389 bp, synthetic construct; identical to SEQ ID NO: 7609
  misc_feature 1..2389: note = Synthetic polypeptide
  source 1..2389: mol_type = other DNA

SEQ ID NO: 9907 - DNA, 630 bp, synthetic construct
  misc_feature 1..630: note = Synthetic polypeptide
  source 1..630: mol_type = other DNA
tgatatggtttggctgtgtccccacccagttctccaattgaatttaactcacataatccccacgtgtcatgggagggacccagtgggaggtaactgaatcatgggggcaggtttttcccgtgctgtacttgtgatagtgaataagtcttgtgagatctgatggttttgtaaagggcagttgtacatatgctgtcttgcctgccaccactaattagtgaatgccaaaggcagcaactggaggctgtgagctactcctctcgatatgctctgggcctcttttatgaagctggtacgaagattgatgtcccttgggctgggcagtacatcaccagtaatccctgcatacgcttcgtctccattgataataagaagcgcaatatagagtcatcagaaattgggccttccctcgtgattcacaccactgtcccatttggagttacatacttggaacacagcattgaggatgtgcaagagttagtcttccagcagctggaaaacattttgccgggtttgcctcagccaattgctaccaaatgccaaaaatggagacattcacaggtaccaagtgctggtgtgattctaggatgtgcgaagagcccctggatgatggcgattggatttcccatctga

SEQ ID NO: 9908 - DNA, 711 bp, synthetic construct
  misc_feature 1..711: note = Synthetic polypeptide
  source 1..711: mol_type = other DNA
tgatatggtttggctgtgtccccacccagttctccaattgaatttaactcacataatccccacgtgtcatgggagggacccagtgggaggtaactgaatcatgggggcaggtttttcccgtgctgtacttgtgatagtgaataagtcttgtgagatctgatggttttgtaaagggcagttgtacatatgctgtcttgcctgccaccactaattagtgaatgccaaaggcagcaactggaggctgtgagctactcctctcgatatgctctgggcctcttttatgaagctggtacgaagattgatgtcccttgggctgggcagtacatcaccagtaatccctgcatacgcttcgtctccattgataataagaagcgcaatatagagtcatcagaaattgggccttccctcgtgattcacaccactgtcccatttggagttacatacttggaacacagcattgaggatgtgcaagagttagtcttccagcagctggaaaacattttgccgggtttgcctcagccaattgctaccaaatgccaaaaatggagacattcacaggttacaaatgctgctgccaactgtcctggccaaatgactctgcatcacaaacctttccttgcatgtggaggggatggatttactcagtccaactttgatggctgcatcacttctgccctatgtgttctggaagctttaaagaattatatttag

SEQ ID NO: 9909 - DNA, 1926 bp, synthetic construct; identical to SEQ ID NO: 9669
  misc_feature 1..1926: note = Synthetic polypeptide
  source 1..1926: mol_type = other DNA

SEQ ID NO: 9910 - DNA, 2439 bp, synthetic construct; identical to SEQ ID NO: 9670
  misc_feature 1..2439: note = Synthetic polypeptide
  source 1..2439: mol_type = other DNA

SEQ ID NO: 9911 - DNA, 2481 bp, synthetic construct; identical to SEQ ID NO: 9671
  misc_feature 1..2481: note = Synthetic polypeptide
  source 1..2481: mol_type = other DNA

SEQ ID NO: 9912 - DNA, 251 bp, synthetic construct
  misc_feature 1..251: note = Synthetic polypeptide
  source 1..251: mol_type = other DNA
tgtggggaagagagaactggaccaggacagcgcgggaaactgacaatgccactgcttgctagctttgggattttggacaaataggagaggagaggcagcagcatggcgagtgtcctgtcccgacgccttggaaagcggtccctcctgggagcccgggtgttgggacccagtgcctcggaggggccctcggctgccccaccctcggagccactgctagaaggggccgctccccagcctttcaccacctctga

SEQ ID NO: 9913 - DNA, 400 bp, synthetic construct; identical to SEQ ID NO: 749
  misc_feature 1..400: note = Synthetic polypeptide
  source 1..400: mol_type = other DNA

SEQ ID NO: 9914 - DNA, 2301 bp, synthetic construct; identical to SEQ ID NO: 750
  misc_feature 1..2301: note = Synthetic polypeptide
  source 1..2301: mol_type = other DNA

SEQ ID NO: 9915 - DNA, 2381 bp, synthetic construct; identical to SEQ ID NO: 751
  misc_feature 1..2381: note = Synthetic polypeptide
  source 1..2381: mol_type = other DNA

SEQ ID NO: 9916 - DNA, 692 bp, synthetic construct; identical to SEQ ID NO: 752
  misc_feature 1..692: note = Synthetic polypeptide
  source 1..692: mol_type = other DNA

SEQ ID NO: 9917 - DNA, 326 bp, synthetic construct
  misc_feature 1..326: note = Synthetic polypeptide
  source 1..326: mol_type = other DNA
tatgtttaggctttgtgtccccacccaaatctcatcttgcattataatccccataatccccacgtgtcaagggaaagactgggtggaggtaattgtatcataggggcggtttcccccatgctgttcttgtgatagtaagtgagttctcatgagatccggtggttttataattgtttggttgttcctcatgcgttcgttctccttcctgctgcctgtgaagaaggtgccttgcttccccttcaccttccaccatgattgcaagtttcctgaggcctcctcagccatgcagaactacttcaaatcatcccaacaccagagaacactaa

SEQ ID NO: 9918 - DNA, 2152 bp, synthetic construct
  misc_feature 1..2152: note = Synthetic polypeptide
  source 1..2152: mol_type = other DNA
tcatttctcaacctgttggactctttctgcagcatatggcaaagtggatctttctctccttcttgaaatgctccctgccttggctactttttagtctcctttgacgattcctcttcctctgcccatatttttaaatgatgagtttggacattctatcaatgattattcaatatctcctgatgggcagtttattctcttagaatacaactacgtgaagcaatggaggcattcctacacagcttcatatgacatttatgatttaaataaaaggcagctgattacagaagagaggattccaaacaacacacagtgggtcacatggtcaccagtgggtcataaattggcatatgtttggaacaatgacatttatgttaaaattgaaccaaatttaccaagttacagaatcacatggacggggaaagaagatataatatataatggaataactgactgggtttatgaagaggaagtcttcagtgcctactctgctctgtggtggtctccaaacggcacttttttagcatatgcccaatttaacgacacagaagtcccacttattgaatactccttctactctgatgagtcactgcagtacccaaagactgtacgggttccatatccaaaggcaggagctgtgaatccaactgtaaagttctttgttgtaaatacagactctctcagctcagtcaccaatgcaacttccatacaaatcactgctcctgcttctatgttgataggggatcactacttgtgtgatgtgacatgggcaacacaagaaagaatttctttgcagtggctcaggaggattcagaactattcggtcatggatatttgtgactatgatgaatccagtggaagatggaactgcttagtggcacggcaacacattgaaatgagtactactggctgggttggaagatttaggccttcagaacctcattttacccttgatggtaatagcttctacaagatcatcagcaatgaagaaggttacagacacatttgctatttccaaatagataaaaaagactgcacatttattacaaaaggcacctgggaagtcatcgggatagaagctctaaccagtgattatctatactacattagtaatgaatataaaggaatgccaggaggaaggaatctttataaaatccaacttagtgactatacaaaagtgacatgcctcagttgtgagctgaatccggaaaggtgtcagtactattctgtgtcattcagtaaagaggcgaagtattatcagctgagatgttccggtcctggtctgcccctctatactctacacagcagcgtgaatgataaagggctgagagtcctggaagacaattcagctttggataaaatgctgcagaatgtccagatgccctccaaaaaactggacttcattattttgaatgaaacaaaattttggtatcagatgatcttgcctcctcattttgataaatccaagaaatatcctctactattagatgtgtatgcaggcccatgtagtcaaaaagcagacactgtcttcagactgaactgggccacttaccttgcaagcacagaaaacattatagtagctagctttgatggcagaggaagtggttaccaaggagataagatcatgcatgcaatcaacagaagactgggaacatttgaagttgaagatcaaattgaagcagccagacaattttcaaaaatgggatttgtggacaacaaacgaattgcaatttggggctggtcatatggagggtacgtaacctcaatggtcctgggatcgggaagtggcgtgttcaagtgtggaatagccgtggcgcctgtatcccggtgggagtactatgactcagtgtacacagaacgttacatgggtctcccaactccagaagacaaccttgaccattacagaaattcaacagtcatgagcagagctgaaaattttaaacaagttgagtacctccttattcatggaacagcagatgataacgttcactttcagcagtcagctcagatctccaaagccctggtcgatgttggagtggatttccaggcaatgtggtatactgatgaagaccatggaatagctagcagcacagcacaccaacatatatatacccacatgagccacttcataaaacaatgtttctctttaccttag

SEQ ID NO: 9919 - DNA, 367 bp, synthetic construct
  misc_feature 1..367: note = Synthetic polypeptide
  source 1..367: mol_type = other DNA
tcatttctcaacctgttggactctttctgcagcatatggcaaagtggatctttctctccttcttgaaatgctccctgccttggctactttttagtctcctttgacgattcctcttcctctgcccatatttttaaatgatgagtttggacattctatcaatgattattcaatatctcctgatgggcagtttattctcttagaatacaactacgtgaagcaatggaggcattcctacacagcttcatatgacatttatgatttaaataaaaggcagctgattacagaagagaggattccaaacaacacacagtgggtcacatggtcaccagtgggtcataaattggttagcatatgtttggaacaatga

SEQ ID NO: 9920 - DNA, 161 bp, synthetic construct; identical to SEQ ID NO: 7668
  misc_feature 1..161: note = Synthetic polypeptide
  source 1..161: mol_type = other DNA

SEQ ID NO: 9921 - DNA, 178 bp, synthetic construct; identical to SEQ ID NO: 7669
  misc_feature 1..178: note = Synthetic polypeptide
  source 1..178: mol_type = other DNA

SEQ ID NO: 9922 - DNA, 698 bp, synthetic construct
  misc_feature 1..698: note = Synthetic polypeptide
  source 1..698: mol_type = other DNA
tgatatggtttggctgtgtccccacccagttctccaattgaatttaactcacataatccccacgtgtcatgggagggacccagtgggaggtaactgaatcatgggggcaggtttttcccgtgctgtacttgtgatagtgaataagtcttgtgagatctgatggttttgtaaagggcagttgtacatatgctgtcttgcctgccaccacgtaagtcatgcctttgctctttctttgtcttccaccgtgattgtgaggcctttccagcatgtggaacttaattagtgaatgccaaaggcagcaactggaggctgtgagctactcctctcgatatgctctgggcctcttttatgaagctggtacgaagattgatgtcccttgggctgggcagtacatcaccagtaatccctgcatacgcttcgtctccattgataataagaagcgcaatatagagtcatcagaaattgggccttccctcgtgattcacaccactgtcccatttggagttacatacttggaacacagcattgaggatgtgcaagagttagtcttccagcagctggaaaacattttgccgggtttgcctcagccaattgctaccaaatgccaaaaatggagacattcacaggtaccaagtgctggtgtgattctaggatgtgcgaagagcccctggatgatggcgattggatttcccatctga

SEQ ID NO: 9923 - DNA, 779 bp, synthetic construct
  misc_feature 1..779: note = Synthetic polypeptide
  source 1..779: mol_type = other DNA
tgatatggtttggctgtgtccccacccagttctccaattgaatttaactcacataatccccacgtgtcatgggagggacccagtgggaggtaactgaatcatgggggcaggtttttcccgtgctgtacttgtgatagtgaataagtcttgtgagatctgatggttttgtaaagggcagttgtacatatgctgtcttgcctgccaccacgtaagtcatgcctttgctctttctttgtcttccaccgtgattgtgaggcctttccagcatgtggaacttaattagtgaatgccaaaggcagcaactggaggctgtgagctactcctctcgatatgctctgggcctcttttatgaagctggtacgaagattgatgtcccttgggctgggcagtacatcaccagtaatccctgcatacgcttcgtctccattgataataagaagcgcaatatagagtcatcagaaattgggccttccctcgtgattcacaccactgtcccatttggagttacatacttggaacacagcattgaggatgtgcaagagttagtcttccagcagctggaaaacattttgccgggtttgcctcagccaattgctaccaaatgccaaaaatggagacattcacaggttacaaatgctgctgccaactgtcctggccaaatgactctgcatcacaaacctttccttgcatgtggaggggatggatttactcagtccaactttgatggctgcatcacttctgccctatgtgttctggaagctttaaagaattatatttag

SEQ ID NO: 9924 - DNA, 405 bp, synthetic construct
  misc_feature 1..405: note = Synthetic polypeptide
  source 1..405: mol_type = other DNA
aaattgaggcaacaattaatagcctaccaaccaaaaatggtccaggaccagacggattcacagccaaattctaccagaggcgtgggctttgccactaggcaggtgggaaatgtgaccaaaccaacggtaattatcagtcaagaaggagacaaagtggtcatcaggactctcagcacattcaagaacacggagattagtttccagctgggagaagagtttgatgaaaccactgcagatgatagaaactgtaagtctgttgttagcctggatggagacaaacttgttcacatacagaaatgggatggcaaagaaacaaattttgtaagagaaattaaggatggcaaaatggttatgacccttacttttggtgatgtggttgctgttcgccactatgagaaggcataa

SEQ ID NO: 9925 - DNA, 507 bp, synthetic construct
  misc_feature 1..507: note = Synthetic polypeptide
  source 1..507: mol_type = other DNA
aaattgaggcaacaattaatagcctaccaaccaaaaatggtccaggaccagacggattcacagccaaattctaccagaggcgtgggctttgccactaggcaggtgggaaatgtgaccaaaccaacggtaattatcagtcaagaaggagacaaagtggtcatcaggactctcagcacattcaagaacacggagattagtttccagctgggagaagagtttgatgaaaccactgcagatgatagaaactgtaagtctgttgttagcctggatggagacaaacttgttcacatacagaaatgggatggcaaagaaacaaattttgtaagagaaattaaggatggcaaaatggttatggtaagtaatgacaattctccattcttccttgtttttttctcctctccgcacacctctcacctccttccttcttcttccctcctccttccattcttcctccttccttccttctttaataatacatcactggcaaggttctttaactatatgtaa

SEQ ID NO: 9926 - DNA, 363 bp, synthetic construct; identical to SEQ ID NO: 7059
  misc_feature 1..363: note = Synthetic polypeptide
  source 1..363: mol_type = other DNA

SEQ ID NO: 9927 - DNA, 465 bp, synthetic construct; identical to SEQ ID NO: 7060
  misc_feature 1..465: note = Synthetic polypeptide
  source 1..465: mol_type = other DNA

SEQ ID NO: 9928 - DNA, 243 bp, synthetic construct; identical to SEQ ID NO: 6376
  misc_feature 1..243: note = Synthetic polypeptide
  source 1..243: mol_type = other DNA

SEQ ID NO: 9929 - DNA, 877 bp, synthetic construct; identical to SEQ ID NO: 6377
  misc_feature 1..877: note = Synthetic polypeptide
  source 1..877: mol_type = other DNA

SEQ ID NO: 9930 - DNA, 1133 bp, synthetic construct; identical to SEQ ID NO: 7332
  misc_feature 1..1133: note = Synthetic polypeptide
  source 1..1133: mol_type = other DNA

SEQ ID NO: 9931 - DNA, 1172 bp, synthetic construct; identical to SEQ ID NO: 7333
  misc_feature 1..1172: note = Synthetic polypeptide
  source 1..1172: mol_type = other DNA

SEQ ID NO: 9932 - DNA, 1178 bp, synthetic construct
  misc_feature 1..1178: note = Synthetic polypeptide
  source 1..1178: mol_type = other DNA
cagcagacccttgaataatgttttgttataaaacattgatgagaaaaaaaagtatttcctggctggggccactgtctgttgggtttgcacgttctacccacgtctgcgtggctcttctgcaggcacccccacccacctacccacatcccaaacctgtgcctgtcaggttcatcagcacgtccgcatggtcccggtgtgggtgagtgtgggtgtgtgggcgtgtgtgccctgcgatgggagggcgtgctggccagggccggttcccgccttgttccctgagcagctgggatgggctctggccacccgtgacttggaactggaataagtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacctccaaccccctggcctcccacgactacatcctgaagattgtgcccacggtttatgaggacaagagtggcaagcagcggtactcctaccagtacacggtggccaacaaggaatacgtcgcctacagccacacgggccgcatcatccctgcaatctggttccgctacgacctcagccccatcacggtcaagtacacagagagacggcagccgctgtacagattcatcaccacgatctgtgccatcattggcgggaccttcaccgtcgccggcatcctggactcatgcatcttcacagcctctgaggcctggaagaagatccagctgggcaagatgcattga

SEQ ID NO: 9933 - DNA, 854 bp, synthetic construct
  misc_feature 1..854: note = Synthetic polypeptide
  source 1..854: mol_type = other DNA
cagcagacccttgaataatgttttgttataaaacattgatgagaaaaaaaagtatttcctggctggggccactgtctgttgggtttgcacgttctacccacgtctgcgtggctcttctgcaggcacccccacccacctacccacatcccaaacctgtgcctgtcaggttcatcagcacgtccgcatggtcccggtgtgggtgagtgtgggtgtgtgggcgtgtgtgccctgcgatgggagggcgtgctggccagggccggttcccgccttgttccctgagcagctgggatgggctctggccacccgtgacttggaactggaataagtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaagaaccaggagcttcagatcctaagtcaagtgggtgaacgcagtgcccttgggagggccgaggcacccggtggcagctggcagggttttgctcagcacgtgccggccttcctcgaagctcggtactgtcacagtggagcctctcaacaacgctgtgaggcagcaccatttgacagg

SEQ ID NO: 9934 - DNA, 473 bp, synthetic construct
  misc_feature 1..473: note = Synthetic polypeptide
  source 1..473: mol_type = other DNA
cagcagacccttgaataatgttttgttataaaacattgatgagaaaaaaaagtatttcctggctggggccactgtctgttgggtttgcacgttctacccacgtctgcgtggctcttctgcaggcacccccacccacctacccacatcccaaacctgtgcctgtcaggttcatcagcacgtccgcatggtcccggtgtgggtgagtgtgggtgtgtgggcgtgtgtgccctgcgatgggagggcgtgctggccagggccggttcccgccttgttccctgagcagctgggatgggctctggccacccgtgacttggaactggaataagtttgacatctacaggaaggtgcccaaggaccttacgcagccaacgtacaccggggccattatctccatctgctgctgcctcttcatcctcttcctcttcctctcggagctcaccggatttataacgacagaagttggttgggcttga

SEQ ID NO: 9935 - DNA, 722 bp, synthetic construct
  misc_feature 1..722: note = Synthetic polypeptide
  source 1..722: mol_type = other DNA
cagcagacccttgaataatgttttgttataaaacattgatgagaaaaaaaagtatttcctggctggggccactgtctgttgggtttgcacgttctacccacgtctgcgtggctcttctgcaggcacccccacccacctacccacatcccaaacctgtgcctgtcaggttcatcagcacgtccgcatggtcccggtgtgggtgagtgtgggtgtgtgggcgtgtgtgccctgcgatgggagggcgtgctggccagggccggttcccgccttgttccctgagcagctgggatgggctctggccacccgtgacttggaactggaataagtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggaagttgaccagcagccagatgtcagagtttgcgtgttttga

SEQ ID NO: 9936 - DNA, 1067 bp, synthetic construct
  misc_feature 1..1067: note = Synthetic polypeptide
  source 1..1067: mol_type = other DNA
tgatatggtttggctgtgtccccctccaaatctcaacttgaattgtatctcccggaattcccatgtgttgtgggagggacctgggaggaagtaattgaatcacgggggccggtctttcttgtactattcttgtgatagtgaataagtctcaggagatctgatgggtttatcaggggtttccgcttttgcttcttcctcatttttttctcttgctgctgccatgtaagaagtgcctttcgccacccactgtgattctgaggcttccccagccatgtggaactgtgattttcaaagccaagtcaaaatattctccagaattactcaaataccggttgcccctctacctggcctccctcttcatcagccttgttttcctgttggtgaatttaacctgtgctgtgctggtaaagacgggaaattgggagaggaaggttatcgtctctgtgcgagtggccattaatgacacgctcttcgtgctgtgtgccgtctctctctccatctgtctctacaaaatctctaagatgtccttagccaacatttacttggagtccaagggctcctccgtgtgtcaagtgactgccatcggtgtcaccgtgatactgctttacacctctcgggcctgctacaacctgttcatcctgtcattttctcagaacaagagcgtccattcctttgattatgactggtacaatgtatcagaccaggcagatttgaagaatcagctgggagatgctggatacgtattatttggagtggtgttatttgtttgggaactcttacctaccaccttagtcgtttatttcttccgagttagaaatcctacaaaggaccttaccaaccctggaatggtccccagccatggattcagtcccagatcttatttctttgacaaccctcgaagatatgacagtgatgatgaccttgcctggaacattgcccctcagggacttcagggaggttttgctccagattactatgattggggacaacaaactaacagcttcctggcacaagcaggaactttgcaagactcaactttggatcctgacaaaccaagccttgggtag

SEQ ID NO: 9937 - DNA, 968 bp, synthetic construct
  misc_feature 1..968: note = Synthetic polypeptide
  source 1..968: mol_type = other DNA
tgatatggtttggctgtgtccccctccaaatctcaacttgaattgtatctcccggaattcccatgtgttgtgggagggacctgggaggaagtaattgaatcacgggggccggtctttcttgtactattcttgtgatagtgaataagtctcaggagatctgatgggtttatcaggggtttccgcttttgcttcttcctcatttttttctcttgctgctgccatgtaagaagtgcctttcgccacccactgtgattctgaggcttccccagccatgtggaactgtgattttcaaagccaagtcaaaatattctccagaattactcaaataccggttgcccctctacctggcctccctcttcatcagccttgttttcctgttggtgaatttaacctgtgctgtgctggtaaagacgggaaattgggagaggaaggttatcgtctctgtgcgagtggccattaatgacacgctcttcgtgctgtgtgccgtctctctctccatctgtctctacaaaatctctaagatgtccttagccaacatttacttggagtccaagggctcctccgtgtgtcaagtgactgccatcggtgtcaccgtgatactgctttacacctctcgggcctgctacaacctgttcatcctgtcattttctcagaacaagagcgtccattcctttgattatgactggtacaatgtatcagaccaggcagatttgaagaatcagctgggagatgctggatacgtattatttggagtggtgttatttgtttgggaactcttacctaccaccttagtcgtttatttcttccgagttagaaatcctacaaaggaccttaccaaccctggaatggtccccagccatggattcagtcccagatcttatttctttgacaaccctcgaagatatgacagtgatgatgaccttgcctggaacattgcccctcagggacttcagggaggattactatga

SEQ ID NO: 9938 - DNA, 558 bp, synthetic construct
  misc_feature 1..558: note = Synthetic polypeptide
  source 1..558: mol_type = other DNA
ggccgggcgcggtggctcacacctgtaattccagcactttgggaggccgaggcgggtggatcacctgaggtcaggagttcaagaccagcctgggcaacatggagaaaccctgtctctacaaaaatacaaaaattagccagagatgctcagaacctcatagaagcagccagcactggggccgccatctccgtgaaggtggtcgccaacatcgctgccaacctgattgcgttcctggctgtgctggactttatcaatgctgccctctcctggctgggagacatggtggacatccaagggctcagcttccagctcatctgctcctacatcctgcggcctgtagccttcttgatgggtgtggcgtgggaggactgcccagtggtagctgagctgctggggatcaagctgtttctgaacgagtttgtggcctatcaagacctctccaagtacaagcaacgccgcctggcaggggccgaggagtgggtcggcgacaggaagcagtggatctccagacgaggtcttgctatgttgaccaggctggtcttgaactcctggccttaa

SEQ ID NO: 9939 - DNA, 837 bp, synthetic construct
  misc_feature 1..837: note = Synthetic polypeptide
  source 1..837: mol_type = other DNA
ggccgggcgcggtggctcacacctgtaattccagcactttgggaggccgaggcgggtggatcacctgaggtcaggagttcaagaccagcctgggcaacatggagaaaccctgtctctacaaaaatacaaaaattagccagagatgctcagaacctcatagaagcagccagcactggggccgccatctccgtgaaggtggtcgccaacatcgctgccaacctgattgcgttcctggctgtgctggactttatcaatgctgccctctcctggctgggagacatggtggacatccaagggctcagcttccagctcatctgctcctacatcctgcggcctgtagccttcttgatgggtgtggcgtgggaggactgcccagtggtagctgagctgctggggatcaagctgtttctgaacgagtttgtggcctatcaagacctctccaagtacaagcaacgccgcctggcaggggccgaggagtgggtcggcgacaggaagcagtggatctccgtcagagctgaagtcctcacgacgtttgccctctgtggatttgccaatttcagctccattgggatcatgctgggaggcttgacctccatggtcccccaacggaagagcgacttctcccagatagtgctccgggcgctcttcacgggagcctgtgtgtccctggtgaacgcctgtatggcagggatcctctacatgcccaggggggctgaagttgactgcatgtccctcttgaacacgaccctcagcagcagtagctttgagatttaccagtgctgccgtgaggccttccagaggatattcaaaagtacacctgccgagtcccagccctga

SEQ ID NO: 9940 - DNA, 876 bp, synthetic construct
  misc_feature 1..876: note = Synthetic polypeptide
  source 1..876: mol_type = other DNA
ggccgggcgcggtggctcacacctgtaattccagcactttgggaggccgaggcgggtggatcacctgaggtcaggagttcaagaccagcctgggcaacatggagaaaccctgtctctacaaaaatacaaaaattagccagagatgctcagaacctcatagaagcagccagcactggggccgccatctccgtgaaggtggtcgccaacatcgctgccaacctgattgcgttcctggctgtgctggactttatcaatgctgccctctcctggctgggagacatggtggacatccaagggctcagcttccagctcatctgctcctacatcctgcggcctgtagccttcttgatgggtgtggcgtgggaggactgcccagtggtagctgagctgctggggatcaagctgtttctgaacgagtttgtggcctatcaagacctctccaagtacaagcaacgccgcctggcaggggccgaggagtgggtcggcgacaggaagcagtggatctccgtcagagctgaagtcctcacgacgtttgccctctgtggatttgccaatttcagctccattgggatcatgctgggaggcttgacctccatggtcccccaacggaagagcgacttctcccagatagtgctccgggcgctcttcacgggagcctgtgtgtccctggtgaacgcctgtatggcagggatcctctacatgcccaggggggctgaagttgactgcatgtccctcttgaacacgaccctcagcagcagtagctttgagatttaccagtgctgccgtgaggccttccagagcgtcaatccagagttcagcccagaggccctggacaactgctgtcggttttacaaccacacgatctgtgcacagtga

SEQ ID NO: 9941 - DNA, 767 bp, synthetic construct
  misc_feature 1..767: note = Synthetic polypeptide
  source 1..767: mol_type = other DNA
catgcctacaatcccagcactttgggaggctaagacaggcagatcgcttgagttcaggagtttgagattagcctgggcaacatggcgaaaccctaaaaaacacaaaaattagctgggcatggtggcttgttcctagagtcctagctactcgggaggctgagaaaaagaagcaaaaaaagttgaaggatttgatctggttcagaagccaactccattctactgttcacctgattgaatttgccaggaagaatgtgtatagtgccaatcagaaaattcaggatgctcaggataagctctacctctcatgggtagagtggaaaaggagcattggatatgatgatactgatgagtcccactgtgctgagcacattgagtcacgtactcttgcaattgcccgcaacctgactcagcagctccagaccacgtgccacaccctcctgtccaacatccaaggtgtaccacagaacatccaagatcaagccaagcacatgggggtgatggcaggcgacatctactcagtgttccgcaatgctgcctcctttaaagaagtgtctgacagcctcctcacttctagcaaggggcagctgcagaaaatgaaggaatctttagatgacgtgatggattatcttgttaacaacacgcccctcaactggctggtaggtcccttttatcctcagctgactgagtctcagaatgctcaggaccaaggtgcagagatggacaagagcagccaggagacccagcgatctgagcataaaactcattaa

SEQ ID NO: 9942 - DNA, 880 bp, synthetic construct
  misc_feature 1..880: note = Synthetic polypeptide
  source 1..880: mol_type = other DNA
catgcctacaatcccagcactttgggaggctaagacaggcagatcgcttgagttcaggagtttgagattagcctgggcaacatggcgaaaccctaaaaaacacaaaaattagctgggcatggtggcttgttcctagagtcctagctactcgggaggctgagaaaaagaagcaaaaaaagttgaaggatttgatctggttcagaagccaagttattatgttagactgggatccctgtctaccaagcttcactcccgtgcctaccagcaggctctcagcagggttaaagaagctaagcaaaaaagccaacagaccatttctcagctccattctactgttcacctgattgaatttgccaggaagaatgtgtatagtgccaatcagaaaattcaggatgctcaggataagctctacctctcatgggtagagtggaaaaggagcattggatatgatgatactgatgagtcccactgtgctgagcacattgagtcacgtactcttgcaattgcccgcaacctgactcagcagctccagaccacgtgccacaccctcctgtccaacatccaaggtgtaccacagaacatccaagatcaagccaagcacatgggggtgatggcaggcgacatctactcagtgttccgcaatgctgcctcctttaaagaagtgtctgacagcctcctcacttctagcaaggggcagctgcagaaaatgaaggaatctttagatgacgtgatggattatcttgttaacaacacgcccctcaactggctggtaggtcccttttatcctcagctgactgagtctcagaatgctcaggaccaaggtgcagagatggacaagagcagccaggagacccagcgatctgagcataaaactcattaa

SEQ ID NO: 9943 - DNA, 182 bp, synthetic construct
  misc_feature 1..182: note = Synthetic polypeptide
  source 1..182: mol_type = other DNA
cttgcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctggtg

SEQ ID NO: 9944 - DNA, 1977 bp, synthetic construct
  misc_feature 1..1977: note = Synthetic polypeptide
  source 1..1977: mol_type = other DNA
cttgcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctgttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctccgaccccctcatccgctgggactcctacgacaacttcagtgggcatcgagatgacggcatggaggaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacgagcctgtccccggggcctccagtgccactgctgccttgagtccccaggagaagcgggagctggaccgcctgctgagtggctttggcttagagcgagagaagcaaggcgccatgtaccacacccagcacctcaggtcccgcccagcagggggctcggctgtgccctcctctggacgccacgttgtcccagcccaggttcatgtcaatggtggggcgttagcatctgagcgggagacagacatcctggacgatgaattgccaaaccaggatggtcacagtgcgggcagcatgggcacactctcttctctggacggggtcaccaacaccagtgaggggggctacccagaggccctgtccccactgaccaacggtctggacaagtcctaccccatggagcctatggtcaatggaggaggctacccctacgagtctgccagccgggcggggcctgcccatgctggccacacggcccccatgcggccctcctactctgcacaggagggtttagctggctaccagagggaggggccccacccagcctggccacagccagtgaccacctcccactatgcccatgaccccagcggtatgttccgctctcaatccttttcggaagctgaaccccagctgcccccagctccggtccgagggggaagcagccgggaggctgtgcaaaggggactgaattcgtggcagcagcagcagcagc

SEQ ID NO: 9945 - DNA, 1269 bp, synthetic construct
  misc_feature 1..1269: note = Synthetic polypeptide
  source 1..1269: mol_type = other DNA
cttgcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctgttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctccgaccccctcatccgctgggactcctacgacaacttcagtgggcatcgagatgacggcatggaggaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacg

SEQ ID NO: 9946 - DNA, 1169 bp, synthetic construct
  misc_feature 1..1169: note = Synthetic polypeptide
  source 1..1169: mol_type = other DNA
cttgcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctgttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctccgaccccctcatccgctgggactcctacgacaacttcagtgggcatcgagatgacggcatggaggatgggaacaaacagaataccaatagccagtcaattggaagcatctcaggtggcctggaggatcaatatacctggccagacacacactggccttcccaaagttag

SEQ ID NO: 9947 - DNA, 1266 bp, synthetic construct
  misc_feature 1..1266: note = Synthetic polypeptide
  source 1..1266: mol_type = other DNA
acatttctactcacaggtctcagagcacttcaaactcagtgtgtccaaaacagagctaccatctgctccagatctgctttatttctggtattcttagctccttgaatggcaccatcatataataaattggacaagccagaacctggaagtcaatttgtcctttccctctctgtcatgttccatatctaacttaacatcaagctctgtccattttacttcctgacttcctctgtaacccatttcttcccgtgtttaccatcacctggtctcagctacccctgtctccctcctgactggcctcccacttccactcttgcccctccactcaattcttctctgttctgcagcccaagtgaccctctcaaaatgtaaatctgatcatgtcactctcctccttagtgctccctagtgactctccagagcttttggaatgaaaagcaaaattcctgtcatggtccacaaagccctgcctagtctggctctgccaacctatttccccacaatccagccacgttggctctctcctcctgtgtttcctgccaccacgtggcctttgcacttgcggtttcctcttactggaatttcctcccgccctccctgcttgcttcagtctggttaactcctacgtatttatcctctatatctctgcttgcccgactcctttttggaggagcttttcctgatcctctaggtcaaggggagctcccaacatctccccattagtgccatgctcctttccttccttgcatttgtcagttttaatttccactcctatgagtgatcactgggttaatgctttctcccgccacccacccgtctacaatctccatgagagtcaagggtccagagaaggaggagaagttgagacaggcggtcaagcaggtgctgaagtgtgatgtgactcagagccagccactgggggccgtccccttacccccggctgactgcgtgctcagcacactgtgtctggatgccgcctgcccagacctccccacctactgcagggcgctcaggaacctcggcagcctactgaagccagggggcttcctggtgatcatggatgcgctcaagagcagctactacatgattggtgagcagaagttctccagcctccccctgggccgggaggcagtagaggctgctgtgaaagaggctggctacacaatcgaatggtttgaggtgatctcgcaaagttattcttccaccatggccaacaacgaaggacttttctccctggtggcgaggaagctgagcagacccctgtga

SEQ ID NO: 9948 - DNA, 2046 bp, synthetic construct
  misc_feature 1..2046: note = Synthetic polypeptide
  source 1..2046: mol_type = other DNA
tggtgtggtctgaatgtttgtatcccccaaaattcataggttgaaatctctctccaatgaaatggtactaaaggtggggcctttaggaggcgattaggtcatgattgcaaagccctcgtgagtgggattcatgcctttatgaaggaggccctgggggcttcttcacccttttggccatgtgaagacacagctggaaggcaccatctaggaagcatggagccggcaccagacactgaatctgctaccaccttgatcttggacttcccagccttcagacctgtgggagatagaagaggactgtcagaaggacgtagaaggcacggttttactgtgaggagcaaagattctttacctacgcattttacaagaaatgtgcagaaagccattgataaatatacctgcaaatccttgtcatccttttcctccagcggaagccatacacccacgggagcccacacctcttggtctgggtcggccacacagagctctaccaccggctcatccacggagaggggctccgtttattcctggagagatgacgaatttgacgaagccagttcacagtcagtgcagcggttactctgggaggtggaggaaatgttatttgaagggaaagtgaaccctcagacccagagtctgctggccgaatgcggggagtggacaagaagatccctccatttgagagtattaggaagacagctgatcctgcccactgacaaaggcgtccagcatttccagggcagcactcctgcctccgcagtccacagacccccgctcagtgcctgcggacacagcagcaacatcagagagttgtgcatttctggctctcaaatagtcccagcagcactctcagcctctgccctgccaggccctgatgacacaggggttgctgacctaacggcacgttcatccctggaagaagaggtttaccatgtggatggaaagattgaggagtatttcgcttttgacagaaaagaggatgatgatgaatgtcttgaacaaaaaccagctcagcccggtaggaaatggcgcaaactcggacttcctcctgtttccccgcgtgactgtgtcaaagatgccgtggcagcagaagtgtttgatcacgtctggacaaatatggtagaacttttggaagagctgattagaaaacactgggaaactacactcacagaagggaaaaaacagagagaaacattgaaagtggctggaaacagatttccgcacgtcctcgttccacacgctcacgccgatggagccagtggccccccgtccggacacgccgaggctcacggcatctccctggcttctcgtctgaacccgccccagattcatcacttctccagcagtttttatagtgacatgaatggtgtcatgacaattcaagcaaaaccgcttcagcggagacctgcctattttgctgacagaacgcagaatgagaaggaggacaaagcatcgggtggaggggcaggtgctctctcctccgcaccgcacagactgggacgggcctcagacactcatggattatcaccttctgcaaagaaaacaccagtgccctggaggctgccttctcttgcttcagattcacagagactaaaaactcccaacatctatagtgacgaagttcttcggggaacaaaactgccgactggcgtggaccacatggcttccccactggttcaaacgtcacggagcaggttccccccgctagtcacggagaccagggggcagaatacagcagttcctggatgccgccttgtttcttacagaggaaggcatctacaaaaccgtgtgttgagtgccatgcctgacggtacagaacgatcgcgtcttcgagaaagaacagccaccctggaacggttgtcaaggcccagcacaacccacacgttccggcagtcggatacgcctcgaaaaagttcattgacacaaatggaatttgctgctcacacatggacaggtcaaagtattttgacaggttcacaatatgtgcctaaatcttttcagaggacaactttgactttcaagaggagattccaagtgacatcttga

SEQ ID NO: 9949 - DNA, 1965 bp, synthetic construct; identical to SEQ ID NO: 8289
  misc_feature 1..1965: note = Synthetic polypeptide
  source 1..1965: mol_type = other DNA

SEQ ID NO: 9950 - DNA, 857 bp, synthetic construct
  misc_feature 1..857: note = Synthetic polypeptide
  source 1..857: mol_type = other DNA
acccggcatttggtttcaaccctctggaagattattatgtctccaagtctgcagtggtgtttgggggcttttatcttttctttttcacagagaagatcttgaagattcttcttaagcagaaaaatgagcatcatcatggacacagccattatgcctctgagtcgcttccctccaagaaggaccaggaggagggggtgatggagaagctgcagaacggggacctggaccacatgattcctcagcactgcagcagtgagctggacggcaaggcgcccatggtggacgagaaggtcattgtgggctcgctctctgtgcaggacctgcaggcttcccagagtgcttgctactggctgaaaggtgtccgctactctgatatcggcactctggcctggatgatcactctgagcgacggcctccataatttcatcgatggcctggccatcggtgcttccttcactgtgtcagttttccaaggcatcagcacctcggtggccatcctctgtgaggagttcccacatgagctaggagactttgtcatcctgctcaacgctgggatgagcatccaacaagctctcttcttcaacttcctttctgcctgctgctgctacctgggtctggcctttggcatcctggccggcagccacttctctgccaactggatttttgcgctagctggaggaatgttcttgtatatttctctggctgatatgttccctgagatgaatgaggtctgtcaagaggatgaaaggaagggcagcatcttgattccatttatcatccagaacctgggcctcctgactggattcaccatcatggtggtcctcaccatgtattcaggacagatccagattgggtag

SEQ ID NO: 9951 - DNA, 824 bp, synthetic construct
  misc_feature 1..824: note = Synthetic polypeptide
  source 1..824: mol_type = other DNA
acccggcatttggtttcaaccctctggaagattattatgtctccaagtctgcagtggtgtttgggggcttttatcttttctttttcacagagaagatcttgaagattcttcttaagcagaaaaatgagcatcatcatggacacagccattatgcctctgagtcgcttccctccaagaaggaccaggaggagggggtgatggagaagctgcagaacggggacctggaccacatgattcctcagcactgcagcagtgagctggacggcaaggcgcccatggtggacgagaaggtcattgtgggctcgctctctgtgcaggacctgcaggcttcccagagtgcttgctactggctgaaaggtgtccgctactctgatatcggcactctggcctggatgatcactctgagcgacggcctccataatttcatcgatggcctggccatcggtgcttccttcactgtgtcagttttccaaggcatcagcacctcggtggccatcctctgtgaggagttcccacatgagctaggagactttgtcatcctgctcaacgctgggatgagcatccaacaagctctcttcttcaacttcctttctgcctgctgctgctacctgggtctggcctttggcatcctggccggcagccacttctctgccaactggatttttgcgctagctggaggaatgttcttgtatatttctctggctgatatgatggagttttgctctgttgcccaggctggagtgcaatggtgccatctcagctcactgcaacctctgccgcttgggttgaagcgattatcctgtctaagcctcccgagtaactga

SEQ ID NO: 9952 - DNA, 514 bp, synthetic construct
  misc_feature 1..514: note = Synthetic polypeptide
  source 1..514: mol_type = other DNA
acccggcatttggtttcaaccctctggaagattattatgtctccaagtctgcagtggtgtttgggggcttttatcttttctttttcacagagaagatcttgaagattcttcttaagcagaaaaatgagcatcatcatggacacagccattatgcctctgagtcgcttccctccaagaaggaccaggaggagggggtgatggagaagctgcagaacggggacctggaccacatgattcctcagcactgcagcagtgagctggacggcaaggcgcccatggtggacgagaaggtcattgtgggctcgctctctgtgcaggacctgcaggcttcccagagtgcttgctactggctgaaaggtgtccgctactctgatatcggcactctggcctggatgatcactctgagcgacggcctccataatttcatcgatggcctggccatcggtgcttccttcactgtgtcagttttccaaggcatcagcacctcggtggccatcctctgtgaggagttccc

SEQ ID NO: 9953 - DNA, 1543 bp, synthetic construct; identical to SEQ ID NO: 8010
  misc_feature 1..1543: note = Synthetic polypeptide
  source 1..1543: mol_type = other DNA

SEQ ID NO: 9954 - DNA, 772 bp, synthetic construct; identical to SEQ ID NO: 8011
  misc_feature 1..772: note = Synthetic polypeptide
  source 1..772: mol_type = other DNA

SEQ ID NO: 9955 - DNA, 608 bp, synthetic construct; identical to SEQ ID NO: 8012
  misc_feature 1..608: note = Synthetic polypeptide
  source 1..608: mol_type = other DNA

SEQ ID NO: 9956 - DNA, 535 bp, synthetic construct; identical to SEQ ID NO: 8013
  misc_feature 1..535: note = Synthetic polypeptide
  source 1..535: mol_type = other DNA

SEQ ID NO: 9957 - DNA, 454 bp, synthetic construct; identical to SEQ ID NO: 8014
  misc_feature 1..454: note = Synthetic polypeptide
  source 1..454: mol_type = other DNA

SEQ ID NO: 9958 - DNA, 280 bp, synthetic construct; identical to SEQ ID NO: 8015
  misc_feature 1..280: note = Synthetic polypeptide
  source 1..280: mol_type = other DNA

SEQ ID NO: 9959 - DNA, 1681 bp, synthetic construct; identical to SEQ ID NO: 714
  misc_feature 1..1681: note = Synthetic polypeptide
  source 1..1681: mol_type = other DNA

SEQ ID NO: 9960 - DNA, 1543 bp, synthetic construct; identical to SEQ ID NO: 717
  misc_feature 1..1543: note = Synthetic polypeptide
  source 1..1543: mol_type = other DNA

SEQ ID NO: 9961 - DNA, 258 bp, synthetic construct; identical to SEQ ID NO: 719
  misc_feature 1..258: note = Synthetic polypeptide
  source 1..258: mol_type = other DNA

SEQ ID NO: 9962 - DNA, 763 bp, synthetic construct; identical to SEQ ID NO: 606
  misc_feature 1..763: note = Synthetic polypeptide
  source 1..763: mol_type = other DNA

SEQ ID NO: 9963 - DNA, 2231 bp, synthetic construct
  misc_feature 1..2231: note = Synthetic polypeptide
  source 1..2231: mol_type = other DNA
ggagcatagtggccaccgatcatgaaccaacagatgccaggaaatcttttccttgttttgatgagcccaacaaaaaggcaacttatacaatatctatcacccatcccaaagaatacggagcactttcaaatatgccagtggcgaaagaagagtcagtggatgataaatggactcgaacaacttttgagaagtctgtccccatgagcacgtacctggtgtgctttgctgtacatcaatttgactctgtaaagagaatatcaaatagtggaaaacctcttacaatttatgtccagccagagcaaaagcacacagccgaatatgctgcaaacataactaaaagtgtgtttgattattttgaagaatactttgctatgaattattctcttcctaaattagataaaatcgctattccagattttggcactggtgccatggagaactggggactcatcacgtacagagaaacgaacctgctttatgaccctaaggaatcagcctcatcaaaccaacagagggtggccactgtggttgcccatgaacttgtgcatcagtggtttggaaatattgtgaccatggactggtgggaagacttgtggctaaatgaaggatttgcttctttctttgagtttctgggagtaaaccatgcagaaacagactggcaaatgcgtgaccaaatgttacttgaagatgtattacctgttcaagaggatgattctttgatgtcttcgcatccaattattgtgactgtgacaacccctgatgaaataacatctgtttttgatggaatatcctatagcaagggatcttctattttgagaatgcttgaagactggataaaaccagagaattttcaaaaaggatgtcagatgtacttggaaaaataccaattcaagaatgcaaaaacttctgatttttgggcagcactggaagaggcaagtaggctaccagtgaaagaagtaatggacacctggaccagacagatgggttatcctgtgcttaacgtgaacggtgtcaagaacatcacacagaaacgctttttgttggacccaagagctaacccttctcagcccccttcagatcttggttatacatggaatatcccagttaaatggactgaagataatataacaagcagtgtgttatttaataggtcagaaaaagaaggaatcactttgaactcctctaatcctagtggaaatgcttttctcaaaataaacccagatcatattgggttttatcgtgtaaattatgaagtagcaacttgggactcgatagctacagcgctctccttgaaccacaagacattttcttcagcagatcgtgcaagtcttattgatgatgcttttgccttggcaagagctcaacttctagattataaggtggctttgaacttgaccaagtatctcaaaagggaagagaattttttaccatggcagagagtaatttcagctgtaacctacatcattagcatgtttgaagatgataaagagctatatcctatgattgaggaatacttccaaggtcaagtgaagcctattgcagattctctgggatggaatgatgctggagaccatgtcacaaagttactccgttcctccgtgttagggtttgcgtgcaagatgggagacagagaagccttgaacaatgcttcctcgttatttgagcagtggctaaatgggactgtaagccttcccgtaaatctcaggcttctggtgtatcggtatgggatgcagaactctggcaatgagatttcatggaactacactcttgagcaataccagaaaacttcattagctcaagaaaaagaaaaactgctgtatggattagcatcagtgaagaacgttactcttttgtcaaggtatttggatttgctcaaggacacgaaccttattaaaactcaggatgtgtttacagtcattcgatatatctcatataacagctatgggaagaacatggcctggaattggatacaactcaactgggactatctagtcaacagatatacactcaataacagaaaccttggccgaattgtcacaatagcagagccattcaacactgaactgcaactgtggcagatggagagcttttttgcaaaatatccacaagctggagcaggagaaaaacctagggaacaagtgctggaaacagtgaaaaacaatatagagtggctaaaacaacatagaaacaccatcagagaatggttttttaatttacttgagagtggttaa

SEQ ID NO: 9964 - DNA, 916 bp, synthetic construct; identical to SEQ ID NO: 7516
  misc_feature 1..916: note = Synthetic polypeptide
  source 1..916: mol_type = other DNA

SEQ ID NO: 9965 - DNA, 157 bp, synthetic construct; identical to SEQ ID NO: 7517
  misc_feature 1..157: note = Synthetic polypeptide
  source 1..157: mol_type = other DNA

SEQ ID NO: 9966 - DNA, 424 bp, synthetic construct; identical to SEQ ID NO: 7518
  misc_feature 1..424: note = Synthetic polypeptide
  source 1..424: mol_type = other DNA

SEQ ID NO: 9967 - DNA, 675 bp, synthetic construct; identical to SEQ ID NO: 7519
  misc_feature 1..675: note = Synthetic polypeptide
  source 1..675: mol_type = other DNA

SEQ ID NO: 9968 - DNA, 1447 bp, synthetic construct
  misc_feature 1..1447: note = Synthetic polypeptide
  source 1..1447: mol_type = other DNA
gaacttggaaagaatcccaaggagaaagaaaatgttgagttgaaaaacaatgaggatgaaaaattagaattattcaacttaaaggacaaaaggctgaggtattatcaagacagctttgctcaacatggatcgagaaaacagggagcagtaccaagtggtgattcaagccaaggatatgggcggccagatgggaggattatctgggaccaccaccgtgaacatcacactgactgatgtcaacgacaaccctccccgattcccccagagtacataccagtttaaaactcctgaatcttctccaccggggacaccaattggcagaatcaaagccagcgacgctgatgtgggagaaaatgctgaaattgagtacagcatcacagacggtgaggggctggatatgtttgatgtcatcaccgaccaggaaacccaggaagggattataactgtcaaaaagctcttggactttgaaaagaagaaagtgtatacccttaaagtggaagcctccaatccttatgttgagccacgatttctctacttggggcctttcaaagattcagccacggttagaattgtggtggaggatgtagatgagccacctgtcttcagcaaactggcctacatcttacaaataagagaagatgctcagataaacaccacaataggctccgtcacagcccaagatccagatgctgccaggaatcctgtcaagtactctgtagatcgacacacagatatggacagaatattcaacattgattctggaaatggttcgatttttacatcgaaacttcttgaccgagaaacactgctatggcacaacattacagtgatagcaacagagatcaataatccaaagcaaagtagtcgagtacctctatatattaaagttctagatgtcaatgacaacgccccagaatttgctgagttctatgaaacttttgtctgtgaaaaagcaaaggcagatcagttgattcagaccctgcatgctgttgacaaggatgacccttatagtggacaccaattttcgttttccttggcccctgaagcagccagtggctcaaactttaccattcaagacaacaaagacaacacggcgggaatcttaactcggaaaaatggctataatagacacgagatgagcacctatctcttgcctgtggtcatttcagacaacgactacccagttcaaagcagcactgggacagtgactgtccgggtctgtgcatgtgaccaccacgggaacatgcaatcctgccatgcggaggcgctcatccaccccacgggactgagcacgggggctctggttgccatccttctgtgcatcgtgatcctactaggtaaactggttctccctgcctcctatctccccatggtgaggggctcacactgttactgtgacactctagatttatctgcctcccccattaaggcatacagcctgatctag

SEQ ID NO: 9969 - DNA, 1828 bp, synthetic construct
  misc_feature 1..1828: note = Synthetic polypeptide
  source 1..1828: mol_type = other DNA
gaacttggaaagaatcccaaggagaaagaaaatgttgagttgaaaaacaatgaggatgaaaaattagaattattcaacttaaaggacaaaaggctgaggtattatcaagacagctttgctcaacatggatcgagaaaacagggagcagtaccaagtggtgattcaagccaaggatatgggcggccagatgggaggattatctgggaccaccaccgtgaacatcacactgactgatgtcaacgacaaccctccccgattcccccagagtacataccagtttaaaactcctgaatcttctccaccggggacaccaattggcagaatcaaagccagcgacgctgatgtgggagaaaatgctgaaattgagtacagcatcacagacggtgaggggctggatatgtttgatgtcatcaccgaccaggaaacccaggaagggattataactgtcaaaaagctcttggactttgaaaagaagaaagtgtatacccttaaagtggaagcctccaatccttatgttgagccacgatttctctacttggggcctttcaaagattcagccacggttagaattgtggtggaggatgtagatgagccacctgtcttcagcaaactggcctacatcttacaaataagagaagatgctcagataaacaccacaataggctccgtcacagcccaagatccagatgctgccaggaatcctgtcaagtactctgtagatcgacacacagatatggacagaatattcaacattgattctggaaatggttcgatttttacatcgaaacttcttgaccgagaaacactgctatggcacaacattacagtgatagcaacagagatcaataatccaaagcaaagtagtcgagtacctctatatattaaagttctagatgtcaatgacaacgccccagaatttgctgagttctatgaaacttttgtctgtgaaaaagcaaaggcagatcagttgattcagaccctgcatgctgttgacaaggatgacccttatagtggacaccaattttcgttttccttggcccctgaagcagccagtggctcaaactttaccattcaagacaacaaagacaacacggcgggaatcttaactcggaaaaatggctataatagacacgagatgagcacctatctcttgcctgtggtcatttcagacaacgactacccagttcaaagcagcactgggacagtgactgtccgggtctgtgcatgtgaccaccacgggaacatgcaatcctgccatgcggaggcgctcatccaccccacgggactgagcacgggggctctggttgccatccttctgtgcatcgtgatcctactagtgacagtggtgctgtttgcagctctgaggcggcagcgaaaaaaagagcctttgatcatttccaaagaggacatcagagataacattgtcagttacaacgacgaaggtggtggagaggaggacacccaggcttttgatatcggcaccctgaggaatcctgaagccatagaggacaacaaattacgaagggacattgtgcccgaagcccttttcctaccccgacggactccaacagctcgcgacaacaccgatgtcagagatttcattaaccaaaggttaaaggaaaatgacacggaccccactgccccgccatacgactccttggccacttacgcctatgaaggcactggctccgtggcggattccctgagctcgctggagtcagtgaccacggatgcagatcaagactatgattaccttagtgactggggacctcgattcaaaaagcttgcagatatgtatggaggagtggacagtgacaaagactcctaa

SEQ ID NO: 9970 - DNA, 616 bp, synthetic construct
  misc_feature 1..616: note = Synthetic polypeptide
  source 1..616: mol_type = other DNA
ccttcctcttggtcctctgactctgcccacctccttccttttgtcccccgctgccaacgtcatcctctccaattccgctccctctcctccccagccctcaccttggagcctcccatgaggggccttgcttgctcttgattttgtgactgtgatcatctctgccccatgcacacattttatttcccatgtgagactgctcagatacttttttgtcttctccttgcatcctctgagagcactggacacagtgccagacacagagaatacaacttattcgaaaacgattgctctatatggattcttctttaagataaagggactcaaacatgatactacctcttatagtttttacatgcagagaataaagcacacagacctggaatctccctctgcggtctacgagcacaaccacgtcagcctgcgagcggcacgcctggtgaagtatgagatcagagcagaggccctggttgacggcaagtggcaggagttcaggacaaaccagatcaagcagaagtttgggttgaccacgtcatcctgcaaaagccataccttgaaaatccaaactgtgggcatcccaatctatgtaagttttgcattcatcttcccagcatcttga

SEQ ID NO: 9971 - DNA, 1084 bp, synthetic construct; identical to SEQ ID NO: 580
  misc_feature 1..1084: note = Synthetic polypeptide
  source 1..1084: mol_type = other DNA

SEQ ID NO: 9972 - DNA, 773 bp, synthetic construct
  misc_feature 1..773: note = Synthetic polypeptide
  source 1..773: mol_type = other DNA
ttatctgattgaaaattagcaaagatctgaatagacatttctcaaagaagagataagaatggacaacaggcatatgaaaaatactcaacaccactaattattagggaaatacaaaccaaaaccacaatgagatatcacctcatcccagttaaaatggctattatcaaaaagacagtaagaatgttgataaaggggcaatgcttatacactgttgttgggaatgtagatcagccactatggaaaacagtatggagattcctcaaaaaacttaaaatagaactaccatatgatgcaataatcccattgcagtgtatatatccaaaagaaagaaaatcagtatatcaaagagttatctgtgcttccatgtttattacagcactagttacaatagacaagatttggaatcaacctgtgttcatcaatggatgaatggataaagaaaatgtggcgtgggctttgccactaggcaggtgggaaatgtgaccaaaccaacggtaattatcagtcaagaaggagacaaagtggtcatcaggactctcagcacattcaagaacacggagattagtttccagctgggagaagagtttgatgaaaccactgcagatgatagaaactgtaagtctgttgttagcctggatggagacaaacttgttcacatacagaaatgggatggcaaagaaacaaattttgtaagagaaattaaggatggcaaaatggttatgacccttacttttggtgatgtggttgctgttcgccactatgagaaggcataa

SEQ ID NO: 9973 - DNA, 875 bp, synthetic construct
  misc_feature 1..875: note = Synthetic polypeptide
  source 1..875: mol_type = other DNA
ttatctgattgaaaattagcaaagatctgaatagacatttctcaaagaagagataagaatggacaacaggcatatgaaaaatactcaacaccactaattattagggaaatacaaaccaaaaccacaatgagatatcacctcatcccagttaaaatggctattatcaaaaagacagtaagaatgttgataaaggggcaatgcttatacactgttgttgggaatgtagatcagccactatggaaaacagtatggagattcctcaaaaaacttaaaatagaactaccatatgatgcaataatcccattgcagtgtatatatccaaaagaaagaaaatcagtatatcaaagagttatctgtgcttccatgtttattacagcactagttacaatagacaagatttggaatcaacctgtgttcatcaatggatgaatggataaagaaaatgtggcgtgggctttgccactaggcaggtgggaaatgtgaccaaaccaacggtaattatcagtcaagaaggagacaaagtggtcatcaggactctcagcacattcaagaacacggagattagtttccagctgggagaagagtttgatgaaaccactgcagatgatagaaactgtaagtctgttgttagcctggatggagacaaacttgttcacatacagaaatgggatggcaaagaaacaaattttgtaagagaaattaaggatggcaaaatggttatggtaagtaatgacaattctccattcttccttgtttttttctcctctccgcacacctctcacctccttccttcttcttccctcctccttccattcttcctccttccttccttctttaataatacatcactggcaaggttctttaactatatgtaa

SEQ ID NO: 9974 - DNA, 1747 bp, synthetic construct
  misc_feature 1..1747: note = Synthetic polypeptide
  source 1..1747: mol_type = other DNA
tcttcctctgagcacactggaagattacagttcccagcttccttgcagttaggtaggatcatgtgattagttctagccaatgacgtggaagtgatgggtattatttcctggtcaagacattaggagctagtgtgccacttgcattctttccctttccctgccacagtgactttgggggccttgtgtttcagatggtggggtctccattgggctgatccaggaaggactgagtggagtagagtccattcccttcccccatcaacatattagacagaaactgaggcttcttgaagagcttgaagacacttggctcccttatctgacccccaaagatgatgaattctatcagcagtggcagctgaaatatcctaaactaattctccgagaagccagcagtgtatctgaggagctccataaagaggttcaagaagcctttctcacactgcacaagcatggctgcttatttcgggacctggttaggatccaaggcaaagatctgctcactccggtatctcgcatcctcattggtaatccaggctgcacctacaagtacctgaacaccaggctctttacggtcccctggccagtgaaagggtctaatataaaacacaccgaggctgaaatagccgctgcttgtgagaccttcctcaagctcaatgactacctgcagatagaaaccatccaggctttggaagaacttgctgccaaagagaaggctaatgaggatgctgtgccattgtgtatgtctgcagatttccccagggttgggatgggttcatcctacaacggacaagatgaagtggacattaagagcagagcagcatacaacgtaactttgctgaatttcatggatcctcagaaaatgccatacctgaaagaggaaccttattttggcatggggaaaatggcagtgagctggcatcatgatgaaaatctggtggacaggtcagcggtggcagtgtacagttatagctgtgaaggccctgaagaggaaagtgaggatgactctcatctcgaaggcagggatcctgatatttggcatgttggttttaagatctcatgggacatagagacacctggtttggcgataccccttcaccaaggagactgctatttcatgcttgatgatctcaatgccacccaccaacactgtgttttggccggttcacaacctcggtttagttccacccaccgagtggcagagtgctcaacaggaaccttggattatattttacaacgctgtcagttggctctgcagaatgtctgtgacgatgtggacaatgatgatgtctctttgaaatcctttgagcctgcagttttgaaacaaggagaagaaattcataatgaggtcgagtttgagtggctgaggcagttttggtttcaaggcaatcgatacagaaagtgcactgactggtggtgtcaacccatggctcaactggaagcactgtggaagaagatggagggtgtgacaaatgctgtgcttcatgaagttaaaagagaggggctccccgtggaacaaaggaatgaaatcttgactgccatccttgcctcgctcactgcacgccagaacctgaggagagaatggcatgccaggtgccagtcacgaattgcccgaacattacctgctgatcagaagccagaatgtcggccatactgggaaaaggatgatgcttcgatgcctctgccgtttgacctcacagacatcgtttcagaactcagaggtcagcttctggaagcaaaaccctag

SEQ ID NO: 9975 - DNA, 442 bp, synthetic construct
  misc_feature 1..442: note = Synthetic polypeptide
  source 1..442: mol_type = other DNA
tcttcctctgagcacactggaagattacagttcccagcttccttgcagttaggtaggatcatgtgattagttctagccaatgacgtggaagtgatgggtattatttcctggtcaagacattaggagctagtgtgccacttgcattctttccctttccctgccacagtgactttgggggccttgtgtttcagatggtggggtctccattgggctgatccaggaaggactgagtggagtagagtccattcccttcccccatcaacatattagacagaaactgaggcttcttgaagagcttgaagacacttggctcccttatctgacccccaaagatgatgaattctatcagcaggccctgaagaggaaagtgaggatgactctcatctcgaaggcagggatcctgatatttggcatgttggttttaagatctcatgggacatag

SEQ ID NO: 9976 - DNA, 251 bp, synthetic construct
  misc_feature 1..251: note = Synthetic polypeptide
  source 1..251: mol_type = other DNA
ggccaggcgcagtgggtcatacctgtaatcccagcactttgggaggctgaggagggtggatcacatgaggaggctggtggtttggcacctgcagccattccaacctcaacggccagtacttccgctccatcccacagcagcggcagaagcttaagaagggaatcttctggaagacctggcggggccgctactacccgctgcaggccaccaccatgttgatccagcccatggcagcagaggcagcctcctag

SEQ ID NO: 9977 - DNA, 5350 bp, synthetic construct; identical to SEQ ID NO: 655
  misc_feature 1..5350: note = Synthetic polypeptide
  source 1..5350: mol_type = other DNA

SEQ ID NO: 9978 - DNA, 302 bp, synthetic construct
  misc_feature 1..302: note = Synthetic polypeptide
  source 1..302: mol_type = other DNA
ggaagattgtgttggctccttttctggaaaactttagaaacttgacagactgtccctacggcaccttcgggatggattgcagagagacctgcaactgccagtcaggcatctgtgacagggggacgggaaaatgcctgaaattccccttcttccaatattcagtaaccaagtcttccaacagatttgtttctctcacggagcatgacatggcatctggagatggcaatattgtgagagaagaagttgtgaaagagaatgctgccgggtctcccgtaatgaggaaatggttaaatccacgctga

SEQ ID NO: 9979 - DNA, 440 bp, synthetic construct
  misc_feature 1..440: note = Synthetic polypeptide
  source 1..440: mol_type = other DNA
gtgcaatcccttgccctgtggctgctggttaggtttggtttaaggggatctctagcagacaatcataggaggaagagaaaaggaagaagtctgggtgcttattcactggcttccttactgcaagttaccctcaggctggctgcattgccttgctgaagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcag

SEQ ID NO: 9980 - DNA, 197 bp, synthetic construct
  misc_feature 1..197: note = Synthetic polypeptide
  source 1..197: mol_type = other DNA
gtgcaatcccttgccctgtggctgctggttaggtttggtttaaggggatctctagcagacaatcataggaggaagagaaaaggaagaagtctgggtgcttattcactggcttccttactgcaagttaccctcaggctggctgcattgccttgctgaagcactgggttctaatcttcacgtcgaagtgaagggttatg

SEQ ID NO: 9981 - DNA, 730 bp, synthetic construct
  misc_feature 1..730: note = Synthetic polypeptide
  source 1..730: mol_type = other DNA
gtgcaatcccttgccctgtggctgctggttaggtttggtttaaggggatctctagcagacaatcataggaggaagagaaaaggaagaagtctgggtgcttattcactggcttccttactgcaagttaccctcaggctggctgcattgccttgctgaagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagaccccttcttcaggagcgcccagccctggatcgcagccctggcagggaccctgcctatcttgctgctgcttctcgccggagccagttacttcttgtggagacaacagaaggaaataactgctctgtccagtgagatagaaagtgagcaagagatgaaagaaatgggatatgctgcaacagagcgggaaataagcctaagagagagcctccaggaggaactcaagaggaaaaaaatccagtacttgactcgtggagaggagtcttcgtccgataccaataagtcagcctga

SEQ ID NO: 9982 - DNA, 2380 bp, synthetic construct
  misc_feature 1..2380: note = Synthetic polypeptide
  source 1..2380: mol_type = other DNA
tttcttggtttcctgaccgggaagcgaggtgattggcagatgattgaggcagccccttaggcgacttaggcctgtcctgtagagcatccctgtgggggactcagaccagcctgggcaacgcagatccaaagagtgctcccaggtaggcaattgccccagtgggatgccttgccagagcagcatggggcaggcccctgctgaggatcaactcagtggctgaacactgagaaggaactgacatttggagtccagacatctgaagtttgggccagcgggtgaggtaccccaggtaccagacaaggaaaccaaagccacaatgggcacagaaaacacacctggaggcaaagccagcccagaccctcaggacgtgcggccaagtgtgttccataacatcaagctgttcgttctgtgccacagcctgctgcagctggcgcagctcatgatctccggctacctaaagagctccatctccacagtggagaagcgcttcggcctctccagccagacgtcggggctgctggcctccttcaacgaggtggggaacacagccttgattgtgtttgtgagctattttggcagccgggtgcaccgaccccgaatgattggctatggggctatccttgtggccctggcgggcctgctcatgactctcccgcacttcatctcggagccataccgctacgacaacaccagccctgaggatatgccacaggacttcaaggcttccctgtgcctgcccacaacctcggccccagcctcggccccctccaatggcaactgctcaagctacacagaaacccagcatctgagtgtggtggggatcatgttcgtggcacagaccctgctgggcgtgggcggggtgcccattcagccctttggcatctcctacatcgatgactttgcccacaacagcaactcgcccctctacctcgggatcctgtttgcagtgaccatgatggggccaggcctggcctttgggctgggcagcctcatgctgcgcctttatgtggacattaaccagatgccagaaggtggtatcagcctgaccataaaggacccccgatgggtgggtgcctggtggctgggtttcctcatcgctgccggtgcagtggccctggctgccatcccctacttcttcttccccaaggaaatgcccaaggaaaaacgtgagcttcagtttcggcgaaaggtcttagcagtcacagactcacctgccaggaagggcaaggactctccctctaagcagagccctggggagtccacgaagaagcaggatggcctagtccagattgcaccaaacctgactgtgatccagttcattaaagtcttccccagggtgctgctgcagaccctacgccaccccatcttcctgctggtggtcctgtcccaggtatgcttgtcatccatggctgcgggcatggccatcttcctgcccaagttcctggagcgccagttttccatcacagcctcctacgccaacctgctcatcggctgcctctccttcccttcggtcatcgtgggcatcgtggtgggtggcgtcctggtcaagcggctccacctgggccctgtgggatgcggtgccctttgcctgctggggatgctgctgtgcctcttcttcagcctgccgctcttctttatcggctgctccagccaccagattgcgggcatcacacaccagaccagtgcccaccctgggctggagctgtctccaagctgcatggaggcctgctcctgcccattggacggctttaaccctgtctgcgaccccagcactcgtgtggaatacatcacaccctgccacgcaggctgctcaagctgggtggtccaggatgctctggacaacagccaggttttctacaccaactgcagctgcgtggtggagggcaaccccgtgctggcaggatcctgcgactcaacgtgcagccatctggtggtgcccttcctgctcctggtcagcctgggctcggccctggcctgtctcacccacacaccctccttcatgctcatcctaagaggagtgaagaaagaagacaagactttggctgtgggcatccagttcatgttcctgaggattttggcctggatgcccagccccgtgatccacggcagcgccatcgacaccacctgtgtgcactgggccctgagctgtgggcgtcgagctgtctgtcgctactacaataatgacctgctccgaaaccggttcatcggcctccagttcttcttcaaaacaggttctgtgatctgcttcgccttagttttggctgtcctgaggcagcaggacaaagaggcaaggaccaaagagagcagatccagccctgccgtagagcagcaattgctagtgtcggggccagggaagaagccagaggattcccgagtgtga

SEQ ID NO: 9983 - DNA, 358 bp, synthetic construct
  misc_feature 1..358: note = Synthetic polypeptide
  source 1..358: mol_type = other DNA
gaataaggaagactgagttttagttctacctgtgtcaggaatgtgtgaaatgtcacttaagatgtacatccagacaacaacacttactgtctccatgagtttaagtgcttcagtatctctgggcatgctctatatgcccaaggtttatattataatttttcatccagaacagaatgttcaaaaacgcaagaggagcttcaaggctgtggtgacagctgccaccatgcaaagcaaactgatccaaaaaggaaatgacagaccaaatggcgaggtgaaaagtgaactctgtgagagtcttgaaaccaacacttcctctaccaagacaacatatatcagttacagcaatcattcaatctga

SEQ ID NO: 9984 - DNA, 358 bp, synthetic construct
  misc_feature 1..358: note = Synthetic polypeptide
  source 1..358: mol_type = other DNA
gaataaggaagactgagttttagttctacctgtgtcaggaatgtgtgaaatgtcacttaagatgtacatccagacaacaacacttactgtctccatgagtttaagtgcttcagtatctctgggcatgctctatatgcccaaggtttatattataatttttcatccagaacagaatgttcaaaaacgcaagaggagcttcaaggctgtggtgacagctgccaccatgcaaagcaaactgatccaaaaaggaaatgacagaccaaatggcgaggtgaaaagtgaactctgtgagagtcttgaaaccaacagtaagtcatctgtagagtttccgatggtcaagagcgggagcacttcctaa

SEQ ID NO: 9985 - DNA, 952 bp, synthetic construct; identical to SEQ ID NO: 8583
  misc_feature 1..952: note = Synthetic polypeptide
  source 1..952: mol_type = other DNA

SEQ ID NO: 9986 - DNA, 87 bp, synthetic construct; identical to SEQ ID NO: 8584
  misc_feature 1..87: note = Synthetic polypeptide
  source 1..87: mol_type = other DNA

SEQ ID NO: 9987 - DNA, 233 bp, synthetic construct
  misc_feature 1..233: note = Synthetic polypeptide
  source 1..233: mol_type = other DNA
attccaccaggaagaataaagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaaga

SEQ ID NO: 9988 - DNA, 585 bp, synthetic construct
  misc_feature 1..585: note = Synthetic polypeptide
  source 1..585: mol_type = other DNA
attccaccaggaagaataaagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaaggctcgatcaagtcatccgccaaagaagcctgtccagtttggaactgttcctctcctgtgcacagaaacagttaagtgctttaatagctacggaaccagttgacattgaataa

SEQ ID NO: 9989 - DNA, 342 bp, synthetic construct
  misc_feature 1..342: note = Synthetic polypeptide
  source 1..342: mol_type = other DNA
attccaccaggaagaataaagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaa

SEQ ID NO: 9990 - DNA, 346 bp, synthetic construct
  misc_feature 1..346: note = Synthetic polypeptide
  source 1..346: mol_type = other DNA
attccaccaggaagaataaagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaa

SEQ ID NO: 9991 - DNA, 504 bp, synthetic construct; identical to SEQ ID NO: 7011
  misc_feature 1..504: note = Synthetic polypeptide
  source 1..504: mol_type = other DNA

SEQ ID NO: 9992 - DNA, 2153 bp, synthetic construct; identical to SEQ ID NO: 7012
  misc_feature 1..2153: note = Synthetic polypeptide
  source 1..2153: mol_type = other DNA

SEQ ID NO: 9993 - DNA, 818 bp, synthetic construct; identical to SEQ ID NO: 7013
  misc_feature 1..818: note = Synthetic polypeptide
  source 1..818: mol_type = other DNA

SEQ ID NO: 9994 - DNA, 176 bp, synthetic construct
  misc_feature 1..176: note = Synthetic polypeptide
  source 1..176: mol_type = other DNA
ggctgggcacagtggctcacgcctgtaataccaacactttgggaggccgaggcgggtggatcacttggtcaagagatcgacaccatcctggataacacgattacgatgaggacctggtgcaggaagcttcatctgaagatgtcctgggcgttcatatgtgttttgtttttctctaa

SEQ ID NO: 9995 - DNA, 100 bp, synthetic construct
  misc_feature 1..100: note = Synthetic polypeptide
  source 1..100: mol_type = other DNA
ggctgggcacagtggctcacgcctgtaataccaacactttgggaggccgaggcgggtggatcacttggtcaagagatcgacaccatcctggataacacga

SEQ ID NO: 9996 - DNA, 426 bp, synthetic construct
  misc_feature 1..426: note = Synthetic polypeptide
  source 1..426: mol_type = other DNA
ggctgggcacagtggctcacgcctgtaataccaacactttgggaggccgaggcgggtggatcacttggtcaagagatcgacaccatcctggataacacgattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaatgtgagcgtgacgaaggctccttgggcaagccattgtgtccacccgagatactctcggagacgttgccaggctctgtgaagaaaagggtatgctttccatcagaagatcatctagaggagtttatagcagaacatctccctg

SEQ ID NO: 9997 - DNA, 1024 bp, synthetic construct; identical to SEQ ID NO: 794
  misc_feature 1..1024: note = Synthetic polypeptide
  source 1..1024: mol_type = other DNA

SEQ ID NO: 9998 - DNA, 607 bp, synthetic construct
  misc_feature 1..607: note = Synthetic polypeptide
  source 1..607: mol_type = other DNA
agaggcaacgtgttacagcaggttccggtgttcctcctgccagcgaagttgggcttccgcccaagtgcagattctgtgccacacgtactgggagcactggacatcccagggtcaggtgcgtatgaggctctttggccaaaggtgccagaagtgctcctggtcccaatatgagatgcctgagttctcctcggatagcaccatgaggattctgagcaacctggtgcagcatatactgaagaaatactatggaaatggcacgaggaagtctccagaaatgccagtaatcctggaagtgtccctggaaggatcccatgacacagccaattgtgaggcatgcactttgggcatctgtggacagggcttaaaaagctgcatgacaaagccgtccaaatccctactcccccacctaaagactgggaattcctcacctggaattggtgctgtgtacctcgcaaaccaagccaagaaccagtcagctgaggcaaaagaggctaaggggagtgggtatgagaaattagggcccagtcgagacccagatccactgaacatctgtgtctttattttgctgcttgtatttattgtagtcaaatgctttacatcagaatga

SEQ ID NO: 9999 - DNA, 452 bp, synthetic construct
  misc_feature 1..452: note = Synthetic polypeptide
  source 1..452: mol_type = other DNA
ggctgggcacagtggctcacgcctgtaataccaacactttgggaggccgaggcgggtggatcacttggtcaagagatcgacaccatcctggataacacgattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaacgtggtgacctggaagacctggaggagcatctgccagggcagacagtctctgaggaagccacaggggttcacatgatgcaggtggacccagccacaccggcaaagaaattggaagactccaccattacaggcagccaccagcagatgtcagcaagtccttcctctgca

SEQ ID NO: 10000 - DNA, 590 bp, synthetic construct
  misc_feature 1..590: note = Synthetic polypeptide
  source 1..590: mol_type = other DNA
ggctgggcacagtggctcacgcctgtaataccaacactttgggaggccgaggcgggtggatcacttggtcaagagatcgacaccatcctggataacacgattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaacgtggtgacctggaagacctggaggagcatctgccagggcagacagtctctgaggaagccacaggggttcacatgatgcaggtggacccagccacaccggcaaagaaattggaagactccaccattacaggcagccaccagcagatgtcagcaagtccttcctctgcacctgcagaagaagcaacagaaaagaccaaagtggaagaggaagtgaaaaccagaaagcccaagaagaaaaccaggaagcccagcaagaaaagccggtggaatgtcctgaaatgttgggacatttttaatatattttag

SEQ ID NO: 10001 - DNA, 1615 bp, synthetic construct
  misc_feature 1..1615: note = Synthetic polypeptide
  source 1..1615: mol_type = other DNA
tcctggttccctgaccaggaagtgagttgactgagggagggccgaggcagccccttaggctacttaagcctgccctgtggggcatccctgcgggggactctgaccagcctgagtgacgccttccaaagagcgctcccgggtgggaaattgtcctggtggaacgcctcaccagagcaacaggtagcaggcccccgcggaggattaacacagtggctgaacaccgggaaggaactggcacttggagtccggacatctgaaacttggaggctgggatgcagatggaaaaggcccttgtgtctgggacacatttactcatcagggaggagagagagttttcaagaaccagactggcgatgtagcttgtggcagctacactctgtgggaggaagatttgaaatgtatcaaacagcttggattgactcattaccgcttctctctttcctggtcacgtctgttacctgatgggacgacaggtttcatcaaccagaaaggaattgattattacaacaagatcatcgatgatttgttaaaaaatggggttactcccattgtgaccctctaccactttgatttgcctcagactttagaagaccaaggaggttggttgtcagaggcaatcattgaatcctttgacaaatatgctcagttttgcttcagtacctttggggatcgtgtcaagcagtggatcaccataaatgaagctaatgttctttctgtgatgtcatatgacttaggtatgtttcctccgggtatccctcactttgggactggaggttatcaggcagctcataatttgattaaggctcatgccagatcctggcacagctatgattccttatttcgaaaaaagcagaaaggtatggtgtctctatcactttttgcggtctggttggaaccagcagatcccaactcagtgtctgaccaggaagctgctaaaagagccatcactttccatctggatttatttgctaaacccatattcatcgatggtgattatcctgaagttgtcaagtctcagattgcctccatgagtcaaaagcaaggctatccatcatcgaggcttccagaattcactgaagaagagaagaaaatgatcaaaggcactgctgatttttttgctgtgcaatattatacaactcgcttaatcaagtaccaggagaacaagaaaggagaactaggtattctccaggatgcggaaattgaattttttccagatccatcttggaaaaatgtggattggatctacgtggtaccatggggagtatgtaaactactgaaatatattaaggatacatataataaccctgtaatttacatcactgagaatgggtttccccagagtgacccagcgcctcttgatgacactcaacgctgggagtatttcagacaaacatttcaggaactgttcaaagctatccaacttgataaagtcaatcttcaagtatattgtgcatggtctcttctggataactttgagtggaaccagggatacagcagccggtttggtctcttccacgttgattttgaagacccagctagaccccgagtcccttacacatcggccaaggaataagccaagatcatccgaaacaatggccttgaagcacatctgtag

SEQ ID NO: 10002 - DNA, 694 bp, synthetic construct
  misc_feature 1..694: note = Synthetic polypeptide
  source 1..694: mol_type = other DNA
tcctggttccctgaccaggaagtgagttgactgagggagggccgaggcagccccttaggctacttaagcctgccctgtggggcatccctgcgggggactctgaccagcctgagtgacgccttccaaagagcgctcccgggtgggaaattgtcctggtggaacgcctcaccagagcaacaggtagcaggcccccgcggaggattaacacagtggctgaacaccgggaaggaactggcacttggagtccggacatctgaaacttggaggctgggatgcagatggaaaaggcccttgtgtctgggacacatttactcatcagggaggagagagagttttcaagaaccagactggcgatgtagcttgtggcagctacactctgtgggaggaagatttgaaatgtatcaaacagcttggattgactcattaccgcttctctctttcctggtcacgtctgttacctgatgggacgacaggtttcatcaaccagaaagctatccaacttgataaagtcaatcttcaagtatattgtgcatggtctcttctggataactttgagtggaaccagggatacagcagccggtttggtctcttccacgttgattttgaagacccagctagaccccgagtcccttacacatcggccaaggaataagccaagatcatccgaaacaatggccttgaagcacatctgtag

SEQ ID NO: 10003 - DNA, 443 bp, synthetic construct
  misc_feature 1..443: note = Synthetic polypeptide
  source 1..443: mol_type = other DNA
tgcctggattggagtcctgacctggctactcccagctgtgtgaactgggccagcaacttagctccgttgtgcctcagtttctccatctctaaatgaagcgcttattcctctctcatggagccgtcgtgagaattacgtgaatgaatacaggctgactactttgaacagtgcctgatgacgtccggttgtttgccttcgtgcgcttcaccaccggggatgccatgagcaagaggtccaagtttgccctcatcacgtggatcggtgagaacgtcagcgggctgcagcgcgccaaaaccgggacggacaagaccctggtgaaggaggtcgtacagaatttcgctaaggagtttgtgatcagtgatcggaaggagctggaggaagatttcatcaagagcgagctgaagaaggcggggggagccaattacgacgcccagacggagtaa

SEQ ID NO: 10004 - DNA, 713 bp, synthetic construct
  misc_feature 1..713: note = Synthetic polypeptide
  source 1..713: mol_type = other DNA
ggctgggcgtggtggctcatgcctataatcccagcactttaggagggcaaggtggttggatcacctgaggtcaggagttcgagaccagtctggccaacaaggtgaaatcctgtctctactaaaaatacaaaaattagctgggcatggtggcgtatgcctgtaatcccagctactcgattgaatttgccaggaagaatgtgtatagtgccaatcagaaaattcaggatgctcaggataagctctacctctcatgggtagagtggaaaaggagcattggatatgatgatactgatgagtcccactgtgctgagcacattgagtcacgtactcttgcaattgcccgcaacctgactcagcagctccagaccacgtgccacaccctcctgtccaacatccaaggtgtaccacagaacatccaagatcaagccaagcacatgggggtgatggcaggcgacatctactcagtgttccgcaatgctgcctcctttaaagaagtgtctgacagcctcctcacttctagcaaggggcagctgcagaaaatgaaggaatctttagatgacgtgatggattatcttgttaacaacacgcccctcaactggctggtaggtcccttttatcctcagctgactgagtctcagaatgctcaggaccaaggtgcagagatggacaagagcagccaggagacccagcgatctgagcataaaactcattaa

SEQ ID NO: 10005 - DNA, 560 bp, synthetic construct
  misc_feature 1..560: note = Synthetic polypeptide
  source 1..560: mol_type = other DNA
gtgtcacctgtcactccctggacggcaagtgccagctgaaggtgagaagcaacacctgttactgctgtgacctctatgcctgcgggagcgcagagccctcgcccgcctactatgagttcatcggcgtcagcggctgccaggacgtgctgcacctgtaccgcctgctctgggcctctgcagttctgaacgtcctgggcctgttcctgggcatcatcaccgccgccgtcctgggggccttcaaggacatggtgcctctgtcccagctggcctatggcccagccgtcccaccacagaccctctacaaccccgcccagcagatcctggcctacgcaggcttccgcctgacgcccgagcccgtcccgacctgctcgtcctaccctctgccccttcagccctgcagccgcttcccagttgcgccctcctctgccctggcttcgtctgaggacctgcagcccccttctccaagcagctctggctctgggcttcccggccaggctccaccgtgctacgcacccacctactttcccccgggggagaagccacccccctacgcaccctga

SEQ ID NO: 10006 - DNA, 2436 bp, synthetic construct
  misc_feature 1..2436: note = Synthetic polypeptide
  source 1..2436: mol_type = other DNA
acattcattttactagaagatcacagaagttaaagacttaaaaaaaactttggcaattaagacagcataccaagatgcaaatgcctggttgaaatagatcaaatattccatctgcacgttaaacaaaagcaattgttatgcttgtgcacatggcaggccagaggccctaattgtcccctttccactacagtggtcctccagttgaccaggcgtaggctgcatggtaactcttttccaggattctacagcctggagtaataagtcatgccaagctctctctgctatatcctgaagtccctgtgggtcagcctccgagggccatccagcttccatctcccaacactaagttcacttcgtgtctctcacagcagggaggagacagcattccttagagacctgaaaggatgcagtgagcttaagaattttcgaaaggttatcaatcagtcagccgttgttcatccccgagcagatgtgtggtggtattgtggtggacctttactaggtactctgctgaataagtagagtggcacttgtgctttagtccatttggctatccctttcatcctggcatttcatcaaccagaggaagaaaagaaaataataagatatcataaagcgagagaagccccttataggtcttccaactctcatatctatttagatgcaattagagccccgcaaggaataccagatcaatttaaagcttgaaatcaaatagctacaggatttaagtcaatattttggtagatgacagtgaataaaaatgtagattagataaactacatctattacaaccaacagcaaagagcttttcatgagttaaaaaaaaaaaaactcatgtcggccccagccctgaggttacctgacctgactctgtgaagtctgtgtgtcagaaaagaaaaaaatggcagttggagttttaactcagactgtggggcactggccaaggccagtggcctatctctcaaaacaaaaagacagggtttccaaaggctggcccccatgtccaagggccctggcagcaatggccctgttaccacaagaagcagataagctaactcttagacaaaacctaaacataaagtctccccatgctgtggtgattttaataaatactaaaggacaccattagctaataaatgttacactaagtagataccaaagcttgctctgtgaaaatccccacataaccattgaagtttgcaacaccctaaccctgccaccttactcctggtatcagagagcctagttaaacataactgtttagaggtgctggactcagtttattctagtaggcccaacctccgagacaatccttaaccatcagtagactaggagttgtatgtagataggagcagcgtcaccaacccctgcaaagtgactctgaagaagactacaagccctgctccagtcacacccagaagctgactggtccacgcacggctgaagcatgaggaaactcatcgcaggactcattttccttaaaatttggacttgtacattaaggacttcagctgaacttcctcagactgagggctgttcccagtatatacatcaagtcactgaggaagacccactacattatctgagacaatggggaaagctgacgtatggcttattcgaaactcctggaattttcagtttccatatccactcttaccaaatgttgattttgttggaggactccactgcaaacctgccaaacccctgcctaaggaaatggaagactttgtacagagctctggagaaaatggtgttgtggtgttttctctggggtcaatggtcagtaacatgacagaagaaagggccaacgtaattgcatcagccctggcccagatcccacaaaaggttctgtggagatttgatgggaataaaccagataccttaggtctcaatactcggctctacaagtggataccccagaatgaccttctaggtcatccaaagaccagagcttttataactcatggtggagccaatggcatctacgaggcaatctaccatgggatccctatggtggggattccattgtttgccgatcaacctgataacattgctcacatgaaggccaggggagcagctgttagagtggacttcaacacaatgtcgagtacagacttgctgaatgcattgaagagagtaattaatgatccttcatataaagagaatgttatgaaattatcaagaattcaacatgatcaaccagtgaagcccctggatcgagcagtcttctggattgaatttgtcatgcgccacaaaggagctaaacaccttcgggttgcagcccacgacctcacctggttccagtaccactctttggatgtgattgggttcctgctggtctgtgtggcaactgtgatatttatcgtcacaaaatgttgtctgttttgtttctggaagtttgctagaaaagcaaagaagggaaaaaatgattag

SEQ ID NO: 10007 - DNA, 1956 bp, synthetic construct
  misc_feature 1..1956: note = Synthetic polypeptide
  source 1..1956: mol_type = other DNA
acattcattttactagaagatcacagaagttaaagacttaaaaaaaactttggcaattaagacagcataccaagatgcaaatgcctggttgaaatagatcaaatattccatctgcacgttaaacaaaagcaattgttatgcttgtgcacatggcaggccagaggccctaattgtcccctttccactacagtggtcctccagttgaccaggcgtaggctgcatggtaactcttttccaggattctacagcctggagtaataagtcatgccaagctctctctgctatatcctgaagtccctgtgggtcagcctccgagggccatccagcttccatctcccaacactaagttcacttcgtgtctctcacagcagggaggagacagcattccttagagacctgaaaggatgcagtgagcttaagaattttcgaaaggttatcaatcagtcagccgttgttcatccccgagcagatgtgtggtggtattgtggtggacctttactaggtactctgctgaataagtagagtggcacttgtgctttagtccatttggctatccctttcatcctggcatttcatcaaccagaggaagaaaagaaaataataagatatcataaagcgagagaagccccttataggtcttccaactctcatatctatttagatgcaattagagccccgcaaggaataccagatcaatttaaagcttgaaatcaaatagctacaggatttaagtcaatattttggtagatgacagtgaataaaaatgtagattagataaactacatctattacaaccaacagcaaagagcttttcatgagttaaaaaaaaaaaaactcatgtcggccccagccctgaggttacctgacctgactctgtgaagtctgtgtgtcagaaaagaaaaaaatggcagttggagttttaactcagactgtggggcactggccaaggccagtggcctatctctcaaaacaaaaagacagggtttccaaaggctggcccccatgtccaagggccctggcagcaatggccctgttaccacaagaagcagataagctaactcttagacaaaacctaaacataaagtctccccatgctgtggtgattttaataaatactaaaggacaccattagctaataaatgttacactaagtagataccaaagcttgctctgtgaaaatccccacataaccattgaagtttgcaacaccctaaccctgccaccttactcctggtatcagagagcctagttaaacataactgtttagaggtgctggactcagtttattctagtaggcccaacctccgagacaatccttaaccatcagtagactaggagttgtatgtagataggagcagcgtcaccaacccctgcaaagtgactctgaagaagactacaagccctgctccagtcacacccagaagctgactggtccacgcacggctgaagcatgaggaaactcatcgcaggactcattttccttaaaatttggacttgtacattaaggacttcagctgaacttcctcagactgagggctgttcccagtatatacatcaagtcactgaggaagacccactacattatctgagacaatggggaaagctgacgtatggcttattcgaaactcctggaattttcagtttccatatccactcttaccaaatgttgattttgttggaggactccactgcaaacctgccaaacccctgcctaaggaaatggaagactttgtacagagctctggagaaaatggtgttgtggtgttttctctggggtcaatggtcagtaacatgacagaagaaagggccaacgtaattgcatcagccctggcccagatcccacaaaaggttctgtggagatttgatgggaataaaccagataccttaggtctcaatactcggctctacaagtggataccccagaatgaccttctagatataaagagaatgttatga

SEQ ID NO: 10008 - DNA, 2356 bp, synthetic construct
  misc_feature 1..2356: note = Synthetic polypeptide
  source 1..2356: mol_type = other DNA
caggttgagcaccctgaatccgaaaatccaaaaccgaaaactttttgaatgctgagttgacactctgcaggtgatgggctgcagtcaaaacacagttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgagtgcactggtgattgctgcggtgtttgaccgagacataaactgcagaagagcagcctctgccgccttccaggagaatgtggggagacagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccgaggacgtaagttttgctgagtccaggagagacggcttgaaggccattgcgaggatttgccagactgttggtgtgaaagcaggagccccagacgaagctgtgtgcggagagaatgtttcccagatttactgtgcgctgctgggctgcatggacgactacaccacggacagcagaggggacgtgggcacctgggtccgcaaggccgccatgaccagtctgatggatctgacacttctgctggctcggagccagcctgagctgatcgaggcccatacctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacgatccggcactccacccagagcctctttgagtacatgaagggcattcagagcgacccgcaggccctgggcagcttcagcgggacccttctgcagatctttgaggacaaccttctgaatgagagggtgtccgtgccgctgctgaagacgctggaccacgtgctcacccacggctgcttcgacatcttcaccacggaggaggaccacccctttgctgtgaagttgcttgcgctctgtaagaaagaaatcaagaattcaaaagatatccagaagctcctgtcaggcatcgcagtgttctgcgagatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctga

SEQ ID NO: 10009 - DNA, 871 bp, synthetic construct
  misc_feature 1..871: note = Synthetic polypeptide
  source 1..871: mol_type = other DNA
caggttgagcaccctgaatccgaaaatccaaaaccgaaaactttttgaatgctgagttgacactctgcaggtgatgggctgcagtcaaaacacagttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgagtgcactggtgattgctgcggtgtttgaccgagacataaactgcagaagagcagcctctgccgccttccaggagaatgtggggagacagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagccgtgcatctgcagctggggtctgatgtctcctgaaagtaaagcagaattttgtgtgtgcgtctgtcggatttctctggggagacagtgtgttcatctttctgggctttga

SEQ ID NO: 10010 - DNA, 2470 bp, synthetic construct
  misc_feature 1..2470: note = Synthetic polypeptide
  source 1..2470: mol_type = other DNA
caggttgagcaccctgaatccgaaaatccaaaaccgaaaactttttgaatgctgagttgacactctgcaggtgatgggctgcagtcaaaacacagttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgagtgcactggtgattgctgcggtgtttgaccgagacataaactgcagaagagcagcctctgccgccttccaggagaatgtggggagacagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccgaggacgtaagttttgctgagtccaggagagacggcttgaaggccattgcgaggatttgccagactgttggtgtgaaagcaggagccccagacgaagctgtgtgcggagagaatgtttcccagatttactgtgcgctgctgggctgcatggacgactacaccacggacagcagaggggacgtgggcacctgggtccgcaaggccgccatgaccagtctgatggatctgacacttctgctggctcggagccagcctgagctgatcgaggcccatacctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacgatccggcactccacccagagcctctttgagtacatgaagggcattcagagcgacccgcaggccctgggcagcttcagcgggacccttctgcagatctttgaggacaaccttctgaatgagagggtgtccgtgccgctgctgaagacgctggaccacgtgctcacccacggctgcttcgacatcttcaccacggaggaggaccacccctttgctgtgaagttgcttgcgctctgtaagaaagaaatcaagaattcaaaagatatccagaagctcctgtcaggcatcgcagttgactttccaagtgcgacactcgtgtgtgtaggcacagtgcagatgtacgcacacacacacctccggcttggggccccaggcccgcactgtgctcacggatctgctctgcccaggttctgcgagatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctga

SEQ ID NO: 10011 - DNA, 1088 bp, synthetic construct
  misc_feature 1..1088: note = Synthetic polypeptide
  source 1..1088: mol_type = other DNA
ggctgggcacagtggctcacgcctgtaataccaacacttttggaggccgaggcaggtggatcacttggtcaagagatcgacaccatcctggataacacgattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaatgtgagcgtgacgaaggctccttgggcaagccattgtgtccacccgagatactctcggagacgttgccaggctctgtgaagaaaagggtatgctttccatcagaagatcatctagaggagtttatagcagaacatctccctgaagcatccaatcagagtctcctcactgttgcccatgcagacacaggcatccaaaccaacggtgacctggaagacctggaggagcatgggccagggcagacagtctctgaggaagccacagaagttcacatgatggagggggacccagacacactggccgaacttctgatcagggatgtacttcaggagctgtccagttacaacggcgaggaggaggacccagaggaggtgaagacatccttgggagttccacaacgtggtgacctggaagacctggaggagcatgtgccagggcagacagtctctgaggaagccacaggggttcacatgatgcaggtggacccagccacgccggcaaagagtgacctggaagacctggaggagcatgtgccagggcagacagtctctgaggaagccacaggggttcacatgatgcaggtggacccagccacactggcaaagcaattggaagactccaccattacaggcagccaccagcagatgtcagcaagtccttcctctgcacctgcagaagaagcaacagaaaagaccaaagtggaagaggaagtgaaaaccagaaagcccaagaagaaaaccaggaagcccagcaagaaaagccggtggaatgtcctgaaatgttgggacatttttaatatattttag

SEQ ID NO: 10012 - DNA, 696 bp, synthetic construct; identical to SEQ ID NO: 6897
  misc_feature 1..696: note = Synthetic polypeptide
  source 1..696: mol_type = other DNA

SEQ ID NO: 10013 - DNA, 801 bp, synthetic construct; identical to SEQ ID NO: 6898
  misc_feature 1..801: note = Synthetic polypeptide
  source 1..801: mol_type = other DNA

SEQ ID NO: 10014 - DNA, 1206 bp, synthetic construct; identical to SEQ ID NO: 7670
  misc_feature 1..1206: note = Synthetic polypeptide
  source 1..1206: mol_type = other DNA

SEQ ID NO: 10015 - DNA, 1134 bp, synthetic construct; identical to SEQ ID NO: 7671
  misc_feature 1..1134: note = Synthetic polypeptide
  source 1..1134: mol_type = other DNA

SEQ ID NO: 10016 - DNA, 1002 bp, synthetic construct; identical to SEQ ID NO: 7672
  misc_feature 1..1002: note = Synthetic polypeptide
  source 1..1002: mol_type = other DNA

SEQ ID NO: 10017 - DNA, 634 bp, synthetic construct; identical to SEQ ID NO: 7103
  misc_feature 1..634: note = Synthetic polypeptide
  source 1..634: mol_type = other DNA

SEQ ID NO: 10018 - DNA, 535 bp, synthetic construct
  misc_feature 1..535: note = Synthetic polypeptide
  source 1..535: mol_type = other DNA
gtgcagccaatttggaaaatttgccagcatttccccaagaagtatacataaagttaccattggacccaacacttccactcccaggacaggagaatacatccagcctgtgtgcctcccagctgccggccaggccctggtggatggcaagatctgtaccgtgacgggctggggcaacacgcagtactatggccaacaggccggggtactccaggaggctcgagtccccataatcagcaatgatgtctgcaatggcgctgacttctatggaaaccagatcaagcccaagatgttctgtgctggctaccccgagggtggcattgatgcctgccagggcgacagcggtggtccctttgtgtgtgaggacagcatctctcggacgccacgttggcggctgtgtggcattgtgagttggggcactggctgtgccctggcccagaagccaggcgtctacaccaaagtcagtgacttccgggagtggatcttccaggccataaagactcactccgaagccagcggcatggtgacccagctctga

SEQ ID NO: 10019 - DNA, 925 bp, synthetic construct
  misc_feature 1..925: note = Synthetic polypeptide
  source 1..925: mol_type = other DNA
gcaatggctcacacatataatctcagaccttttggaagaccaaggcaggaggattgcttgaggccaagagttcgagaccaagcctgggcaacatatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctga

SEQ ID NO: 10020 - DNA, 252 bp, synthetic construct
  misc_feature 1..252: note = Synthetic polypeptide
  source 1..252: mol_type = other DNA
gcaatggctcacacatataatctcagaccttttggaagaccaaggcaggaggattgcttgaggccaagagttcgagaccaagcctgggcaacatatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgc

SEQ ID NO: 10021 - DNA, 184 bp, synthetic construct
  misc_feature 1..184: note = Synthetic polypeptide
  source 1..184: mol_type = other DNA
gcaatggctcacacatataatctcagaccttttggaagaccaaggcaggaggattgcttgaggccaagagttcgagaccaagcctgggcaacatatggaaatcctgactgctcgtcagaagaaagcagaagaactaaagagactcactgaccttgccagtcagatggcagagatgcagctggcc

SEQ ID NO: 10022 - DNA, 480 bp, synthetic construct
  misc_feature 1..480: note = Synthetic polypeptide
  source 1..480: mol_type = other DNA
gtggttctctgtggtccctggataagaggcatcaccattatctggaaacatgcagtaaatgcagattcttcatcttctccccagacctcctgagttagaaattcacaagttctccaggcaatggtggcttgctatccgggaaatggaacaggttatgttcgccacgtggacaaccccaacggtgatggtcgctgcatcacctgcatctactatctgaacaagaattgggatgccaagctacatggtgggatcctgcggatatttccagaggggaaatcattcatagcagatgtggagcccatttttgacagactcctgttcttctggtcagatcgtaggaacccacacgaagtgcagccctcttacgcaaccagatatgctatgactgtctggtactttgatgctgaagaaagggcagaagccaaaaagaaattcaggaatttaactaggaaaactgaatctgccctcactgaagactga

SEQ ID NO: 10023 - DNA, 351 bp, synthetic construct
  misc_feature 1..351: note = Synthetic polypeptide
  source 1..351: mol_type = other DNA
gtggttctctgtggtccctggataagaggcatcaccattatctggaaacatgcagtaaatgcagattcttcatcttctccccagacctcctgagttagaaattcacaagttctccaggcaatggtggcttgctatccgggaaatggaacaggttatgttcgccacgtggacaaccccaacggtgatggtcgctgcatcacctgcatctactatctgaacaagaattgggatgccaagctacatggtgggatcctgcggatatttccagaggggaaatcattcatagcagatgtggagcccatttttgacagactcctgttcttctggtcagatcgtaggaacccacacgaa

SEQ ID NO: 10024 - DNA, 2245 bp, synthetic construct
  misc_feature 1..2245: note = Synthetic polypeptide
  source 1..2245: mol_type = other DNA
acattcattttactagaggatcatagaagttaaagacttaaaacaaactttggcagttaagacagcataccaagatgcaaatgcctggttggaatggattaaatattccatctgcacgttaaacaaaatcaattgttatgcttgtgcacatggcaggccagaggccctgattgtccctcttccactaaggtggtcctccagtcgaccaggtgtgggctgcatggtagctcttttccaggattctacagcctggagtaataagtcatgccaagctctctctgctatatcccgaagtctctgtgggtcagcccccgagggccatccagcttccatctcccaacactaagttcacttcttgtctctcacggcagggaggagatttagcattccttggagacctgaagggatgcagtgagcttaagagtttccaagagcttatcaatcagtcagcccttgttcatccccgagaggatgtgtggtggtatcggggtggacctttactgggcactctgctgaataactagagtggcacttgtgctttagtccatttggctatccctttcaccctggcatttcatcaaccagaggaaaaaaaaagtaagacatcataaaacgagagaagccccttataggtctttcaattctcacatctacttaaatgcaattggagccccacaaggaataccagatcaatttaaagcttgaaatcaaatagttacaggatttaagtcaatattttagtagatgacagtcaacaaaaatgtagattagataaactacatctattacaaccaacagcaaagagcttttcattagttaaaaagaaaaactcatgtcggccccagccctgaggctacctgacctgacaaaactctttacactctgtgtgtcagaaagagaaaaaatgacagttggagttttaacccagactgtagggccctggtcaaggccaggggcctatctctcaaaacaactagacggggtttccaaaggctggcccccatgtccaagggccctggcagcaactgccctgttagcacaagaagcagatgagctaactcttaggcaaaacctaaacagaaagtctccccatgctgtggtgactttaataaataccaaaggacatcattagctaataaatgctagactaactagataccaaaccttgctctgtgaaaatccccacaaaaccattgaagtttccaacaccctaacccagccaccttactcctggtaacagagagcccagttaaacataactgtttagaggtgctggactcagtttattctagtaggcctaacctccgagaccacccttaaacatcagtagactgggagctgtacgtggatgggagcggctttgccaacccctgcaaagtgactctgaagaaggagacaagccctgctccagtcacacccagaagctgactggtccacgcacaggcgaagcatgaggaaactcattgcgggactcattttccttaaaatttggacttgtacagtaaggacttcaactgaccttcctcagattgagaactgtttccagtatatacatcaagtcactgagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctccgtcaccactctgggctctcccatgcattcaaactga

SEQ ID NO: 10025 - DNA, 853 bp, synthetic construct; identical to SEQ ID NO: 9052
  misc_feature 1..853: note = Synthetic polypeptide
  source 1..853: mol_type = other DNA

SEQ ID NO: 10026 - DNA, 265 bp, synthetic construct; identical to SEQ ID NO: 9053
  misc_feature 1..265: note = Synthetic polypeptide
  source 1..265: mol_type = other DNA

SEQ ID NO: 10027 - DNA, 1327 bp, synthetic construct
  misc_feature 1..1327: note = Synthetic polypeptide
  source 1..1327: mol_type = other DNA
ggggaacagaccctctgacctactgctgtttgtgaagaaatatgggaacctttttagcttggagcttggtgacatatctgcagttcttattactggcttgcccttaatcaaagaagcccttatccacatggaccaaaactttgggaaccgccccgtgacccctatgcgagaacatatctttaagaaaaatggattgattatgtcaagtggccaggcatggaaggagcaaagaaggttcactctgacagcactaaggaactttggtttaggaaagaagagcttagaggaacgcattcaggaggaggcccaacacctcactgaagcaataaaagaggagaacggacagccttttgaccctcatttcaagatcaacaatgcagtttccaatatcatttgctccatcaccttcggagaacgctttgagtaccaggatagttggtttcagcagctgctgaagttactagatgaagtcacatacttggaggcttcaaagacatgccagctctacaatgtctttccatggataatgaaattcctgcctggaccccaccaaactctcttcagcaactggaaaaaactgaaattgtttgtttctcatatgattgacaaacacagaaaggattggaatcctgcagaaacaagagactttattgatgcttaccttaaagaaatgtcaaagcacacaggcaatcctacttcaagtttccatgaagaaaacctcatctgcagcaccctggacctcttctttgccggaaccgagacaacttccacaactctgcgatgggctctgctttatatggccctctacccagaaatccaagaaaaagtacaagctgagattgacagagtgattggccaggggcagcagccgagcacagccgcccgggagtccatgccctacaccaatgctgtcatccatgaggtgcagagaatgggcaacatcatccccctgaacgttcccagggaagtgacagttgataccactttggctgggtaccacctgcccaagggtaccatgatcctgaccaatttgacggcgctgcacagggaccccacagagtgggccacccctgacacattcaatccggaccattttctggagaatggacagtttaagaaaagggaagcctttatgcctttctcaataggaaagcgggcatgcctcggagaacagttggccaggactgagctgtttattttcttcacttcccttatgcaaaaatttaccttcaggcccccaaacaatgagaagctgagcctgaagtttagaatgggtatcaccatttccccagtcagtcaccgcctctgcgctgttcctcaggtgtaa

SEQ ID NO: 10028 - DNA, 705 bp, synthetic construct
  misc_feature 1..705: note = Synthetic polypeptide
  source 1..705: mol_type = other DNA
catttatagaagtattgttttctcctcagaggaggagactcgctatatgttgtgcagcacacaggcaatcctacttcaagtttccatgaagaaaacctcatctgcagcaccctggacctcttctttgccggaaccgagacaacttccacaactctgcgatgggctctgctttatatggccctctacccagaaatccaagaaaaagtacaagctgagattgacagagtgattggccaggggcagcagccgagcacagccgcccgggagtccatgccctacaccaatgctgtcatccatgaggtgcagagaatgggcaacatcatccccctgaacgttcccagggaagtgacagttgataccactttggctgggtaccacctgcccaagggtaccatgatcctgaccaatttgacggcgctgcacagggaccccacagagtgggccacccctgacacattcaatccggaccattttctggagaatggacagtttaagaaaagggaagcctttatgcctttctcaataggaaagcgggcatgcctcggagaacagttggccaggactgagctgtttattttcttcacttcccttatgcaaaaatttaccttcaggcccccaaacaatgagaagctgagcctgaagtttagaatgggtatcaccatttccccagtcagtcaccgcctctgcgctgttcctcaggtgtaa

SEQ ID NO: 10029 - DNA, 1084 bp, synthetic construct
  misc_feature 1..1084: note = Synthetic polypeptide
  source 1..1084: mol_type = other DNA
acttctcaaaagaagatatttatgcagccaaaaaacacatgaaaaaatgctcatcatcactggccatcagagaaatgcaaatcaaaaccacagtgagataccatctcacaccagttagaatggcgatcatcaaaaagtcaggaaacaacaggtgctggagaggatgtggagaaataggaacacttttacactgttggtgagactgtaaactagttcaaccattgtggaagtcagtgtggcgattcctcagggatctagaactagaaataccatttgacccagccatcctattactgggtatatacccaaaggattataaatcatgctgctataaagacacatgcacacatatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacctggatgaagctggaaaccatcattctcagcaaactattgcaaggacaaaaaaccaaacagcacatgttctcactcatagggccaaggagattaagatcaagttgggaattctcctccagaagccagactcagttggtgaccttgtcattccgtacaatgagaagccagagaaaccagccaagacccagaaaacctcgctggacgaggccctgcagtggcgtgattccctggacaaactcctgcagaacaactatggacttgccagtttcaaaagtttcctgaagtctgaattcagtgaggaaaaccttgagttctggattgcctgtgaggattacaagaagatcaagtcccctgccaagatggctgagaaggcaaagcaaatttatgaagaattcattcaaacggaggctcctaaagaggtgaatattgaccacttcactaaggacatcacaatgaagaacctggtggaaccttccctgagcagctttgacatggcccagaaaagaatccatgccctgatggaaaaggattctctgcctcgctttgtgcgctctgagttttatcaggagttaatcaagtag

SEQ ID NO: 10030 - DNA, 1096 bp, synthetic construct
  misc_feature 1..1096: note = Synthetic polypeptide
  source 1..1096: mol_type = other DNA
acttctcaaaagaagatatttatgcagccaaaaaacacatgaaaaaatgctcatcatcactggccatcagagaaatgcaaatcaaaaccacagtgagataccatctcacaccagttagaatggcgatcatcaaaaagtcaggaaacaacaggtgctggagaggatgtggagaaataggaacacttttacactgttggtgagactgtaaactagttcaaccattgtggaagtcagtgtggcgattcctcagggatctagaactagaaataccatttgacccagccatcctattactgggtatatacccaaaggattataaatcatgctgctataaagacacatgcacacatatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacctggatgaagctggaaaccatcattctcagcaaactattgcaaggacaaaaaaccaaacagcacatgttctcactcatagggccaaggagattaagatcaagttgggaattctcctccagaagccagactcagttggtgaccttgtcattccgtacaatgagaagccagagaaaccagccaagacccagaaaacctcgctggacgaggccctgcagtggcgtgattccctggacaaactcctgcagaacaactatggacttgccagtttcaaaagtttcctgaagtctgaattcagtgaggaaaaccttgagttctggattgcctgtgaggattacaagaagatcaagtcccctgccaagatggctgagaaggcaaagcaaatttatgaagaattcattcaaacggaggctcctaaagaggttggtctctgggtgaatattgaccacttcactaaggacatcacaatgaagaacctggtggaaccttccctgagcagctttgacatggcccagaaaagaatccatgccctgatggaaaaggattctctgcctcgctttgtgcgctctgagttttatcaggagttaatcaagtag

SEQ ID NO: 10031 - DNA, 618 bp, synthetic construct
  misc_feature 1..618: note = Synthetic polypeptide
  source 1..618: mol_type = other DNA
accactacacacctattagatctaggccagaatctggaagactgacaacaccaaatgctgatgaggctgtggggaaagaggaactcttatttattgttcgtgggaattaaaaatggtgtagccattttggaagacaattcgactattccttgcaaaactattcaatctagcagttgcactccttgagtcaagggtccagagaaggaggagaagttgagacaggcggtcaagcaggtgctgaagtgtgatgtgactcagagccagccactgggggccgtccccttacccccggctgactgcgtgctcagcacactgtgtctggatgccgcctgcccagacctccccacctactgcagggcgctcaggaacctcggcagcctactgaagccagggggcttcctggtgatcatggatgcgctcaagagcagctactacatgattggtgagcagaagttctccagcctccccctgggccgggaggcagtagaggctgctgtgaaagaggctggctacacaatcgaatggtttgaggtgatctcgcaaagttattcttccaccatggccaacaacgaaggacttttctccctggtggcgaggaagctgagcagacccctgtga

SEQ ID NO: 10032 - DNA, 1211 bp, synthetic construct
  misc_feature 1..1211: note = Synthetic polypeptide
  source 1..1211: mol_type = other DNA
ggctgggcatggtggctcatgcctgtaatcccagcactttgggatgctcagattctgtagctggttctgtaaaggttggtggagaggcaggtccatctgtcacactaccctgccactacagtggagctgtcacatccatgtgctggaatagaggctcatgttctctattcacatgccaaaatggcattgtctggaccaatggaacccacgtcacctatcggaaggacacacgctataagctattgggggacctttcaagaagggatgtctctttgaccatagaaaatacagctgtgtctgacagtggcgtatattgttgccgtgttgagcaccgtgggtggttcaatgacatgaaaatcaccgtatcattggagattgtgccacccaaggtcacgactactccaattgtcacaactgttccaaccgtcacgactgttcgaacgagcaccactgttccaacgacaacgactgttccaatgacgactgttccaacgacaactgttccaacaacaatgagcattccaacgacaacgactgttctgacgacaatgactgtttcaacgacaacgagcgttccaacgacaacgagcattccaacaacaacaagtgttccagtgacaacaactgtctctacctttgttcctccaatgcctttgcccaggcagaaccatgaaccagtagccacttcaccatcttcacctcagccagcagaaacccaccctacgacactgcagggagcaataaggagagaacccaccagctcaccattgtactcttacacaacagatgggaatgacaccgtgacagagtcttcagatggcctttggaataacaatcaaactcaactgttcctagaacatagtctactgacggccaataccactaaaggaatctatgctggagtctgtatttctgtcttggtgcttcttgctcttttgggtgtcatcattgccaaaatgtttcatttagcagccttcaaattaaagctttgcaaaatgcagttgaaaaggaagtccaagcagaagacaatatctacattgagaatagtctttatgccacggactaagacccagtggtgctctttgagagtttacgcccatgagtgcagaagactgaacagacatcagcacatcagacgtcttttagaccccaagacaatttttctgtttcagtttcatctggcattccaacatgtcagtgatactgggtag

SEQ ID NO: 10033 - DNA, 1100 bp, synthetic construct
  misc_feature 1..1100: note = Synthetic polypeptide
  source 1..1100: mol_type = other DNA
ggctgggcatggtggctcatgcctgtaatcccagcactttgggatgctcagattctgtagctggttctgtaaaggttggtggagaggcaggtccatctgtcacactaccctgccactacagtggagctgtcacatccatgtgctggaatagaggctcatgttctctattcacatgccaaaatggcattgtctggaccaatggaacccacgtcacctatcggaaggacacacgctataagctattgggggacctttcaagaagggatgtctctttgaccatagaaaatacagctgtgtctgacagtggcgtatattgttgccgtgttgagcaccgtgggtggttcaatgacatgaaaatcaccgtatcattggagattgtgccacccaaggtcacgactactccaattgtcacaactgttccaaccgtcacgactgttcgaacgagcaccactgttccaacgacaacgactgttccaatgacgactgttccaacgacaactgttccaacaacaatgagcattccaacgacaacgactgttctgacgacaatgactgtttcaacgacaacgagcgttccaacgacaacgagcattccaacaacaacaagtgttccagtgacaacaactgtctctacctttgttcctccaatgcctttgcccaggcagaaccatgaaccagtagccacttcaccatcttcacctcagccagcagaaacccaccctacgacactgcagggagcaataaggagagaacccaccagctcaccattgtactcttacacaacagatgggaatgacaccgtgacagagtcttcagatggcctttggaataacaatcaaactcaactgttcctagaacatagtctactgacggccaataccactaaaggaatctatgctggagtctgtatttctgtcttggtgcttcttgctcttttgggtgtcatcattgccaaaaagtatttcttcaaaaaggaggttcaacaactaagtgtttcatttagcagccttcaaattaaagctttgcaaaatgcagttgaaaaggaagtccaagcagaagacaatatctacattgagaatagtctttatgccacggactaa

SEQ ID NO: 10034 - DNA, 674 bp, synthetic construct
  misc_feature 1..674: note = Synthetic polypeptide
  source 1..674: mol_type = other DNA
ggctgggcatggtggctcatgcctgtaatcccagcactttgggatgctcagattctgtagctggttctgtaaaggttggtggagaggcaggtccatctgtcacactaccctgccactacagtggagctgtcacatccatgtgctggaatagaggctcatgttctctattcacatgccaaaatggcattgtctggaccaatggaacccacgtcacctatcggaaggacacacgctataagctattgggggacctttcaagaagggatgtctctttgaccatagaaaatacagctgtgtctgacagtggcgtatattgttgccgtgttgagcaccgtgggtggttcaatgacatgaaaatcaccgtatcattggagattgtgccacccaaggtcacgactactccaattgtcacaactgttccaaccgtcacgactgttcgaacgagcaccactgttccaacgacaacgactgttccaatgacgactgttccaacgacaactgttccaacaacaatgagcattccaacgacaacgactgttctgacgacaatgactgtttcaacgacaacgagcgttccaacgacaacgagcattccaacaacaacaagtgttccagtgacaacaactgtctctacctttgttcctccaatgcctttgcccaggcagaaccatgaa

SEQ ID NO: 10035 - DNA, 574 bp, synthetic construct
  misc_feature 1..574: note = Synthetic polypeptide
  source 1..574: mol_type = other DNA
tgactctttcacaagttatgttgacatgatgaaagaagcattagaaaaacttcagctcaatatagtagagatgaaagatgaaaatgcaactttagatggcggagatgttttattcacaggcagagaattttttgtgggcctttccaaaaggacaaatcaacgaggtgctgaaatcttggctgatacttttaaggactatgcagtctccacagtgccagtggcagatgggttgcatttgaagagtttctgcagcatggctgggcctaacctgatcgcaattgggtctagtgaatctgcacagaaggcccttaagatcatgcaacagatgagtgaccaccgctacgacaaactcactgtgcctgatgacatagcagcaaactgtatatatctaaatatccccaacaaagggcacgtcttgctgcaccgaaccccggaagagtatccagaaagtgcaaaggtttatgagaaactgaaggaccatatgctgatccccgtgagcatgtctgaactggaaaaggtggatgggctgctcacctgctgctcagttttaattaacaagaaagtagactcctga

SEQ ID NO: 10036 - DNA, 462 bp, synthetic construct
  misc_feature 1..462: note = Synthetic polypeptide
  source 1..462: mol_type = other DNA
ccgggcgcggtgactcacgcctgtaatcccagcactttgggaggccgaggtgggcagatcacgagatcaagagatcaagaccatcctggccaacatggtgttgggcagttcagcgacgacatccagcagatgaccgggcagcggcccagcctgtactggcggctgtgctggaagctggtcagcccctgctttctcctgttcgtggtcgtggtcagcattgtgaccttcagacccccccactacggagcctacatcttccccgactgggccaacgcgctgggctgggtcatcgccacatcctccatggccatggtgcccatctatgcggcctacaagttctgcagcctgcctgggtcctttcgagagaaactggcctacgccattgcacccgagaaggaccgtgagctggtggacagaggggaggtgcgccagttcacgctccgccactggctcaaggtgtag

SEQ ID NO: 10037 - DNA, 586 bp, synthetic construct; identical to SEQ ID NO: 6809
  misc_feature 1..586: note = Synthetic polypeptide
  source 1..586: mol_type = other DNA

SEQ ID NO: 10038 - DNA, 167 bp, synthetic construct
  misc_feature 1..167: note = Synthetic polypeptide
  source 1..167: mol_type = other DNA
gtggtggctcatgcctgtaatttcagcactttgggaggccaaggcaggcggatcacttgaggtacttgaggttctgtttggattctgcaaagcagactcgtcagaaagttgctgtgaactggaccaacttcagcctcaagaaaaccactcctagcacagctcagtga

SEQ ID NO: 10039 - DNA, 571 bp, synthetic construct
  misc_feature 1..571: note = Synthetic polypeptide
  source 1..571: mol_type = other DNA
gccgggcacggtggctcacgcctgtaatcccagcactttgggaggccaaggcaggtggatcacgaggtcaagagatcaagaccatcctggccaacatggctcagagactcaggtcccaggactggacatatctgcactcctgccctctgacttcagccgctacttccaatatgaggggtctctgactacaccgccctgtgcccagggtgtcatctggactgtgtttaaccagacagtgatgctgagtgctaagcagctccacaccctctctgacaccctgtggggacctggtgactctcggctacagctgaacttccgagcgacgcagcctttgaatgggcgagtgattgaggcctccttccctgctggagtggacagcagtcctcgggctgctgagccagtccagctgaattcctgcctggctgctggtgacatcctagccctggtttttggcctcctttttgctgtcaccagcgtcgcgttccttgtgcagatgagaaggcagcacagaaggggaaccaaagggggtgtgagctaccgcccagcagaggtagccgagactggagcctag

SEQ ID NO: 10040 - DNA, 494 bp, synthetic construct
  misc_feature 1..494: note = Synthetic polypeptide
  source 1..494: mol_type = other DNA
tgtgatggttaatactgagtgtcaattgattgaattgaaggatacaaagtgttgatcctggatgtgtctgtgagggtgttgtcaaaagagattaacatttgagtcggtgggctgggagaggcagacccacccttaatctgggtaggaaccacctaatccagcatgactagaatataagcaggcagaaaaatatgaaaagagagactggcctagcttcccagcctagatctttcttccgtactggatgcttcctgcacttgaacatcagactccaggttcttcagttttggaactcaaactggctctccttgcacctcagcctgcagatggcctattgtgggaccttgtgatcatgctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtgg

SEQ ID NO: 10041 - DNA, 804 bp, synthetic construct
  misc_feature 1..804: note = Synthetic polypeptide
  source 1..804: mol_type = other DNA
tgtgatggttaatactgagtgtcaattgattgaattgaaggatacaaagtgttgatcctggatgtgtctgtgagggtgttgtcaaaagagattaacatttgagtcggtgggctgggagaggcagacccacccttaatctgggtaggaaccacctaatccagcatgactagaatataagcaggcagaaaaatatgaaaagagagactggcctagcttcccagcctagatctttcttccgtactggatgcttcctgcacttgaacatcagactccaggttcttcagttttggaactcaaactggctctccttgcacctcagcctgcagatggcctattgtgggaccttgtgatcatgctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtggggatcgtgtggcagtggtgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgtgatgggtggctgaacttcaagaaactactaaaatataaagtcagacacagagacgttaaataa

SEQ ID NO: 10042 - DNA, 1911 bp, synthetic construct
  misc_feature 1..1911: note = Synthetic polypeptide
  source 1..1911: mol_type = other DNA
tgtgatggttaatactgagtgtcaattgattgaattgaaggatacaaagtgttgatcctggatgtgtctgtgagggtgttgtcaaaagagattaacatttgagtcggtgggctgggagaggcagacccacccttaatctgggtaggaaccacctaatccagcatgactagaatataagcaggcagaaaaatatgaaaagagagactggcctagcttcccagcctagatctttcttccgtactggatgcttcctgcacttgaacatcagactccaggttcttcagttttggaactcaaactggctctccttgcacctcagcctgcagatggcctattgtgggaccttgtgatcatgctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtggggatcgtgtggcagtggtgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgtgatgggtggctgaacttcaagaaactactaaatgaggcatccaccactcatcactgtgtggagactggaagccaggaagcatctgccatctacttcactagtgggaccagtggtcttcccaagatggcagaacattcctactcgagcctgggcctcaaggccaagatggatgctggttggacaggcctgcaagcctctgatataatgtggaccatatcagacacaggttggatactgaacatcttgtgctcacttatggaaccttgggcattaggagcatgcacatttgttcatctcttgccaaagtttgacccactggttattctaaagacactctccagttatccaatcaagagtatgatgggtgcccccattgtttaccggatgttgctacagcaggatctttccagttacaagttcccccatctacagaactgcgtcactgtaggggagtcccttcttccagaaactctggagaactggagggcccagacaggactggacatccgagaatcctatggccagacagaaacgggattaacttgcatggtttccaagacaatgaaaatcaaaccaggatacatgggaacggctgcttcctgttatgatgtacagatcatagatgataagggcaacgtcctgccccccggcacagaaggagacattggcatcagggtcaaacccatcaggcctataggcatcttctctggctatgtggacaatcccgacaagacagcagccaacattcgaggagacttttggctccttggagaccggggaatcaaagatgaagatgggtatttccagtttatgggacgggcaaatgatatcattaactccagcgggtaccggattggaccctcggaggtagagaatgcactgatggagcaccctgctgtggttgagacggctgtgatcagcagcccagaccccgtccgaggagaggtggtgaaggcatttgtggtcctggcctcgcagttcctgtcccatgacccagaacagctcaccaaggagctgcagcagcatgtgaagtcagtgacagccccatacaagtacccaagaaagatagagtttgtcttgaacctgcccaagactgtcacagggaaaattcaacgagccaagcttcgagacaaggagtggaagatgtccggaaaagcccgtgcgcagtga

SEQ ID NO: 10043 - DNA, 531 bp, synthetic construct
  misc_feature 1..531: note = Synthetic polypeptide
  source 1..531: mol_type = other DNA
tgtgatggttaatactgagtgtcaattgattgaattgaaggatacaaagtgttgatcctggatgtgtctgtgagggtgttgtcaaaagagattaacatttgagtcggtgggctgggagaggcagacccacccttaatctgggtaggaaccacctaatccagcatgactagaatataagcaggcagaaaaatatgaaaagagagactggcctagcttcccagcctagatctttcttccgtactggatgcttcctgcacttgaacatcagactccaggttcttcagttttggaactcaaactggctctccttgcacctcagcctgcagatggcctattgtgggaccttgtgatcatgctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtggggatcgtgtggcagtggtgctgccccgagtgcctgag

SEQ ID NO: 10044 - DNA, 1055 bp, synthetic construct
  misc_feature 1..1055: note = Synthetic polypeptide
  source 1..1055: mol_type = other DNA
ggctcacgcctgtaatcccagcactttgggaggtcgaagcaggtggattacttgaggcccttccatactttgaccggctagactatgtgtccatgatgtgtaacgaacaggcctattctctagctgtggagaagttgctaaacatccggcctcctcctcgggcacagtggatccgagtgctgtttggagaaatcacacgtttgttgaaccacatcatggctgtgaccacacatgccctggaccttggggccatgacccctttcttctggctgtttgaagaaagggagaagatgtttgagttctacgagcgagtgtctggagcccgaatgcatgctgcttatatccggccaggaggagtgcaccaggacctaccccttgggcttatggatgacatttatcagttttctaagaacttctctcttcggcttgatgagttggaggagttgctgaccaacaataggatctggcgaaatcggacaattgacattggggttgtaacagcagaagaagcacttaactatggttttagtggagtgatgcttcggggctcaggcatccagtgggacctgcggaagacccagccctatgatgtttacgaccaggttgagtttgatgttcctgttggttctcgaggggactgctatgataggtacctgtgccgggtggaggagatgcgccagtccctgagaattatcgcacagtgtctaaacaagatgcctcctggggagatcaaggttgatgatgccaaagtgtctccacctaagcgagcagagatgaagacttccatggagtcactgattcatcactttaagttgtatactgagggctaccaagttcctccaggagccacatatactgccattgaggctcccaagggagagtttggggtgtacctggtgtctgatggcagcagccgcccttatcgatgcaagatcaaggctcctggttttgcccatctggctggtttggacaagatgtctaagggacacatgttggcagatgtcgttgccatcataggtacccaagatattgtatttggagaagtagatcggtga

SEQ ID NO: 10045 - DNA, 1037 bp, synthetic construct
  misc_feature 1..1037: note = Synthetic polypeptide
  source 1..1037: mol_type = other DNA
ggctcacgcctgtaatcccagcactttgggaggtcgaagcaggtggattacttgaggcccttccatactttgaccggctagactatgtgtccatgatgtgtaacgaacaggcctattctctagctgtggagaagttgctaaacatccggcctcctcctcgggcacagtggatccgagtgctgtttggagaaatcacacgtttgttgaaccacatcatggctgtgaccacacatgccctggaccttggggccatgacccctttcttctggctgtttgaagaaagggagaagatgtttgagttctacgagcgagtgtctggagcccgaatgcatgctgcttatatccggccaggaggagtgcaccaggacctaccccttgggcttatggatgacatttatcagttttctaagaacttctctcttcggcttgatgagttggaggagttgctgaccaacaataggatctggcgaaatcggacaattgacattggggttgtaacagcagaagaagcacttaactatggttttagtggagtgatgcttcggggctcaggcatccagtgggacctgcggaagacccagccctatgatgtttacgaccaggttgagtttgatgttcctgttggttctcgaggggactgctatgataggtacctgtgccgggtggaggagatgcgccagtccctgagaattatcgcacagtgtctaaacaagatgcctcctggggagatcaaggttgatgatgccaaagtgtctccacctaagcgagcagagatgaagacttccatggagtcactgattcatcactttaagttgtatactgagggctaccaagttcctccaggagccacatatactgccattgaggctcccaagggagagtttggggtgtacctggtgtctgatggcagcagccgcccttatcgatgcaagatcaaggctcctggttttgcccatctggctggtttggacaagatgtctaagggacacatgttggcagatgtcgttgccatcataggtacgaggcctattgtgtag

SEQ ID NO: 10046 - DNA, 653 bp, synthetic construct
  misc_feature 1..653: note = Synthetic polypeptide
  source 1..653: mol_type = other DNA
ggctcacgcctgtaatcccagcactttgggaggtcgaagcaggtggattacttgaggcccttccatactttgaccggctagactatgtgtccatgatgtgtaacgaacaggcctattctctagctgtggagaagttgctaaacatccggcctcctcctcgggcacagtggatccgagtgctgtttggagaaatcacacgtttgttgaaccacatcatggctgtgaccacacatgccctggaccttggggccatgacccctttcttctggctgtttgaagaaagggagaagatgtttgagttctacgagcgagtgtctggagcccgaatgcatgctgcttatatccggccaggaggagtgcaccaggacctaccccttgggcttatggatgacatttatcagttttctaagaacttctctcttcggcttgatgagttggaggagttgctgaccaacaataggatctggcgaaatcggacaattgacattggggttgtaacagcagaagaagcacttaactatggttttagtggagtgatgcttcggggctcaggcatccagtgggacctgcggaagacccagccctatgatgtttacgaccaggttgagtttgatgttcctgttggttctcgaggggactgctatgataggtaa

SEQ ID NO: 10047 - DNA, 3705 bp, synthetic construct
  misc_feature 1..3705: note = Synthetic polypeptide
  source 1..3705: mol_type = other DNA
aatggaaaatgtaaaggcattagggtcatactgacatgtgtttgaattcaggtcctctgattttacgagctcatgaccttgggggagcgaatcctgccagtctctctggatctctttcttctgtaaggtatggcctcacatgtgcaagttttctcccctcacacccttcaatcaagtgccttctgtagtgtgaagaaactgaaaatagagccgagttccaactgggacatgactgggtacggctcccacagcaaagtgtatagccagagcaagaacatccccctgtcgcagccagccaccacaaccgtcagcacctccttgccggtcccaaacccaagcctaccttacgagcagaccatcgtcttcccaggaagcaccgggcacatcgtggtcacctcagcaagcagcacttctgtcaccgggcaagtcctcggcggaccacacaacctaatgcgtcgaagcactgtgagcctccttgatacctaccaaaaatgtggactcaagcgtaagagcgaggagatcgagaacacaagcagcgtgcagatcatcgaggagcatccacccatgattcagaataatgcaagcggggccactgtcgccactgccaccacgtctactgccacctccaaaaacagcggctccaacagcgagggcgactatcagctggtgcagcatgaggtgctgtgctccatgaccaacacctacgaggtcttagagttcttgggccgagggacgtttgggcaagtggtcaagtgctggaaacggggcaccaatgagatcgtagccatcaagatcctgaagaaccacccatcctatgcccgacaaggtcagattgaagtgagcatcctggcccggttgagcacggagagtgccgatgactataacttcgtccgggcctacgaatgcttccagcacaagaaccacacgtgcttggtcttcgagatgttggagcagaacctctatgactttctgaagcaaaacaagtttagccccttgcccctcaaatacattcgcccagttctccagcaggtagccacagccctgatgaaactcaaaagcctaggtcttatccacgctgacctcaaaccagaaaacatcatgctggtggatccatctagacaaccatacagagtcaaggtcatcgactttggttcagccagccacgtctccaaggctgtgtgctccacctacttgcagtccagatattacagggcccctgagatcatccttggtttaccattttgtgaggcaattgacatgtggtccctgggctgtgttattgcagaattgttcctgggttggccgttatatccaggagcttcggagtatgatcagattcggtatatttcacaaacacagggtttgcctgctgaatatttattaagcgccgggacaaagacaactaggtttttcaaccgtgacacggactcaccatatcctttgtggagactgaagacaccagatgaccatgaagcagagacagggattaagtcaaaagaagcaagaaagtacattttcaactgtttagatgatatggcccaggtgaacatgacgacagatttggaagggagcgacatgttggtagaaaaggctgaccggcgggagttcattgacctgttgaagaagatgctgaccattgatgctgacaagagaatcactccaatcgaaaccctgaaccatccctttgtcaccatgacacacttactcgattttccccacagcacacacgtcaaatcatgtttccagaacatggagatctgcaagcgtcgggtgaatatgtatgacacggtgaaccagagcaaaacccctttcatcacgcacgtggcccccagcacgtccaccaacctgaccatgacctttaacaaccagctgaccactgtccacaaccaggctccctcctctaccagtgccactatttccttagccaatcccgaagtctccatactaaactacccatctacactctaccagccctcagcggcatccatggctgcagtggcccagcggagcatgcccctgcagacaggaacagcccagatttgtgcccggcctgacccgttccagcaagctctcatcgtgtgtccccccggcttccaaggcttgcaggcctctccctctaagcacgctggctactcggtgcgaatggaaaatgcagttcccatcgtcactcaagccccaggagctcagcctcttcagatccaaccaggtctgcttgcccagcaggcttggccaagtgggacccagcagatcctgcttcccccagcatggcagcaactgactggagtggccacccacacatcagtgcagcatgccaccgtgattcccgagaccatggcaggcacccagcagctggcggactggagaaatacgcatgctcacggaagccattataatcccatcatgcagcagcctgcactattgaccggtcatgtgacccttccagcagcacagcccttaaatgtgggtgtggcccacgtgatgcggcagcagccaaccagcaccacctcctcccggaagagtaagcagcaccagtcatctgtgagaaatgtctccacctgtgaggtgtcctcctctcaggccatcagctccccacagcgatccaagcgtgtcaaggagaacacacctccccgctgtgccatggtgcacagtagcccggcctgcagcacctcggtcacctgtgggtggggcgacgtggcctccagcaccacccgggaacggcagcggcagacaattgtcattcccgacactcccagccccacggtcagcgtcatcaccatcagcagtgacacggacgaggaggaggaacagaaacacgcccccaccagcactgtctccaagcaaagaaaaaacgtcatcagctgtgtcacagtccacgactccccctactccgactcctccagcaacaccagcccctactccgtgcagcagcgtgctgggcacaacaatgccaatgcctttgacaccaaggggagcctggagaatcactgcacggggaacccccgaaccatcatcgtgccacccctgaaaacccaggccagcgaagtattggtggagtgtgatagcctggtgccagtcaacaccagtcaccactcgtcctcctacaagtccaagtcctccagcaacgtgacctccaccagcggtcactcttcagggagctcatctggagccatcacctaccggcagcagcggccgggcccccacttccagcagcagcagccactcaatctcagccaggctcagcagcacatcaccacggaccgcactgggagccaccgaaggcagcaggcctacatcactcccaccatggcccaggctccgtactccttcccgcacaacagccccagccacggcactgtgcacccgcatctggctgcagccgctgccgctgcccacctccccacccagccccacctctacacctacactgcgccggcggccctgggctccaccggcaccgtggcccacctggtggcctcgcaaggctctgcgcgccacaccgtgcagcacactgcctacccagccagcatcgtccaccaggtccccgtgagcatgggcccccgggtcctgccctcgcccaccatccacccgagtcagtatccagcccaatttgcccaccagacctacatcagcgcctcgccagcctccaccgtctacactggatacccactgagccccgccaaggtcaaccagtacccttacatataa

SEQ ID NO: 10048 - DNA, 3624 bp, synthetic construct
  misc_feature 1..3624: note = Synthetic polypeptide
  source 1..3624: mol_type = other DNA
aatggaaaatgtaaaggcattagggtcatactgacatgtgtttgaattcaggtcctctgattttacgagctcatgaccttgggggagcgaatcctgccagtctctctggatctctttcttctgtaaggtatggcctcacatgtgcaagttttctcccctcacacccttcaatcaagtgccttctgtagtgtgaagaaactgaaaatagagccgagttccaactgggacatgactgggtacggctcccacagcaaagtgtatagccagagcaagaacatccccctgtcgcagccagccaccacaaccgtcagcacctccttgccggtcccaaacccaagcctaccttacgagcagaccatcgtcttcccaggaagcaccgggcacatcgtggtcacctcagcaagcagcacttctgtcaccgggcaagtcctcggcggaccacacaacctaatgcgtcgaagcactgtgagcctccttgatacctaccaaaaatgtggactcaagcgtaagagcgaggagatcgagaacacaagcagcgtgcagatcatcgaggagcatccacccatgattcagaataatgcaagcggggccactgtcgccactgccaccacgtctactgccacctccaaaaacagcggctccaacagcgagggcgactatcagctggtgcagcatgaggtgctgtgctccatgaccaacacctacgaggtcttagagttcttgggccgagggacgtttgggcaagtggtcaagtgctggaaacggggcaccaatgagatcgtagccatcaagatcctgaagaaccacccatcctatgcccgacaaggtcagattgaagtgagcatcctggcccggttgagcacggagagtgccgatgactataacttcgtccgggcctacgaatgcttccagcacaagaaccacacgtgcttggtcttcgagatgttggagcagaacctctatgactttctgaagcaaaacaagtttagccccttgcccctcaaatacattcgcccagttctccagcaggtagccacagccctgatgaaactcaaaagcctaggtcttatccacgctgacctcaaaccagaaaacatcatgctggtggatccatctagacaaccatacagagtcaaggtcatcgactttggttcagccagccacgtctccaaggctgtgtgctccacctacttgcagtccagatattacagggcccctgagatcatccttggtttaccattttgtgaggcaattgacatgtggtccctgggctgtgttattgcagaattgttcctgggttggccgttatatccaggagcttcggagtatgatcagattcggtatatttcacaaacacagggtttgcctgctgaatatttattaagcgccgggacaaagacaactaggtttttcaaccgtgacacggactcaccatatcctttgtggagactgaagacaccagatgaccatgaagcagagacagggattaagtcaaaagaagcaagaaagtacattttcaactgtttagatgatatggcccaggtgaacatgacgacagatttggaagggagcgacatgttggtagaaaaggctgaccggcgggagttcattgacctgttgaagaagatgctgaccattgatgctgacaagagaatcactccaatcgaaaccctgaaccatccctttgtcaccatgacacacttactcgattttccccacagcacacacgtcaaatcatgtttccagaacatggagatctgcaagcgtcgggtgaatatgtatgacacggtgaaccagagcaaaacccctttcatcacgcacgtggcccccagcacgtccaccaacctgaccatgacctttaacaaccagctgaccactgtccacaaccagccctcagcggcatccatggctgcagtggcccagcggagcatgcccctgcagacaggaacagcccagatttgtgcccggcctgacccgttccagcaagctctcatcgtgtgtccccccggcttccaaggcttgcaggcctctccctctaagcacgctggctactcggtgcgaatggaaaatgcagttcccatcgtcactcaagccccaggagctcagcctcttcagatccaaccaggtctgcttgcccagcaggcttggccaagtgggacccagcagatcctgcttcccccagcatggcagcaactgactggagtggccacccacacatcagtgcagcatgccaccgtgattcccgagaccatggcaggcacccagcagctggcggactggagaaatacgcatgctcacggaagccattataatcccatcatgcagcagcctgcactattgaccggtcatgtgacccttccagcagcacagcccttaaatgtgggtgtggcccacgtgatgcggcagcagccaaccagcaccacctcctcccggaagagtaagcagcaccagtcatctgtgagaaatgtctccacctgtgaggtgtcctcctctcaggccatcagctccccacagcgatccaagcgtgtcaaggagaacacacctccccgctgtgccatggtgcacagtagcccggcctgcagcacctcggtcacctgtgggtggggcgacgtggcctccagcaccacccgggaacggcagcggcagacaattgtcattcccgacactcccagccccacggtcagcgtcatcaccatcagcagtgacacggacgaggaggaggaacagaaacacgcccccaccagcactgtctccaagcaaagaaaaaacgtcatcagctgtgtcacagtccacgactccccctactccgactcctccagcaacaccagcccctactccgtgcagcagcgtgctgggcacaacaatgccaatgcctttgacaccaaggggagcctggagaatcactgcacggggaacccccgaaccatcatcgtgccacccctgaaaacccaggccagcgaagtattggtggagtgtgatagcctggtgccagtcaacaccagtcaccactcgtcctcctacaagtccaagtcctccagcaacgtgacctccaccagcggtcactcttcagggagctcatctggagccatcacctaccggcagcagcggccgggcccccacttccagcagcagcagccactcaatctcagccaggctcagcagcacatcaccacggaccgcactgggagccaccgaaggcagcaggcctacatcactcccaccatggcccaggctccgtactccttcccgcacaacagccccagccacggcactgtgcacccgcatctggctgcagccgctgccgctgcccacctccccacccagccccacctctacacctacactgcgccggcggccctgggctccaccggcaccgtggcccacctggtggcctcgcaaggctctgcgcgccacaccgtgcagcacactgcctacccagccagcatcgtccaccaggtccccgtgagcatgggcccccgggtcctgccctcgcccaccatccacccgagtcagtatccagcccaatttgcccaccagacctacatcagcgcctcgccagcctccaccgtctacactggatacccactgagccccgccaaggtcaaccagtacccttacatataa

SEQ ID NO: 10049 - DNA, 2865 bp, synthetic construct
  misc_feature 1..2865: note = Synthetic polypeptide
  source 1..2865: mol_type = other DNA
aatggaaaatgtaaaggcattagggtcatactgacatgtgtttgaattcaggtcctctgattttacgagctcatgaccttgggggagcgaatcctgccagtctctctggatctctttcttctgtaaggtatggcctcacatgtgcaagttttctcccctcacacccttcaatcaagtgccttctgtagtgtgaagaaactgaaaatagagccgagttccaactgggacatgactgggtacggctcccacagcaaagtgtatagccagagcaagaacatccccctgtcgcagccagccaccacaaccgtcagcacctccttgccggtcccaaacccaagcctaccttacgagcagaccatcgtcttcccaggaagcaccgggcacatcgtggtcacctcagcaagcagcacttctgtcaccgggcaagtcctcggcggaccacacaacctaatgcgtcgaagcactgtgagcctccttgatacctaccaaaaatgtggactcaagcgtaagagcgaggagatcgagaacacaagcagcgtgcagatcatcgaggagcatccacccatgattcagaataatgcaagcggggccactgtcgccactgccaccacgtctactgccacctccaaaaacagcggctccaacagcgagggcgactatcagctggtgcagcatgaggtgctgtgctccatgaccaacacctacgaggtcttagagttcttgggccgagggacgtttgggcaagtggtcaagtgctggaaacggggcaccaatgagatcgtagccatcaagatcctgaagaaccacccatcctatgcccgacaaggtcagattgaagtgagcatcctggcccggttgagcacggagagtgccgatgactataacttcgtccgggcctacgaatgcttccagcacaagaaccacacgtgcttggtcttcgagatgttggagcagaacctctatgactttctgaagcaaaacaagtttagccccttgcccctcaaatacattcgcccagttctccagcaggtagccacagccctgatgaaactcaaaagcctaggtcttatccacgctgacctcaaaccagaaaacatcatgctggtggatccatctagacaaccatacagagtcaaggtcatcgactttggttcagccagccacgtctccaaggctgtgtgctccacctacttgcagtccagatattacagggcccctgagatcatccttggtttaccattttgtgaggcaattgacatgtggtccctgggctgtgttattgcagaattgttcctgggttggccgttatatccaggagcttcggagtatgatcagattcggtatatttcacaaacacagggtttgcctgctgaatatttattaagcgccgggacaaagacaactaggtttttcaaccgtgacacggactcaccatatcctttgtggagactgaagacaccagatgaccatgaagcagagacagggattaagtcaaaagaagcaagaaagtacattttcaactgtttagatgatatggcccaggtgaacatgacgacagatttggaagggagcgacatgttggtagaaaaggctgaccggcgggagttcattgacctgttgaagaagatgctgaccattgatgctgacaagagaatcactccaatcgaaaccctgaaccatccctttgtcaccatgacacacttactcgattttccccacagcacacacgtcaaatcatgtttccagaacatggagatctgcaagcgtcgggtgaatatgtatgacacggtgaaccagagcaaaacccctttcatcacgcacgtggcccccagcacgtccaccaacctgaccatgacctttaacaaccagctgaccactgtccacaaccaggctccctcctctaccagtgccactatttccttagccaatcccgaagtctccatactaaactacccatctacactctaccagccctcagcggcatccatggctgcagtggcccagcggagcatgcccctgcagacaggaacagcccagatttgtgcccggcctgacccgttccagcaagctctcatcgtgtgtccccccggcttccaaggcttgcaggcctctccctctaagcacgctggctactcggtgcgaatggaaaatgcagttcccatcgtcactcaagccccaggagctcagcctcttcagatccaaccaggtctgcttgcccagcaggcttggccaagtgggacccagcagatcctgcttcccccagcatggcagcaactgactggagtggccacccacacatcagtgcagcatgccaccgtgattcccgagaccatggcaggcacccagcagctggcggactggagaaatacgcatgctcacggaagccattataatcccatcatgcagcagcctgcactattgaccggtcatgtgacccttccagcagcacagcccttaaatgtgggtgtggcccacgtgatgcggcagcagccaaccagcaccacctcctcccggaagagtaagcagcaccagtcatctcaaagaaaaaacgtcatcagctgtgtcacagtccacgactccccctactccgactcctccagcaacaccagcccctactccgtgcagcagcgtgctgggcacaacaatgccaatgcctttgacaccaaggggagcctggagaatcactgcacggggaacccccgaaccatcatcgtgccacccctgaaaacccaggccagcgaagtattggtggagtgtgatagcctggtgccaggtaatttggggccaggacagggcaggaacctctccctggagagtggttttcctgcttttctgctgctagaaatgttgctgtatgggagctag

SEQ ID NO: 10050 - DNA, 775 bp, synthetic construct
  misc_feature 1..775: note = Synthetic polypeptide
  source 1..775: mol_type = other DNA
cagtgacaggcccagtgggatgcaggaagcagcctgccctcgctgtgaaatctccttccgagtgtggatgtgcgggggcagcctagagatcgtcccctgcagccgagtggggcacgtcttccggaagaagcacccctacgttttccctgatggaaatgccaacacgtatataaagaacaccaagcggacagctgaagtgtggatggatgaatacaagcaatactattacgctgcccggccattcgccctggagaggcccttcgggaatgttgagagcagattggacctgaggaagaatctgcgctgccagagcttcaagtggtacctggagaatatctaccctgaactcagcatccccaaggagtcctccatccagaagggcaatatccgacagagacagaagtgcctggaatctcaaaggcagaacaaccaagaaaccccaaacctaaagttgagcccctgtgccaaggtcaaaggcgaagatgcaaagtcccaggtatgggccttcacatacacccagcagatcctccaggaggagctgtgcctgtcagtcatcaccttgttccctggcgccccagtggttcttgtcctttgcaagaatggagatgaccgacagcaatggaccaaaactggttcccacatcgagcacatagcatcccacctctgcctcgatacagatatgttcggtgatggcaccgagaacggcaaggaaatcgtcgtcaacccatgtgagtcctcactcatgagccagcactgggacatggtgagctcttga

SEQ ID NO: 10051 - DNA, 417 bp, synthetic construct
  misc_feature 1..417: note = Synthetic polypeptide
  source 1..417: mol_type = other DNA
cagtgacaggcccagtgggatgcaggaagcagcctgccctcgctgtgaaatctccttccgagtgtggatgtgcgggggcagcctagagatcgtcccctgcagccgagtggggcacgtcttccggaagaagcacccctacgttttccctgatggaaatgccaacacgtatataaagaacaccaagcggacagctgaagtgtggatggatgaatacaagcaatactattacgctgcccggccattcgccctggagaggcccttcgggaatgttgagagcagattggacctgaggaagaatctgcgctgccagagcttcaagtggtacctggagaatatctaccctgaactcagcatccccaaggagtcctccatccagaagggcaatatccgacagagacagaagtgcctggaatctca

SEQ ID NO: 10052 - DNA, 620 bp, synthetic construct
  misc_feature 1..620: note = Synthetic polypeptide
  source 1..620: mol_type = other DNA
ttgagctctctatgccccagtttcctcatctgtaaagtagaaatagtaacagtcagcctcacagagttggcttcaggagaaatcagttaagtgacaaccatgagtggaaaaaactaattatggttcagcactggcctgagacagtatgcgagaaaattcaaaacgactgtagagaccctccggattactggacaatacatggactatggcccgataaaagtgaaggatgtaatagatcgtggcccttcaatttagaagagattaaggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacagtgtgcttctaaaattggggataaaaccatccatcaattactaccaaaccacagaggaggatctcaacctggatgtggagcccaccacagaagacactgcagaagaagtaactatacacgttttattacactctgctttgtttggggagattgggcccagaaggtggtga

SEQ ID NO: 10053 - DNA, 776 bp, synthetic construct
  misc_feature 1..776: note = Synthetic polypeptide
  source 1..776: mol_type = other DNA
ttgagctctctatgccccagtttcctcatctgtaaagtagaaatagtaacagtcagcctcacagagttggcttcaggagaaatcagttaagtgacaaccatgagtggaaaaaactaattatggttcagcactggcctgagacagtatgcgagaaaattcaaaacgactgtagagaccctccggattactggacaatacatggactatggcccgataaaagtgaaggatgtaatagatcgtggcccttcaatttagaagagattaaggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacagtgtgcttctaaaattggggataaaaccatccatcaattactaccaagttgcagattttaaagatgcccttgccagagtatatggagtgatacccaaaatccagtgccttccaccaagccaggatgaggaagtacagacaattggtcagatagaactgtgcctcactaagcaagaccagcagctgcaaaactgcaccgagccgggggagcagccgtcccccaagcaggaagtctggctggcaaatggggccgccgagagccggggtctgagagtctgtgaagatggcccagtcttctatcccccacctaaaaagaccaagcattga

SEQ ID NO: 10054 - DNA, 371 bp, synthetic construct
  misc_feature 1..371: note = Synthetic polypeptide
  source 1..371: mol_type = other DNA
ttgagctctctatgccccagtttcctcatctgtaaagtagaaatagtaacagtcagcctcacagagttggcttcaggagaaatcagttaagtgacaaccatgagtggaaaaaactaattatggttcagcactggcctgagacagtatgcgagaaaattcaaaacgactgtagagaccctccggattactggacaatacatggactatggcccgataaaagtgaaggatgtaatagatcgtggcccttcaatttagaagagattaagaaaaattggatggagattacagacagttcactcccttccccctcaactctcccaatcattaacatcttctatagtgtgttacatttgttacaattaatgaactga

SEQ ID NO: 10055 - DNA, 221 bp, synthetic construct
  misc_feature 1..221: note = Synthetic polypeptide
  source 1..221: mol_type = other DNA
ttgagctctctatgccccagtttcctcatctgtaaagtagaaatagtaacagtcagcctcacagagttggcttcaggagaaatcagttaagtgacaaccatgagtggaaaaaactaattatggttcagcactggcctgagacagtatgcgagaaaattcaaaacgactgtagagaccctccggattactggacaatacatggactatggcaagcccgataa

SEQ ID NO: 10056 - DNA, 766 bp, synthetic construct
  misc_feature 1..766: note = Synthetic polypeptide
  source 1..766: mol_type = other DNA
ttgagctctctatgccccagtttcctcatctgtaaagtagaaatagtaacagtcagcctcacagagttggcttcaggagaaatcagttaagtgacaaccatgagtggaaaaaactaattatggttcagcactggcctgagacagtatgcgagaaaattcaaaacgactgtagagaccctccggattactggacaatacatggactatggcccgataaaagtgaaggatgtaatagatcgtggcccttcaatttagaagagattaaggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacagtgtgcttctaaaattggggataaaaccatccatcaattactaccaagttgcagattttaaagatgcccttgccagagtatatggagtgatacccaaaatccagtgccttccaccaagccaggatgaggaagtacagacaattggtcagatagaactgtgcctcactaagcaagaccagcagctgcaaaactgcaccgagccgggggagcagccgtcccccaagcaggaagtctggctggcaaatggggccgccgagagccggggtctgagagtctgtgaagatggcccagtcttctatcccccacctaaaaagac

SEQ ID NO: 10057 - DNA, 1692 bp, synthetic construct; identical to SEQ ID NO: 9681
  misc_feature 1..1692: note = Synthetic polypeptide
  source 1..1692: mol_type = other DNA

SEQ ID NO: 10058 - DNA, 1319 bp, synthetic construct
  misc_feature 1..1319: note = Synthetic polypeptide
  source 1..1319: mol_type = other DNA
agtaatcagtatgtctggaactcatattttgttttctaataccatttcctactaaaaggaatcggggatttctggagaaatggctggtctccagggctggggaagaaaagactttgccttcaaaagaaacagcatttttaaacactacacaaatgccttgcctgcaatcagcttcaacttggagtagctatgaacacaattcggagtcttacctattaagagaacatgtatcagagttagattcctctttccattctgttctatcattgccatcagatgtgcctcttcattttcactttgaaacactgttaaaaaagactgaaataaaaggcaatcttgctgaaaataaatttgtagatgaatatatcatatctccatcacctgtacatagtactctgaatcaatggagaaatggatattcacctatatgtaagcctcaaataaggtcagaatcttctgcacaactgttacagggaagaaagaaaagacatttgagtgaaacagcattaggagaaagaactaaacttgaagaatctgattttcaacacacagaatcaggatcccatagcaattttactgctgtttccaatgtcaacgttttatcaagaatccagaattcatcacgaaatactgcacgacggagattgagaagtgagagctcttatgacatagataacattgtgattcccatgtcattagtagccccagctaaattagagaaactccaatataaggaaatacttactccaagctggaggatggttgttcttcagcctttggatgaatataatttaggcaaagaagagatagaagatctttctgatgaagtcttctccctaaggcacaaaaaatatgaagagagagagcaagccaggtggtcactatgggagcaaagcaagtggcacagaagaaacagcagagcttacagtaaaaatgttgaaggacaggacttgcttttgaaagaataccctaataacttcagtagcagtcagcaatgtgctgctgcaagtcctcctgggcttccttcagagaaccaggatctgtgtgcatatggcttaccttctttaaatcaaagtcaagaaaccaagtctttgtggtgggaacgacgggcttttccactgaagggtgaagacatggcagccttattatgtcaagatgaaaaaaaggatcaggttgaaaggtcaagcacagctttccatggtgaaatcttcggtaccagtgtaccagagaatggccaccatccaaaaaagcagtcagatggaatggaagaatacaaaacctttggtctaggacttactaatgttaaaaaaaataggtga

SEQ ID NO: 10059 - DNA, 1193 bp, synthetic construct
  misc_feature 1..1193: note = Synthetic polypeptide
  source 1..1193: mol_type = other DNA
agtaatcagtatgtctggaactcatattttgttttctaataccatttcctactaaaaggaatcggggatttctggagaaatggctggtctccagggctggggaagaaaagactttgccttcaaaagaaacagcatttttaaacactacacaaatgccttgcctgcaatcagcttcaacttggagtagctatgaacacaattcggagtcttacctattaagagaacatgtatcagagttagattcctctttccattctgttctatcattgccatcagatgtgcctcttcattttcactttgaaacactgttaaaaaagactgaaataaaaggcaatcttgctgaaaataaatttgtagatgaatatatcatatctccatcacctggagaaagaactaaacttgaagaatctgattttcaacacacagaatcaggatcccatagcaattttactgctgtttccaatgtcaacgttttatcaagaatccagaattcatcacgaaatactgcacgacggagattgagaagtgagagctcttatgacatagataacattgtgattcccatgtcattagtagccccagctaaattagagaaactccaatataaggaaatacttactccaagctggaggatggttgttcttcagcctttggatgaatataatttaggcaaagaagagatagaagatctttctgatgaagtcttctccctaaggcacaaaaaatatgaagagagagagcaagccaggtggtcactatgggagcaaagcaagtggcacagaagaaacagcagagcttacagtaaaaatgttgaaggacaggacttgcttttgaaagaataccctaataacttcagtagcagtcagcaatgtgctgctgcaagtcctcctgggcttccttcagagaaccaggatctgtgtgcatatggcttaccttctttaaatcaaagtcaagaaaccaagtctttgtggtgggaacgacgggcttttccactgaagggtgaagacatggcagccttattatgtcaagatgaaaaaaaggatcaggttgaaaggtcaagcacagctttccatggtgaaatcttcggtaccagtgtaccagagaatggccaccatccaaaaaagcagtcagatggaatggaagaatacaaaacctttggtctaggacttactaatgttaaaaaaaataggtga

SEQ ID NO: 10060 - DNA, 473 bp, synthetic construct
  misc_feature 1..473: note = Synthetic polypeptide
  source 1..473: mol_type = other DNA
agtaatcagtatgtctggaactcatattttgttttctaataccatttcctactaaaaggaatcggggatttctggagaaatggctggtctccagggctggggaagaaaagactttgccttcaaaagaaacagcatttttaaacactacacaaatgccttgcctgcaatcagcttcaacttggagtagctatgaacacaattcggagtcttacctattaagagaacatgtatcagagttagattcctctttccattctgttctatcattgccatcagatgtgcctcttcattttcactttgaaacactgttaaaaaagactgaaataaaaggcaatcttgctgaaaataaatttgtagatgaatatatcatatctccatcacctggtatgtcacatttacagttcttgtactctatatgcctttttatgtctttatacttactatttttgcattctaagaaaaataaaatctaa

SEQ ID NO: 10061 - DNA, 302 bp, synthetic construct
  misc_feature 1..302: note = Synthetic polypeptide
  source 1..302: mol_type = other DNA
agtaatcagtatgtctggaactcatattttgttttctaataccatttcctactaaaaggaatcggggatttctggagaaatggctggtctccagggctggggaagaaaagactttgccttcaaaagaaacagcatttttaaacactacacaaatgccttgcctgcaatcagcttcaacttggagtagctatgaacacaattcggagtcttacctattaagagaacatgtatcagagttagattcctctttccattctgttctatcattgccatcaggtaagcctccttgtaacaatttctaa

SEQ ID NO: 10062 - DNA, 246 bp, synthetic construct
  misc_feature 1..246: note = Synthetic polypeptide
  source 1..246: mol_type = other DNA
ctacctttctaacagatcctttgttttgtttaggcttctaaccctcctttatgtgactcagagaaaggagacctcattccaagttccaggattaattctgtatctggagtccatctttcaccatcttctcctgagattgtactggaccgtgaccactcttcttccattggctgcctctcttctgatgccattatttcatcaccagagaatacacatgcagcaaatagcattgtgagtcaaactatt

SEQ ID NO: 10063 - DNA, 1209 bp, synthetic construct
  misc_feature 1..1209: note = Synthetic polypeptide
  source 1..1209: mol_type = other DNA
ctacctttctaacagatcctttgttttgtttaggcttctaaccctcctttatgtgactcagagaaaggagacctcattccaagttccaggattaattctgtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaaggctcgatcaagtcatccgccaaagaagcctgtccagtttggaactgttcctctcctgtgcacagaaacagttaagtgctttaatagctacggaaccagttgacattgaataa

SEQ ID NO: 10064 - DNA, 1074 bp, synthetic construct
  misc_feature 1..1074: note = Synthetic polypeptide
  source 1..1074: mol_type = other DNA
ctacctttctaacagatcctttgttttgtttaggcttctaaccctcctttatgtgactcagagaaaggagacctcattccaagttccaggattaattctgtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaa

SEQ ID NO: 10065 - DNA, 1317 bp, synthetic construct
  misc_feature 1..1317: note = Synthetic polypeptide
  source 1..1317: mol_type = other DNA
ctacctttctaacagatcctttgttttgtttaggcttctaaccctcctttatgtgactcagagaaaggagacctcattccaagttccaggattaattctgtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaaggctcgatcaagtcatccgccaaagaagcctgtccagtttggaactgttcctctcctgtgcacagaaacagttaagtgctttaatagctacggaaccagttgacattgaataa

SEQ ID NO: 10066 - DNA, 266 bp, synthetic construct
  misc_feature 1..266: note = Synthetic polypeptide
  source 1..266: mol_type = other DNA
ctacctttctaacagatcctttgttttgtttaggcttctaaccctcctttatgtgactcagagaaaggagacctcattccaagttccaggattaattctgtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagca

SEQ ID NO: 10067 - DNA, 795 bp, synthetic construct
  misc_feature 1..795: note = Synthetic polypeptide
  source 1..795: mol_type = other DNA
ctacctttctaacagatcctttgttttgtttaggcttctaaccctcctttatgtgactcagagaaaggagacctcattccaagttccaggattaattctgtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagagtgcccttttttcaatccttcctgcgattggctgcttttag

SEQ ID NO: 10068 - DNA, 1078 bp, synthetic construct
  misc_feature 1..1078: note = Synthetic polypeptide
  source 1..1078: mol_type = other DNA
ctacctttctaacagatcctttgttttgtttaggcttctaaccctcctttatgtgactcagagaaaggagacctcattccaagttccaggattaattctgtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaa

SEQ ID NO: 10069 - DNA, 229 bp, synthetic construct; identical to SEQ ID NO: 7242
  misc_feature 1..229: note = Synthetic polypeptide
  source 1..229: mol_type = other DNA

SEQ ID NO: 10070 - DNA, 223 bp, synthetic construct
  misc_feature 1..223: note = Synthetic polypeptide
  source 1..223: mol_type = other DNA
caaagtggtgaataataaggctccacacccagatggccgaggttcaaatcccagctctgccgcttgaaggctgtgggatcttagggctcacccttcagaggacaatgacttttacatcaactacaaggacatcgacctggcttcccagcctgtctactgtaacctgcagtcactgggccaggccccaatggatgaagaggagtacgtgatccccgggcactga

SEQ ID NO: 10071 - DNA, 888 bp, synthetic construct; identical to SEQ ID NO: 9660
  misc_feature 1..888: note = Synthetic polypeptide
  source 1..888: mol_type = other DNA

SEQ ID NO: 10072 - DNA, 1254 bp, synthetic construct; identical to SEQ ID NO: 9661
  misc_feature 1..1254: note = Synthetic polypeptide
  source 1..1254: mol_type = other DNA

SEQ ID NO: 10073 - DNA, 1104 bp, synthetic construct; identical to SEQ ID NO: 9662
  misc_feature 1..1104: note = Synthetic polypeptide
  source 1..1104: mol_type = other DNA

SEQ ID NO: 10074 - DNA, 1195 bp, synthetic construct
  misc_feature 1..1195: note = Synthetic polypeptide
  source 1..1195: mol_type = other DNA
tgatatggtttggctgtgttcccacccaaatctcatcttgaatttccacaggttgtgggagggacccagtgggaggtaattgaaccatggaggcaggtctttcctatgctgttctcctgatagtgaataagtctcccaagatctggtgttttttaaaaaaggagagttttcctgcacaagctatctctgcctgctgccattcatgtaagatgtgacttgctcctccttgccttctgccaggattgtgaggcatccccagccatgtggaactcaaagttccaatggtcctgtaaagaagtccatgcgtgagaaggctgttgagagaaggagtgtcaataaagagcacaacagtaactttaaagctggatacattccgattgatgaagatcgtctccacaaaacagggttgagaggaagaaagggcaatttagccatctgtgtgattatcctcttgtttatcctggctgtcatcaatttaataataacacttgttatttgggccgtgattcgcattggaccaaatggctgtgatagtatggagtttcatgaaagtggcctgcttcgatttaagcaagtatctgacatgggagtgatccaccctctttataaaagcacagtaggaggaaggcgaaatgaaaatttggtcatcactggcaacaaccagcctattgtttttcagcaagggacaacaaagctcagtgtagaaaacaacaaaacttctattacaagtgacatcggcatgcagttttttgacccgaggactcaaaatatcttattcagcacagactatgaaactcatgagtttcatttgccaagtggagtgaaaagtttgaatgttcaaaaggcatctactgaaaggattaccagcaatgctaccagtgatttaaatataaaagttgatgggcgtgctattgtgcgtggaaatgaaggtgtattcattatgggcaaaaccattgaatttcacatgggtggtaatatggagttaaaggcggaaaacagtatcatcctaaatggatctgtgatggtcagcaccacccgcctacccagttcctccagtggagaccagttgggtagtggtgactgggtacgctacaagctctgcatgtgtgctgatgggacgctcttcaaggtgcaagtaaccagccagaacatgggctgccaaatctcagacaacccctgtggaaacactcattaa

SEQ ID NO: 10075 - DNA, 553 bp, synthetic construct
  misc_feature 1..553: note = Synthetic polypeptide
  source 1..553: mol_type = other DNA
tgatatggtttggctgtgttcccacccaaatctcatcttgaatttccacaggttgtgggagggacccagtgggaggtaattgaaccatggaggcaggtctttcctatgctgttctcctgatagtgaataagtctcccaagatctggtgttttttaaaaaaggagagttttcctgcacaagctatctctgcctgctgccattcatgtaagatgtgacttgctcctccttgccttctgccaggattgtgaggcatccccagccatgtggaactcaaagttccaatggtcctgtaaagaagtccatgcgtgagaaggctgttgagagaaggagtgtcaataaagagcacaacagtaactttaaagctggatacattccgattgatgaagatcgtctccacaaaacagggttgagaggaagaaagggcaatttagccatctgtgtgattatcctcttgtttatcctggctgtcatcaatttaatactccctggcagccaggcaagagacagaagagccttctctgggattcctgatgcatatagaaaaaagatctga

SEQ ID NO: 10076 - DNA, 1033 bp, synthetic construct; identical to SEQ ID NO: 9698
  misc_feature 1..1033: note = Synthetic polypeptide
  source 1..1033: mol_type = other DNA

SEQ ID NO: 10077 - DNA, 961 bp, synthetic construct; identical to SEQ ID NO: 9699
  misc_feature 1..961: note = Synthetic polypeptide
  source 1..961: mol_type = other DNA

SEQ ID NO: 10078 - DNA, 709 bp, synthetic construct; identical to SEQ ID NO: 9700
  misc_feature 1..709: note = Synthetic polypeptide
  source 1..709: mol_type = other DNA

SEQ ID NO: 10079 - DNA, 431 bp, synthetic construct; identical to SEQ ID NO: 9701
  misc_feature 1..431: note = Synthetic polypeptide
  source 1..431: mol_type = other DNA

SEQ ID NO: 10080 - DNA, 721 bp, synthetic construct
  misc_feature 1..721: note = Synthetic polypeptide
  source 1..721: mol_type = other DNA
gggatccgaagtagagcttccaacgaccctcaggagcgctgagcgaccaagtgaagtacctacaggacccatttgtgttcactgatctattggagcagctggggattgtggtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgaggtctcactccatcggttactccattcgccattccataagtatgcctgctatgaggaattctcctactttcaaatcatttgaggagagggttgagacaactgtcacaagcctcaagacgaaagtaggcggtacgaaccctaatggaggcagttttgaggaggtcctcagctccacggcccatgccagtgcccagagcttggcaggaggctcccggcggaccaaggaggaggagctgcagtgctaa

SEQ ID NO: 10081 - DNA, 706 bp, synthetic construct
  misc_feature 1..706: note = Synthetic polypeptide
  source 1..706: mol_type = other DNA
gggatccgaagtagagcttccaacgaccctcaggagcgctgagcgaccaagtgaagtacctacaggacccatttgtgttcactgatctattggagcagctggggattgtggtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagttactccattcgccattccataagtatgcctgctatgaggaattctcctactttcaaatcatttgaggagagggttgagacaactgtcacaagcctcaagacgaaagtaggcggtacgaaccctaatggaggcagttttgaggaggtcctcagctccacggcccatgccagtgcccagagcttggcaggaggctcccggcggaccaaggaggaggagctgcagtgctaa

SEQ ID NO: 10082 - DNA, 526 bp, synthetic construct
  misc_feature 1..526: note = Synthetic polypeptide
  source 1..526: mol_type = other DNA
gggatccgaagtagagcttccaacgaccctcaggagcgctgagcgaccaagtgaagtacctacaggacccatttgtgttcactgatctattggagcagctggggattgtggtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagttactccattcgccattccataagtatgcctgctatgagacgaaagtag

SEQ ID NO: 10083 - DNA, 487 bp, synthetic construct
  misc_feature 1..487: note = Synthetic polypeptide
  source 1..487: mol_type = other DNA
gggatccgaagtagagcttccaacgaccctcaggagcgctgagcgaccaagtgaagtacctacaggacccatttgtgttcactgatctattggagcagctggggattgtggtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagacgaaagtag

SEQ ID NO: 10084 - DNA, 667 bp, synthetic construct
  misc_feature 1..667: note = Synthetic polypeptide
  source 1..667: mol_type = other DNA
gggatccgaagtagagcttccaacgaccctcaggagcgctgagcgaccaagtgaagtacctacaggacccatttgtgttcactgatctattggagcagctggggattgtggtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgaggaattctcctactttcaaatcatttgaggagagggttgagacaactgtcacaagcctcaagacgaaagtaggcggtacgaaccctaatggaggcagttttgaggaggtcctcagctccacggcccatgccagtgcccagagcttggcaggaggctcccggcggaccaaggaggaggagctgcagtgctaa

SEQ ID NO: 10085 - DNA, 592 bp, synthetic construct
  misc_feature 1..592: note = Synthetic polypeptide
  source 1..592: mol_type = other DNA
gggatccgaagtagagcttccaacgaccctcaggagcgctgagcgaccaagtgaagtacctacaggacccatttgtgttcactgatctattggagcagctggggattgtggtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagttactccattcgccattccataagtatgcctgctatgaggaattctcctactttcaaatcatttgaggagagggttgagacaactgtcacaagcctcaaggtacagatgaagtga

SEQ ID NO: 10086 - DNA, 1420 bp, synthetic construct; identical to SEQ ID NO: 9697
  misc_feature 1..1420: note = Synthetic polypeptide
  source 1..1420: mol_type = other DNA

SEQ ID NO: 10087 - DNA, 913 bp, synthetic construct
  misc_feature 1..913: note = Synthetic polypeptide
  source 1..913: mol_type = other DNA
ggcacaacaggggaagctgcagatgtgggtcgacctatttccgaaggccctggggcggcctggacctcccttcaacatcaccccacggagagccagaaggtttttcctgcgttgtattatctggaataccagagatgtgatcctggatgacctgagcctcacgggggagaagatgagcgacatttatgtgaaaggttggatgattggctttgaagaacacaagcaaaagacagacgtgcattatcgttccctgggaggtgaaggcaacttcaactggaggttcattttccccttcgactacctgccagctgagcaagtctgtaccattgccaagaaggatgccttctggaggctggacaagactgagagcaaaatcccagcacgagtggtgttccagatctgggacaatgacaagttctcctttgatgattttctgggctccctgcagctcgatctcaaccgcatgcccaagccagccaagacagccaagaagtgctccttggaccagctggatgatgctttccacccagaatggtttgtgtccctttttgagcagaaaacagtgaagggctggtggccctgtgtagcagaagagggtgagaagaaaatactggcgggcaagctggaaatgaccttggagattgtagcagagagtgagcatgaggagcggcctgctggccagggccgggatgagcccaacatgaaccctaagcttgaggacccaaggcgccccgacacctccttcctgtggtttacctccccatacaagaccatgaagttcatcctgtggcggcgtttccggtgggccatcatcctcttcatcatcctcttcatcctgctgctgttcctggccatcttcatctacgccttcccgaactatgctgccatgaagctggtgaagcccttcagctga

SEQ ID NO: 10088 - DNA, 321 bp, synthetic construct
  misc_feature 1..321: note = Synthetic polypeptide
  source 1..321: mol_type = other DNA
aagtgggtgaatcacctgaggtcaggcattcgagaccagcctggccaacatagtgaaaaccctcctcttctgaaaatgcaaaaattagcggggcatggtggcacatgcctgtaatctcagctactcgggagactgaagcaggagaatagcttgaacccaggaggcagatgtggcagtgagacgagattgtgccattgcactccagcctgggcgacagagaacatggacgttttgttctcatttcgtgatggagactgcagtaaaggattcttcctggtctctctattggtggaaatagcagctgcttctgcaatcaaagta

SEQ ID NO: 10089 - DNA, 993 bp, synthetic construct
  misc_feature 1..993: note = Synthetic polypeptide
  source 1..993: mol_type = other DNA
aagtgggtgaatcacctgaggtcaggcattcgagaccagcctggccaacatagtgaaaaccctcctcttctgaaaatgcaaaaattagcggggcatggtggcacatgcctgtaatctcagctactcgggagactgaagcaggagaatagcttgaacccaggaggcagatgtggcagtgagacgagattgtgccattgcactccagcctgggcgacagagaacatggacgttttgttctcatttcgtgatggagactgcagtaaaggattcttcctggtctctctattggtggaaatagcagctgcttctgcaatcaaagtaattcctactgtattcaaggcaatgcaaatgcaagaacgggacactttgctaaaggcgctgttggaaatagcttcttgcttggagaaagcccttcaagtgtttcaccaaatccacgatcatgtgaacccaaaagcatttttcagtgttcttcgcatatatttgtctggctggaaaggcaacccccagctatcagacggtctggtgtatgaagggttctgggaagacccaaaggagtttgcagggggcagtgcaggccaaagcagcgtctttcagtgctttgacgtcctgctgggcatccagcagactgctggtggaggacatgctgctcagttcctccaggacatgagaagatatatgccaccagctcacaggaacttcctgtgctcattagagtcaaatccctcagtccgtgagtttgtcctttcaaaaggtgatgctggcctgcgggaagcttatgacgcctgtgtgaaagctctggtctccctgaggagctaccatctgcaaatcgtgactaagtacatcctgattcctgcaagccagcagccaaaggagaataagacctctgaagacccttcaaaactggaagccaaaggaactggaggcactgatttaatgaatttcctgaagactgtaagaagtacaactgagaaatcccttttgaaggaaggttaa

SEQ ID NO: 10090 - DNA, 298 bp, synthetic construct
  misc_feature 1..298: note = Synthetic polypeptide
  source 1..298: mol_type = other DNA
aagtgggtgaatcacctgaggtcaggcattcgagaccagcctggccaacatagtgaaaaccctcctcttctgaaaatgcaaaaattagcggggcatggtggcacatgcctgtaatctcagctactcgggagactgaagcaggagaatagcttgaacccaggaggcagatgtggcagtgagacgagattgtgccattgcactccagcctgggcgacagagaacatggacgttttgttctcatttcgtgatggagactgcagtaaaggattcttcctggtctctctattggtggaaatag

SEQ ID NO: 10091 - DNA, 1079 bp, synthetic construct; identical to SEQ ID NO: 7188
  misc_feature 1..1079: note = Synthetic polypeptide
  source 1..1079: mol_type = other DNA

SEQ ID NO: 10092 - DNA, 1077 bp, synthetic construct; identical to SEQ ID NO: 9663
  misc_feature 1..1077: note = Synthetic polypeptide
  source 1..1077: mol_type = other DNA

SEQ ID NO: 10093 - DNA, 684 bp, synthetic construct; identical to SEQ ID NO: 9664
  misc_feature 1..684: note = Synthetic polypeptide
  source 1..684: mol_type = other DNA

SEQ ID NO: 10094 - DNA, 1764 bp, synthetic construct; identical to SEQ ID NO: 9665
  misc_feature 1..1764: note = Synthetic polypeptide
  source 1..1764: mol_type = other DNA

SEQ ID NO: 10095 - DNA, 1716 bp, synthetic construct; identical to SEQ ID NO: 9666
  misc_feature 1..1716: note = Synthetic polypeptide
  source 1..1716: mol_type = other DNA

SEQ ID NO: 10096 - DNA, 852 bp, synthetic construct; identical to SEQ ID NO: 9667
  misc_feature 1..852: note = Synthetic polypeptide
  source 1..852: mol_type = other DNA

SEQ ID NO: 10097 - DNA, 866 bp, synthetic construct; identical to SEQ ID NO: 9659
  misc_feature 1..866: note = Synthetic polypeptide
  source 1..866: mol_type = other DNA

SEQ ID NO: 10098 - DNA, 3649 bp, synthetic construct
  misc_feature 1..3649: note = Synthetic polypeptide
  source 1..3649: mol_type = other DNA
tggaaatttaaaatgtgattgggaaaataaacattgaattgaaggattagaaaataatgttgaagaaaaacctaccagaacaacaaaaaagaaatgaaacataggagagaaatatcagaaaactagaggatcaatgcacaaaggccaacagtggattggaatattaagagttccaaaaagagaacagaggaaaagatgaggaagaaattaaggatgaactaacgtaagaaaatttgccaaaacagagaatgagtcttcaatgctaaaaggttgactgagttcccaaaaaagacccgtcctaaggcacatcagtgtgaaattcaggacactgttattaaggagaagatcctaaaagtttccagagcctaaagaaaaaaagaaaaagaaaatgtcatcagagtcctcaatagcaatgctggaacctagaagacaatggaggaataaatgcctttaaaattccaagtgaaaattattttcaacctagaatttggtatcaaaactaccaatcaagtatgaagagagaataaatcagacatgcaagaatttgaaaaattgatctaccatgttccttttcctaggaagatactggagatgtgttccaccaaaataagcgaataaatcaagaaagagggaaacatgcgattcggaaagcaggagaggaaagaaggccacagagtgggcctccagtgaggacacgcgccgctcctgccaaagcaaagggaagactgaggaggagtgtcagaactacgtgcgagtcctgatcgtcgccggccggaaggtgttcatgtgtggaaccaatgccttttcccccatgtgcaccagcagacaggtggggaacctcagccggactattgagaagatcaatggtgtggcccgctgcccctatgacccacgccacaactccacagctgtcatctcctcccagggggagctctatgcagccacggtcatcgacttctcaggtcgggaccctgccatctaccgcagcctgggcagtgggccaccgcttcgcactgcccaatataactccaagtggcttaatgagccaaacttcgtggcagcctatgatattgggctgtttgcatacttcttcctgcgggagaacgcagtggagcacgactgtggacgcaccgtgtactctcgcgtggcccgcgtgtgcaagaatgacgtggggggccgattcctgctggaggacacatggaccacattcatgaaggcccggctcaactgctcccgcccgggcgaggtccccttctactataacgagctgcagagtgccttccacttgccggagcaggacctcatctatggagttttcacaaccaacgtaaacagcatcgcggcttctgctgtctgcgccttcaacctcagtgctatctcccaggctttcaatggcccatttcgctaccaggagaaccccagggctgcctggctccccatagccaaccccatccccaatttccagtgtggcaccctgcctgagaccggtcccaacgagaacctgacggagcgcagcctgcaggacgcgcagcgcctcttcctgatgagcgaggccgtgcagccggtgacacccgagccctgtgtcacccaggacagcgtgcgcttctcacacctcgtggtggacctggtgcaggctaaagacacgctctaccatgtactctacattggcaccgagtcgggcaccatcctgaaggcgctgtccacggcgagccgcagcctccacggctgctacctggaggagctgcacgtgctgccccccgggcgccgcgagcccctgcgcagcctgcgcatcctgcacagcgcccgcgcgctcttcgtggggctgagagacggcgtcctgcgggtcccactggagaggtgcgccgcctaccgcagccagggggcatgcctgggggcccgggacccgtactgtggctgggacgggaagcagcaacgttgcagcacactcgaggacagctccaacatgagcctctggacccagaacatcaccgcctgtcctgtgcggaatgtgacacgggatgggggcttcggcccatggtcaccatggcaaccatgtgagcacttggatggggacaactcaggctcttgcctgtgtcgagctcgatcctgtgattcccctcgaccccgctgtgggggccttgactgcctggggccagccatccacatcgccaactgctccaggaatggggcgtggaccccgtggtcatcgtgggcgctgtgcagcacgtcctgtggcatcggcttccaggtccgccagcgaagttgcagcaaccctgctccccgccacgggggccgcatctgcgtgggcaagagccgggaggaacggttctgtaatgagaacacgccttgcccggtgcccatcttctgggcttcctggggctcctggagcaagtgcagcagcaactgtggagggggcatgcagtcgcggcgtcgggcctgcgagaacggcaactcctgcctgggctgcggcgtggagttcaagacgtgcaaccccgagggctgccccgaagtgcggcgcaacaccccctggacgccgtggctgcccgtgaacgtgacgcagggcggggcacggcaggagcagcggttccgcttcacctgccgcgcgccccttgcagacccgcacggcctgcagttcggcaggagaaggaccgagacgaggacctgtcccgcggacggctccggctcctgcgacaccgacgccctggtggaggtcctcctgcgcagcgggagcacctccccgcacacggtgagcgggggctgggccgcctggggcccgtggtcgtcctgctcccgggactgcgagctgggcttccgcgtccgcaagagaacgtgcactaacccggagccccgcaacgggggcctgccctgcgtgggcgatgctgccgagtaccaggactgcaacccccaggcttgcccagttcggggtgcttggtcctgctggacctcatggtctccatgctcagcttcctgtggtgggggtcactatcaacgcacccgttcctgcaccagccccgcaccctccccaggtgaggacatctgtctcgggctgcacacggaggaggcactatgtgccacacaggcctgcccagaaggctggtcgccctggtctgagtggagtaagtgcactgacgacggagcccagagccgaagccggcactgtgaggagctcctcccagggtccagcgcctgtgctggaaacagcagccagagccgcccctgcccctacagcgagattcccgtcatcctgccagcctccagcatggaggaggccaccgactgtgcagggttcaatctcatccacttggtggccacgggcatctcctgcttcttgggctctgggctcctgaccctagcagtgtacctgtcttgccagcactgccagcgtcagtcccaggagtccacactggtccatcctgccacccccaaccatttgcactacaagggcggaggcaccccgaagaatgaaaagtacacacccatggaattcaagaccctgaacaagaataacttgatccctgatgacagagccaacttctacccattgcagcagaccaatgtgtacacgactacttactacccaagccccctgaacaaacacagcttccggcccgaggcctcacctggacaacggtgcttccccaacagctga

SEQ ID NO: 10099 - DNA, 3478 bp, synthetic construct
  misc_feature 1..3478: note = Synthetic polypeptide
  source 1..3478: mol_type = other DNA
tggaaatttaaaatgtgattgggaaaataaacattgaattgaaggattagaaaataatgttgaagaaaaacctaccagaacaacaaaaaagaaatgaaacataggagagaaatatcagaaaactagaggatcaatgcacaaaggccaacagtggattggaatattaagagttccaaaaagagaacagaggaaaagatgaggaagaaattaaggatgaactaacgtaagaaaatttgccaaaacagagaatgagtcttcaatgctaaaaggttgactgagttcccaaaaaagacccgtcctaaggcacatcagtgtgaaattcaggacactgttattaaggagaagatcctaaaagtttccagagcctaaagaaaaaaagaaaaagaaaatgtcatcagagtcctcaatagcaatgctggaacctagaagacaatggaggaataaatgcctttaaaattccaagtgaaaattattttcaacctagaatttggtatcaaaactaccaatcaagtatgaagagagaataaatcagacatgcaagaatttgaaaaattgatctaccatgttccttttcctaggaagatactggagatgtgttccaccaaaataagcgaataaatcaagaaagagggaaacatgcgattcggaaagcaggagaggaaagaaggccacagagtgggcctccagtgaggacacgcgccgctcctgccaaagcaaagggaagactgaggaggagtgtcagaactacgtgcgagtcctgatcgtcgccggccggaaggtgttcatgtgtggaaccaatgccttttcccccatgtgcaccagcagacaggtggggaacctcagccggactattgagaagatcaatggtgtggcccgctgcccctatgacccacgccacaactccacagctgtcatctcctcccagggggagctctatgcagccacggtcatcgacttctcaggtcgggaccctgccatctaccgcagcctgggcagtgggccaccgcttcgcactgcccaatataactccaagtggcttaatgagccaaacttcgtggcagcctatgatattgggctgtttgcatacttcttcctgcgggagaacgcagtggagcacgactgtggacgcaccgtgtactctcgcgtggcccgcgtgtgcaagaatgacgtggggggccgattcctgctggaggacacatggaccacattcatgaaggcccggctcaactgctcccgcccgggcgaggtccccttctactataacgagctgcagagtgccttccacttgccggagcaggacctcatctatggagttttcacaaccaacgtaaacagcatcgcggcttctgctgtctgcgccttcaacctcagtgctatctcccaggctttcaatggcccatttcgctaccaggagaaccccagggctgcctggctccccatagccaaccccatccccaatttccagtgtggcaccctgcctgagaccggtcccaacgagaacctgacggagcgcagcctgcaggacgcgcagcgcctcttcctgatgagcgaggccgtgcagccggtgacacccgagccctgtgtcacccaggacagcgtgcgcttctcacacctcgtggtggacctggtgcaggctaaagacacgctctaccatgtactctacattggcaccgagtcgggcaccatcctgaaggcgctgtccacggcgagccgcagcctccacggctgctacctggaggagctgcacgtgctgccccccgggcgccgcgagcccctgcgcagcctgcgcatcctgcacagcgcccgcgcgctcttcgtggggctgagagacggcgtcctgcgggtcccactggagaggtgcgccgcctaccgcagccagggggcatgcctgggggcccgggacccgtactgtggctgggacgggaagcagcaacgttgcagcacactcgaggacagctccaacatgagcctctggacccagaacatcaccgcctgtcctgtgcggaatgtgacacgggatgggggcttcggcccatggtcaccatggcaaccatgtgagcacttggatggggacaactcaggctcttgcctgtgtcgagctcgatcctgtgattcccctcgaccccgctgtgggggccttgactgcctggggccagccatccacatcgccaactgctccaggaatggggcgtggaccccgtggtcatcgtgggcgctgtgcagcacgtcctgtggcatcggcttccaggtccgccagcgaagttgcagcaaccctgctccccgccacgggggccgcatctgcgtgggcaagagccgggaggaacggttctgtaatgagaacacgccttgcccggtgcccatcttctgggcttcctggggctcctggagcaagtgcagcagcaactgtggagggggcatgcagtcgcggcgtcgggcctgcgagaacggcaactcctgcctgggctgcggcgtggagttcaagacgtgcaaccccgagggctgccccgaagtgcggcgcaacaccccctggacgccgtggctgcccgtgaacgtgacgcagggcggggcacggcaggagcagcggttccgcttcacctgccgcgcgccccttgcagacccgcacggcctgcagttcggcaggagaaggaccgagacgaggacctgtcccgcggacggctccggctcctgcgacaccgacgccctggtggaggtcctcctgcgcagcgggagcacctccccgcacacggtgagcgggggctgggccgcctggggcccgtggtcgtcctgctcccgggactgcgagctgggcttccgcgtccgcaagagaacgtgcactaacccggagccccgcaacgggggcctgccctgcgtgggcgatgctgccgagtaccaggactgcaacccccaggcttgcccagttcggggtgcttggtcctgctggacctcatggtctccatgctcagcttcctgtggtgggggtcactatcaacgcacccgttcctgcaccagccccgcaccctccccaggtgaggacatctgtctcgggctgcacacggaggaggcactatgtgccacacaggcctgcccagaaggctggtcgccctggtctgagtggagtaagtgcactgacgacggagcccagagccgaagccggcactgtgaggagctcctcccagggtccagcgcctgtgctggaaacagcagccagagccgcccctgcccctacagcgagattcccgtcatcctgccagcctccagcatggaggaggccaccgactgtgcaggtaaaagaaaccggacctacctcatgctgcggtcctcccagccctccggcaccccactccaaagtctggactctttccacatcctgctccagacagccaagctttgttggggtccccactgctttgagatgggttcaatctcatccacttggtggccacgggcatctcctgcttcttgggctctgggctcctga

SEQ ID NO: 10100 - DNA, 3472 bp, synthetic construct
  misc_feature 1..3472: note = Synthetic polypeptide
  source 1..3472: mol_type = other DNA
tggaaatttaaaatgtgattgggaaaataaacattgaattgaaggattagaaaataatgttgaagaaaaacctaccagaacaacaaaaaagaaatgaaacataggagagaaatatcagaaaactagaggatcaatgcacaaaggccaacagtggattggaatattaagagttccaaaaagagaacagaggaaaagatgaggaagaaattaaggatgaactaacgtaagaaaatttgccaaaacagagaatgagtcttcaatgctaaaaggttgactgagttcccaaaaaagacccgtcctaaggcacatcagtgtgaaattcaggacactgttattaaggagaagatcctaaaagtttccagagcctaaagaaaaaaagaaaaagaaaatgtcatcagagtcctcaatagcaatgctggaacctagaagacaatggaggaataaatgcctttaaaattccaagtgaaaattattttcaacctagaatttggtatcaaaactaccaatcaagtatgaagagagaataaatcagacatgcaagaatttgaaaaattgatctaccatgttccttttcctaggaagatactggagatgtgttccaccaaaataagcgaataaatcaagaaagagggaaacatgcgattcggaaagcaggagaggaaagaaggccacagagtgggcctccagtgaggacacgcgccgctcctgccaaagcaaagggaagactgaggaggagtgtcagaactacgtgcgagtcctgatcgtcgccggccggaaggtgttcatgtgtggaaccaatgccttttcccccatgtgcaccagcagacaggtggggaacctcagccggactattgagaagatcaatggtgtggcccgctgcccctatgacccacgccacaactccacagctgtcatctcctcccagggggagctctatgcagccacggtcatcgacttctcaggtcgggaccctgccatctaccgcagcctgggcagtgggccaccgcttcgcactgcccaatataactccaagtggcttaatgagccaaacttcgtggcagcctatgatattgggctgtttgcatacttcttcctgcgggagaacgcagtggagcacgactgtggacgcaccgtgtactctcgcgtggcccgcgtgtgcaagaatgacgtggggggccgattcctgctggaggacacatggaccacattcatgaaggcccggctcaactgctcccgcccgggcgaggtccccttctactataacgagctgcagagtgccttccacttgccggagcaggacctcatctatggagttttcacaaccaacgtaaacagcatcgcggcttctgctgtctgcgccttcaacctcagtgctatctcccaggctttcaatggcccatttcgctaccaggagaaccccagggctgcctggctccccatagccaaccccatccccaatttccagtgtggcaccctgcctgagaccggtcccaacgagaacctgacggagcgcagcctgcaggacgcgcagcgcctcttcctgatgagcgaggccgtgcagccggtgacacccgagccctgtgtcacccaggacagcgtgcgcttctcacacctcgtggtggacctggtgcaggctaaagacacgctctaccatgtactctacattggcaccgagtcgggcaccatcctgaaggcgctgtccacggcgagccgcagcctccacggctgctacctggaggagctgcacgtgctgccccccgggcgccgcgagcccctgcgcagcctgcgcatcctgcacagcgcccgcgcgctcttcgtggggctgagagacggcgtcctgcgggtcccactggagaggtgcgccgcctaccgcagccagggggcatgcctgggggcccgggacccgtactgtggctgggacgggaagcagcaacgttgcagcacactcgaggacagctccaacatgagcctctggacccagaacatcaccgcctgtcctgtgcggaatgtgacacgggatgggggcttcggcccatggtcaccatggcaaccatgtgagcacttggatggggacaactcaggctcttgcctgtgtcgagctcgatcctgtgattcccctcgaccccgctgtgggggccttgactgcctggggccagccatccacatcgccaactgctccaggaatggggcgtggaccccgtggtcatcgtgggcgctgtgcagcacgtcctgtggcatcggcttccaggtccgccagcgaagttgcagcaaccctgctccccgccacgggggccgcatctgcgtgggcaagagccgggaggaacggttctgtaatgagaacacgccttgcccggtgcccatcttctgggcttcctggggctcctggagcaagtgcagcagcaactgtggagggggcatgcagtcgcggcgtcgggcctgcgagaacggcaactcctgcctgggctgcggcgagttcaagacgtgcaaccccgagggctgccccgaagtgcggcgcaacaccccctggacgccgtggctgcccgtgaacgtgacgcagggcggggcacggcaggagcagcggttccgcttcacctgccgcgcgccccttgcagacccgcacggcctgcagttcggcaggagaaggaccgagacgaggacctgtcccgcggacggctccggctcctgcgacaccgacgccctggtggaggtcctcctgcgcagcgggagcacctccccgcacacggtgagcgggggctgggccgcctggggcccgtggtcgtcctgctcccgggactgcgagctgggcttccgcgtccgcaagagaacgtgcactaacccggagccccgcaacgggggcctgccctgcgtgggcgatgctgccgagtaccaggactgcaacccccaggcttgcccagttcggggtgcttggtcctgctggacctcatggtctccatgctcagcttcctgtggtgggggtcactatcaacgcacccgttcctgcaccagccccgcaccctccccaggtgaggacatctgtctcgggctgcacacggaggaggcactatgtgccacacaggcctgcccaggctggtcgccctggtctgagtggagtaagtgcactgacgacggagcccagagccgaagccggcactgtgaggagctcctcccagggtccagcgcctgtgctggaaacagcagccagagccgcccctgcccctacagcgagattcccgtcatcctgccagcctccagcatggaggaggccaccgactgtgcaggtaaaagaaaccggacctacctcatgctgcggtcctcccagccctccggcaccccactccaaagtctggactctttccacatcctgctccagacagccaagctttgttggggtccccactgctttgagatgggttcaatctcatccacttggtggccacgggcatctcctgcttcttgggctctgggctcctga

SEQ ID NO: 10101 - DNA, 3457 bp, synthetic construct
  misc_feature 1..3457: note = Synthetic polypeptide
  source 1..3457: mol_type = other DNA
tggaaatttaaaatgtgattgggaaaataaacattgaattgaaggattagaaaataatgttgaagaaaaacctaccagaacaacaaaaaagaaatgaaacataggagagaaatatcagaaaactagaggatcaatgcacaaaggccaacagtggattggaatattaagagttccaaaaagagaacagaggaaaagatgaggaagaaattaaggatgaactaacgtaagaaaatttgccaaaacagagaatgagtcttcaatgctaaaaggttgactgagttcccaaaaaagacccgtcctaaggcacatcagtgtgaaattcaggacactgttattaaggagaagatcctaaaagtttccagagcctaaagaaaaaaagaaaaagaaaatgtcatcagagtcctcaatagcaatgctggaacctagaagacaatggaggaataaatgcctttaaaattccaagtgaaaattattttcaacctagaatttggtatcaaaactaccaatcaagtatgaagagagaataaatcagacatgcaagaatttgaaaaattgatctaccatgttccttttcctaggaagatactggagatgtgttccaccaaaataagcgaataaatcaagaaagagggaaacatgcgattcggaaagcaggagaggaaagaaggccacagagtgggcctccagtgaggacacgcgccgctcctgccaaagcaaagggaagactgaggaggagtgtcagaactacgtgcgagtcctgatcgtcgccggccggaaggtgttcatgtgtggaaccaatgccttttcccccatgtgcaccagcagacaggtggggaacctcagccggactattgagaagatcaatggtgtggcccgctgcccctatgacccacgccacaactccacagctgtcatctcctcccagggggagctctatgcagccacggtcatcgacttctcaggtcgggaccctgccatctaccgcagcctgggcagtgggccaccgcttcgcactgcccaatataactccaagtggcttaatgagccaaacttcgtggcagcctatgatattgggctgtttgcatacttcttcctgcgggagaacgcagtggagcacgactgtggacgcaccgtgtactctcgcgtggcccgcgtgtgcaagaatgacgtggggggccgattcctgctggaggacacatggaccacattcatgaaggcccggctcaactgctcccgcccgggcgaggtccccttctactataacgagctgcagagtgccttccacttgccggagcaggacctcatctatggagttttcacaaccaacgtaaacagcatcgcggcttctgctgtctgcgccttcaacctcagtgctatctcccaggctttcaatggcccatttcgctaccaggagaaccccagggctgcctggctccccatagccaaccccatccccaatttccagtgtggcaccctgcctgagaccggtcccaacgagaacctgacggagcgcagcctgcaggacgcgcagcgcctcttcctgatgagcgaggccgtgcagccggtgacacccgagccctgtgtcacccaggacagcgtgcgcttctcacacctcgtggtggacctggtgcaggctaaagacacgctctaccatgtactctacattggcaccgagtcgggcaccatcctgaaggcgctgtccacggcgagccgcagcctccacggctgctacctggaggagctgcacgtgctgccccccgggcgccgcgagcccctgcgcagcctgcgcatcctgcacagcgcccgcgcgctcttcgtggggctgagagacggcgtcctgcgggtcccactggagaggtgcgccgcctaccgcagccagggggcatgcctgggggcccgggacccgtactgtggctgggacgggaagcagcaacgttgcagcacactcgaggacagctccaacatgagcctctggacccagaacatcaccgcctgtcctgtgcggaatgtgacacgggatgggggcttcggcccatggtcaccatggcaaccatgtgagcacttggatggggacaactcaggctcttgcctgtgtcgagctcgatcctgtgattcccctcgaccccgctgtgggggccttgactgcctggggccagccatccacatcgccaactgctccaggaatggggcgtggaccccgtggtcatcgtgggcgctgtgcagcacgtcctgtggcatcggcttccaggtccgccagcgaagttgcagcaaccctgctccccgccacgggggccgcatctgcgtgggcaagagccgggaggaacggttctgtaatgagaacacgccttgcccggtgcccatcttctgggcttcctggggctcctggagcaagtgcagcagcaactgtggagggggcatgcagtcgcggcgtcgggcctgcgagaacggcaactcctgcctgggctgcggcgtggagttcaagacgtgcaaccccgagggctgccccgaagtgcggcgcaacaccccctggacgccgtggctgcccgtgaacgtgacgcagggcggggcacggcaggagcagcggttccgcttcacctgccgcgcgccccttgcagacccgcacggcctgcagttcggcaggagaaggaccgagacgaggacctgtcccgcggacggctccggctcctgcgacaccgacgccctggtggaggtcctcctgcgcagcgggagcacctccccgcacacggtgagcgggggctgggccgcctggggcccgtggtcgtcctgctcccgggactgcgagctgggcttccgcgtccgcaagagaacgtgcactaacccggagccccgcaacgggggcctgccctgcgtgggcgatgctgccgagtaccaggactgcaacccccaggcttgcccagttcggggtgcttggtcctgctggacctcatggtctccatgctcagcttcctgtggtgggggtcactatcaacgcacccgttcctgcaccagccccgcaccctccccaggtgaggacatctgtctcgggctgcacacggaggaggcactatgtgccacacaggcctgcccagaaggctggtcgccctggtctgagtggagtaagtgcactgacgacggagcccagagccgaagccggcactgtgaggagctcctcccagggtccagcgcctgtgctggaaacagcagccagagccgcccctgcccctacagcgagattcccgtcatcctgccagcctccagcatggaggaggccaccgactgtgcagggttcaatctcatccacttggtggccacgggcatctcctgcttcttgggctctgggctcctgaccctagcagtgtacctgtcttgccagcactgccagcgtcagtcccaggagtccacactggtccatcctgccacccccaaccatttgcactacaagggcggaggcaccccg

SEQ ID NO: 10102 - DNA, 906 bp, synthetic construct; identical to SEQ ID NO: 9877
  misc_feature 1..906: note = Synthetic polypeptide
  source 1..906: mol_type = other DNA

SEQ ID NO: 10103 - DNA, 255 bp, synthetic construct; identical to SEQ ID NO: 9878
  misc_feature 1..255: note = Synthetic polypeptide
  source 1..255: mol_type = other DNA

SEQ ID NO: 10104 - DNA, 255 bp, synthetic construct; identical to SEQ ID NO: 9879
  misc_feature 1..255: note = Synthetic polypeptide
  source 1..255: mol_type = other DNA

SEQ ID NO: 10105 - DNA, 1029 bp, synthetic construct; identical to SEQ ID NO: 9690
  misc_feature 1..1029: note = Synthetic polypeptide
  source 1..1029: mol_type = other DNA

SEQ ID NO: 10106 - DNA, 957 bp, synthetic construct; identical to SEQ ID NO: 9691
  misc_feature 1..957: note = Synthetic polypeptide
  source 1..957: mol_type = other DNA

SEQ ID NO: 10107 - DNA, 705 bp, synthetic construct; identical to SEQ ID NO: 9692
  misc_feature 1..705: note = Synthetic polypeptide
  source 1..705: mol_type = other DNA

SEQ ID NO: 10108 - DNA, 427 bp, synthetic construct; identical to SEQ ID NO: 9693
  misc_feature 1..427: note = Synthetic polypeptide
  source 1..427: mol_type = other DNA

SEQ ID NO: 10109 - DNA, 996 bp, synthetic construct
  misc_feature 1..996: note = Synthetic polypeptide
  source 1..996: mol_type = other DNA
cataaaaggcaaaaattggtaaattggacctcatcaaaataaaaaatacttgctctatgaaagaccttcttaagaggatgaaaagaaaagctacaaactgggagaaaatatttgcaaaccacatgtccaacaaaggacttttatctagaacatagaaagaactcagaacccaacagtaaaaagcccaagaaatccaattagaaaattcatgaacagatatttcatcaaaagataaaagataaacagatgaaagaagaagtaaatgaatgtggtgaaagtattgacagaaataatctgaaacggtcacaaagccatcttccttactttactcctaaaccacctcaagatagtgcggttatcaaagctggatattgtgtaaaacaaggagcagtgatgaaaaactggaagagaagatattttcaattggatgaaaacacaataggctacttcaaatctgaactggaaaaggaacctcttcgtgtaataccacttaaagaggttcataaagtccaggaatgtaagcaaagcgacataatgatgagggacaacctctttgaaattgtaacaacgtctcgaactttctatgtgcaggctgatagccctgaagagatgcacagttggattaaagcagtctctggcgccattgtagcacagcggggtcccggcagatctgcgtcttctgagcatccccccggtccttcagaatccaaacacgctttccgtcctaccaacgcagccaccgccacctcacattccacagcctctcgcagcaactctttggtctcaacctttaccatggagaagcgaggattttacgagtctcttgccaaggtcaagccagggaacttcaaggtccagactgtctctccaagagaaccagcttccaaagtgactgaacaagctctgttaagacctcaaagtaaaaatggccctcaggaaaaagattgtgacctagtagacttggacgatgcgagccttccggtcagtgacgtgtga

SEQ ID NO: 10110 - DNA, 933 bp, synthetic construct
  misc_feature 1..933: note = Synthetic polypeptide
  source 1..933: mol_type = other DNA
cataaaaggcaaaaattggtaaattggacctcatcaaaataaaaaatacttgctctatgaaagaccttcttaagaggatgaaaagaaaagctacaaactgggagaaaatatttgcaaaccacatgtccaacaaaggacttttatctagaacatagaaagaactcagaacccaacagtaaaaagcccaagaaatccaattagaaaattcatgaacagatatttcatcaaaagataaaagataaacagatgaaagaagaagtaaatgaatgtggtgaaagtattgacagaaataatctgaaacggtcacaaagccatcttccttactttactcctaaaccacctcaagatagtgcggttatcaaagctggatattgtgtaaaacaaggagcagtgatgaaaaactggaagagaagatattttcaattggatgaaaacacaataggctacttcaaatctgaactggaaaaggaacctcttcgtgtaataccacttaaagaggttcataaagtccaggaatgtaagcaaagcgacataatgatgagggacaacctctttgaaattgtaacaacgtctcgaactttctatgtgcaggctgatagccctgaagagatgcacagttggattaaagcagtctctggcgccattgtagcacagcggggtcccggcagatctgcgtcttctatgcggcaggccagaaggctgtcgaacccttgtatacagaggagcatccccccggtccttcagaatccaaacacgctttccgtcctaccaacgcagccaccgccacctcacattccacagcctctcgcagcaactctttggtctcaacctttaccatggagaagcgaggattttacgagtctcttgccaaggtcaagccagggaacttcaaggtccagactgtctctccaagagaaccagcttccaaagtga

SEQ ID NO: 10111 - DNA, 786 bp, synthetic construct
  misc_feature 1..786: note = Synthetic polypeptide
  source 1..786: mol_type = other DNA
cataaaaggcaaaaattggtaaattggacctcatcaaaataaaaaatacttgctctatgaaagaccttcttaagaggatgaaaagaaaagctacaaactgggagaaaatatttgcaaaccacatgtccaacaaaggacttttatctagaacatagaaagaactcagaacccaacagtaaaaagcccaagaaatccaattagaaaattcatgaacagatatttcatcaaaagataaaagataaacagatgaaagaagaagtaaatgaatgtggtgaaagtattgacagaaataatctgaaacggtcacaaagccatcttccttactttactcctaaaccacctcaagatagtgcggttatcaaagctggatattgtgtaaaacaaggagcagtgatgaaaaactggaagagaagatattttcaattggatgaaaacacaataggctacttcaaatctgaactggaaaaggaacctcttcgtgtaataccacttaaagaggttcataaagtccaggaatgtaagcaaagcgacataatgatgagggacaacctctttgaaattgtaacaacgtctcgaactttctatgtgcaggctgatagccctgaagagatgcacagttggattaaagcagtctctggcgccattgtagcacagcggggtcccggcagatctgcgtcttctatgcggcaggccagaaggctgtcgaacccttgtatacagaggtatacatcaagagctggtgaatgcagcacgtatgtgggctctcacgcaaacgtgccttcttag

SEQ ID NO: 10112 - DNA, 342 bp, synthetic construct
  misc_feature 1..342: note = Synthetic polypeptide
  source 1..342: mol_type = other DNA
cagggcttctcagctgtgccgcacagggaccctgggcagtgtctggaggcagccaggtggggtgcttggcatctcaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgag

SEQ ID NO: 10113 - DNA, 1512 bp, synthetic construct
  misc_feature 1..1512: note = Synthetic polypeptide
  source 1..1512: mol_type = other DNA
cagggcttctcagctgtgccgcacagggaccctgggcagtgtctggaggcagccaggtggggtgcttggcatctcaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactcttgtccctttaaaaaatcaaagccgcaccccgcctccctggccagcaagaaacctaaaagggaaacaaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccaggacggcccacctccatggagacggcccacggcctcgccaccaccagccccacctggcctccacttggtggccccagccccgatcccagcgccgccgagctgaccccactctga

SEQ ID NO: 10114 - DNA, 1377 bp, synthetic construct
  misc_feature 1..1377: note = Synthetic polypeptide
  source 1..1377: mol_type = other DNA
cagggcttctcagctgtgccgcacagggaccctgggcagtgtctggaggcagccaggtggggtgcttggcatctcaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgcagtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactctaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccagccctggggcccgactcctgctctgttggtatagacgagtaa

SEQ ID NO: 10115 - DNA, 744 bp, synthetic construct
  misc_feature 1..744: note = Synthetic polypeptide
  source 1..744: mol_type = other DNA
cagggcttctcagctgtgccgcacagggaccctgggcagtgtctggaggcagccaggtggggtgcttggcatctcaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcaactctga

SEQ ID NO: 10116 - DNA, 1564 bp, synthetic construct
  misc_feature 1..1564: note = Synthetic polypeptide
  source 1..1564: mol_type = other DNA
cagggcttctcagctgtgccgcacagggaccctgggcagtgtctggaggcagccaggtggggtgcttggcatctcaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagatctcttggaaagtctcacaggcccgcttcattatggcatctgggcccaggacaactggagcagctccacgtggcgggagcggagcacctggccgggcctcgcctcaacccagggaaccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactcttgtccctttaaaaaatcaaagccgcaccccgcctccctggccagcaagaaacctaaaagggaaacaaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccaggacggcccacctccatggagacggcccacggcctcgccaccaccagcc

SEQ ID NO: 10117 - DNA, 1440 bp, synthetic construct
  misc_feature 1..1440: note = Synthetic polypeptide
  source 1..1440: mol_type = other DNA
cagggcttctcagctgtgccgcacagggaccctgggcagtgtctggaggcagccaggtggggtgcttggcatctcaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactcttgtccctttaaaaaatcaaagccgcaccccgcctccctggccagcaagaaacctaaaagggaaacaaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccagccctggggcccgactcctgctctgttggtatagacgagtaa

SEQ ID NO: 10118 - DNA, 1446 bp, synthetic construct
  misc_feature 1..1446: note = Synthetic polypeptide
  source 1..1446: mol_type = other DNA
cagggcttctcagctgtgccgcacagggaccctgggcagtgtctggaggcagccaggtggggtgcttggcatctcaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactctaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccaggacggcccacctccatggagacggcccacggcctcgccaccaccagccccacctggcctccacttggtggccccagccccgatcccagcgccgccgagctgaccccactctga

SEQ ID NO: 10119 - DNA, 1374 bp, synthetic construct
  misc_feature 1..1374: note = Synthetic polypeptide
  source 1..1374: mol_type = other DNA
cagggcttctcagctgtgccgcacagggaccctgggcagtgtctggaggcagccaggtggggtgcttggcatctcaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactctaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccagccctggggcccgactcctgctctgttggtatagacgagtaa

SEQ ID NO: 10120 - DNA, 885 bp, synthetic construct
  misc_feature 1..885: note = Synthetic polypeptide
  source 1..885: mol_type = other DNA
cagggcttctcagctgtgccgcacagggaccctgggcagtgtctggaggcagccaggtggggtgcttggcatctcaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgcagtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactcttgtccctttaaaaaatcaaagccgcaccccgcctcc

SEQ ID NO: 10121 - DNA, 402 bp, synthetic construct
  misc_feature 1..402: note = Synthetic polypeptide
  source 1..402: mol_type = other DNA
cagggcttctcagctgtgccgcacagggaccctgggcagtgtctggaggcagccaggtggggtgcttggcatctcaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcactacctcctgcaggagatctatggcattgagaacaagaacaaccaggagaccaagccctcggacgacgagaacagcgacaacagcaacgagtgtgtggtgtgcctgtccgac

SEQ ID NO: 10122 - DNA, 1533 bp, synthetic construct; identical to SEQ ID NO: 8543
  misc_feature 1..1533: note = Synthetic polypeptide
  source 1..1533: mol_type = other DNA

SEQ ID NO: 10123 - DNA, 285 bp, synthetic construct; identical to SEQ ID NO: 6932
  misc_feature 1..285: note = Synthetic polypeptide
  source 1..285: mol_type = other DNA

SEQ ID NO: 10124 - DNA, 333 bp, synthetic construct; identical to SEQ ID NO: 6933
  misc_feature 1..333: note = Synthetic polypeptide
  source 1..333: mol_type = other DNA

SEQ ID NO: 10125 - DNA, 207 bp, synthetic construct; identical to SEQ ID NO: 6934
  misc_feature 1..207: note = Synthetic polypeptide
  source 1..207: mol_type = other DNA

SEQ ID NO: 10126 - DNA, 555 bp, synthetic construct; identical to SEQ ID NO: 6935
  misc_feature 1..555: note = Synthetic polypeptide
  source 1..555: mol_type = other DNA

SEQ ID NO: 10127 - DNA, 225 bp, synthetic construct; identical to SEQ ID NO: 6936
  misc_feature 1..225: note = Synthetic polypeptide
  source 1..225: mol_type = other DNA

SEQ ID NO: 10128 - DNA, 2678 bp, synthetic construct
  misc_feature 1..2678: note = Synthetic polypeptide
  source 1..2678: mol_type = other DNA
gcccctcaggtcctcctgcccaggaccaggacatctgcccggccagtgaggatgagagcggacagtggaaaaactttcgactgccggacttcgtcaacccagtccactacgacctgcacgtgaagcccctgttggaggaggacacctacacgggcaccgtgagcatctccatcaacctgagcgctcccacccggtacctgtggctgcacctccgggagaccaggatcacccggctcccggagctgaagaggccctctggggaccaggtgcaagtccggaggtgtttcgagtacaaaaagcaggagtacgtggtggtcgaggcggaggaagagcttacccccagcagtggagatggcctgtatctcctgaccatggagttcgccggctggctgaacggctccctcgtgggattttatagaaccacctacacggagaacggacaagtcaagagcatagtggccaccgatcatgaaccaacagatgccaggaaatcttttccttgttttgatgagcccaacaaaaaggcaacttatacaatatctatcacccatcccaaagaatacggagcactttcaaatatgccagtggcgaaagaagagtcagtggatgataaatggactcgaacaacttttgagaagtctgtccccatgagcacgtacctggtgtgctttgctgtacatcaatttgactctgtaaagagaatatcaaatagtggaaaacctcttacaatttatgtccagccagagcaaaagcacacagccgaatatgctgcaaacataactaaaagtgtgtttgattattttgaagaatactttgctatgaattattctcttcctaaattagataaaatcgctattccagattttggcactggtgccatggagaactggggactcatcacgtacagagaaacgaacctgctttatgaccctaaggaatcagcctcatcaaaccaacagagggtggccactgtggttgcccatgaacttgtgcatcagtggtttggaaatattgtgaccatggactggtgggaagacttgtggctaaatgaaggatttgcttctttctttgagtttctgggagtaaaccatgcagaaacagactggcaaatgcgtgaccaaatgttacttgaagatgtattacctgttcaagaggatgattctttgatgtcttcgcatccaattattgtgactgtgacaacccctgatgaaataacatctgtttttgatggaatatcctatagcaagggatcttctattttgagaatgcttgaagactggataaaaccagagaattttcaaaaaggatgtcagatgtacttggaaaaataccaattcaagaatgcaaaaacttctgatttttgggcagcactggaagaggcaagtaggctaccagtgaaagaagtaatggacacctggaccagacagatgggttatcctgtgcttaacgtgaacggtgtcaagaacatcacacagaaacgctttttgttggacccaagagctaacccttctcagcccccttcagatcttggttatacatggaatatcccagttaaatggactgaagataatataacaagcagtgtgttatttaataggtcagaaaaagaaggaatcactttgaactcctctaatcctagtggaaatgcttttctcaaaataaacccagatcatattgggttttatcgtgtaaattatgaagtagcaacttgggactcgatagctacagcgctctccttgaaccacaagacattttcttcagcagatcgtgcaagtcttattgatgatgcttttgccttggcaagagctcaacttctagattataaggtggctttgaacttgaccaagtatctcaaaagggaagagaattttttaccatggcagagagtaatttcagctgtaacctacatcattagcatgtttgaagatgataaagagctatatcctatgattgaggaatacttccaaggtcaagtgaagcctattgcagattctctgggatggaatgatgctggagaccatgtcacaaagttactccgttcctccgtgttagggtttgcgtgcaagatgggagacagagaagccttgaacaatgcttcctcgttatttgagcagtggctaaatgggactgtaagccttcccgtaaatctcaggcttctggtgtatcggtatgggatgcagaactctggcaatgagatttcatggaactacactcttgagcaataccagaaaacttcattagctcaagaaaaagaaaaactgctgtatggattagcatcagtgaagaacgttactcttttgtcaaggtatttggatttgctcaaggacacgaaccttattaaaactcaggatgtgtttacagtcattcgatatatctcatataacagctatgggaagaacatggcctggaattggatacaactcaactgggactatctagtcaacagatatacactcaataacagaaaccttggccgaattgtcacaatagcagagccattcaacactgaactgcaactgtggcagatggagagcttttttgcaaaatatccacaagctggagcaggagaaaaacctagggaacaagtgctggaaacagtgaaaaacaatatagagtggctaaaacaacatagaaacaccatcagagaatggttttttaatttacttgagagtggttaa

SEQ ID NO: 10129 - DNA, 1334 bp, synthetic construct
  misc_feature 1..1334: note = Synthetic polypeptide
  source 1..1334: mol_type = other DNA
ctttctgagaaacttcatttcccatacataaaatgtttgtgaagaaatatgggaacctttttagcttggagcttggtgacatatctgcagttcttattactggcttgcccttaatcaaagaagcccttatccacatggaccaaaactttgggaaccgccccgtgacccctatgcgagaacatatctttaagaaaaatggattgattatgtcaagtggccaggcatggaaggagcaaagaaggttcactctgacagcactaaggaactttggtttaggaaagaagagcttagaggaacgcattcaggaggaggcccaacacctcactgaagcaataaaagaggagaacggacagccttttgaccctcatttcaagatcaacaatgcagtttccaatatcatttgctccatcaccttcggagaacgctttgagtaccaggatagttggtttcagcagctgctgaagttactagatgaagtcacatacttggaggcttcaaagacatgccagctctacaatgtctttccatggataatgaaattcctgcctggaccccaccaaactctcttcagcaactggaaaaaactgaaattgtttgtttctcatatgattgacaaacacagaaaggattggaatcctgcagaaacaagagactttattgatgcttaccttaaagaaatgtcaaagcacacaggcaatcctacttcaagtttccatgaagaaaacctcatctgcagcaccctggacctcttctttgccggaaccgagacaacttccacaactctgcgatgggctctgctttatatggccctctacccagaaatccaagaaaaagtacaagctgagattgacagagtgattggccaggggcagcagccgagcacagccgcccgggagtccatgccctacaccaatgctgtcatccatgaggtgcagagaatgggcaacatcatccccctgaacgttcccagggaagtgacagttgataccactttggctgggtaccacctgcccaagggtaccatgatcctgaccaatttgacggcgctgcacagggaccccacagagtgggccacccctgacacattcaatccggaccattttctggagaatggacagtttaagaaaagggaagcctttatgcctttctcaataggaaagcgggcatgcctcggagaacagttggccaggactgagctgtttattttcttcacttcccttatgcaaaaatttaccttcaggcccccaaacaatgagaagctgagcctgaagtttagaatgggtatcaccatttccccagtcagtcaccgcctctgcgctgttcctcaggtgtaa

SEQ ID NO: 10130 - DNA, 2408 bp, synthetic construct
  misc_feature 1..2408: note = Synthetic polypeptide
  source 1..2408: mol_type = other DNA
tcatgttacatgacctatcacagacatttgaagtacctactgacttcctcttccctgaaactcttgtccccttggcttccaggacaccgcactctcctggttttcttcttatcccaccacccattccttttcactttcctttgtttgttcctcccccatctattcaacctccaaacactgaagagccccagagttagtctttggttctcttctctatttatttcaatttcccaagttttatggctttaagtatcttctgtaggttattaactcccaatgttatgcctcaactcctacttctcttctaaacttaagaactgtatatccaacatgctcaacatcttctctttggtgcctaagaggcatctctgttttaacaagtccagtaggaagctcttgaccaccctaccttacaaacctgctccttccaagaactttcttcctaggaaagcagaacttcattcttcttgttgtttagaacaagaacctctcaaactccccttctccttgccttccacccacctgtaaaactgaaactcttatttggtgttttttccacgctgggatttatctggggtctgaccacatcttagctactgccatgaccctaatccaagatagcttcacttctcttctgaattattgcaatagcttcctaactgtacttcctccctatcgttttgttctcatttctgcagccaaagagatcctttcaaaatgtaagtcatatcatgtcccccttctgctgaaaaccctccagtggcccccatcccactcaaagtaaaagccaaagtacctgcaatggcccacatgtcttgaacaattcaggcctcatgatctagctttcctgacatctcttcttgtacccctggctcactccattctgtcataatcccctctttttgattctttgaacataccaggcgctctccaaccagctccaggggtgttccctctacttgttatgttctttccccagaggtcagcatgaccacctctctgttccaagtttatgttctgctcgctatggaatagccctcgtcttacatttctgcaatttcacaacgatagcacaaaatgtcatcatgaacatcaccatggtagccatggtcaacagcacaagccctcaatcccagctcaatgattcctctgaggtgctgcctgttgactcatttggtggcctaagtaaagccccaaagagtcttcctgcaaaggctcctgtgtatgactggtctcctcaaatccaaggcatcatctttggtgctgttggctatggtggcatactgacaatggctcccagtggatacctggctggaagagtaggaacaaagcgagtggttggcatttctttgtttgcaacttcatttctcactctatgcatccctctggccactgactttggaatagtcttgctcattgtaactcgaatagtccagggcctaagccagtcctcaatacttgggggtcagtttgcaatttgggaaaagtggggccctccacaagaacgaagcagactctgcagcattgctttatcaggaatgttactgggatgctttactgccatcctcataggtggcttcattagtgaaacccttgggtggccctttgtcttctatatctttggaggtgttggctgtgtctgctgccttctctggtttgttgtgatttatgatgaccccgtttcctatccatggataagcacctcagaaaaagaatacatcatatcctccttgaaacaacaggtcgggtcttctaagcagcctcttcccatcaaagctatgctcagatctctacccatttggtccatatgtttaggctgtttcagccatcaatggttagttagcacaatggttgtatacataccaacttacatcagctctgtgtaccatgttaacatcagagacaatggacttctatctgcccttccttttattgttgcctgggtcataggcatggtgggaggctatctggcagatttccttctaaccaaaaagtttagactcatcactgtgaggaaaattgccacaattttaggaagtctcccctcttcagcactcattgtgtctctgccttacctcaattccggctatatcacagcaactgccttgctgacgctctcttgcggattaagcacattgtgtcagtcagggatttatatcaatgtcttagatattgctccaaggtattccagttttctcatgggagcatcaagaggattttcgagcatagcacctgtcattgtacccactgtcagtggatttcttcttagtcaggaccctgagtttgggtggaggaatgtcttcttcttgctgtttgccgttaacctgttaggactactcttctacctcatatttggagaagcagatgtccaagaatgggctaaagagagaaaactcactcgtttatga

SEQ ID NO: 10131 - DNA, 2174 bp, synthetic construct
  misc_feature 1..2174: note = Synthetic polypeptide
  source 1..2174: mol_type = other DNA
tcatgttacatgacctatcacagacatttgaagtacctactgacttcctcttccctgaaactcttgtccccttggcttccaggacaccgcactctcctggttttcttcttatcccaccacccattccttttcactttcctttgtttgttcctcccccatctattcaacctccaaacactgaagagccccagagttagtctttggttctcttctctatttatttcaatttcccaagttttatggctttaagtatcttctgtaggttattaactcccaatgttatgcctcaactcctacttctcttctaaacttaagaactgtatatccaacatgctcaacatcttctctttggtgcctaagaggcatctctgttttaacaagtccagtaggaagctcttgaccaccctaccttacaaacctgctccttccaagaactttcttcctaggaaagcagaacttcattcttcttgttgtttagaacaagaacctctcaaactccccttctccttgccttccacccacctgtaaaactgaaactcttatttggtgttttttccacgctgggatttatctggggtctgaccacatcttagctactgccatgaccctaatccaagatagcttcacttctcttctgaattattgcaatagcttcctaactgtacttcctccctatcgttttgttctcatttctgcagccaaagagatcctttcaaaatgtaagtcatatcatgtcccccttctgctgaaaaccctccagtggcccccatcccactcaaagtaaaagccaaagtacctgcaatggcccacatgtcttgaacaattcaggcctcatgatctagctttcctgacatctcttcttgtacccctggctcactccattctgtcataatcccctctttttgattctttgaacataccaggcgctctccaaccagctccaggggtgttccctctacttgttatgttctttccccagaggtcagcatgaccacctctctgttccaagtttatgttctgctcgctatggaatagccctcgtcttacatttctgcaatttcacaacgatagcacaaaatgtcatcatgaacatcaccatggtagccatggtcaacagcacaagccctcaatcccagctcaatgattcctctgaggtgctgcctgttgactcatttggtggcctaagtaaagccccaaagagtcttcctgcaaagtcctcaatacttgggggtcagtttgcaatttgggaaaagtggggccctccacaagaacgaagcagactctgcagcattgctttatcaggaatgttactgggatgctttactgccatcctcataggtggcttcattagtgaaacccttgggtggccctttgtcttctatatctttggaggtgttggctgtgtctgctgccttctctggtttgttgtgatttatgatgaccccgtttcctatccatggataagcacctcagaaaaagaatacatcatatcctccttgaaacaacaggtcgggtcttctaagcagcctcttcccatcaaagctatgctcagatctctacccatttggtccatatgtttaggctgtttcagccatcaatggttagttagcacaatggttgtatacataccaacttacatcagctctgtgtaccatgttaacatcagagacaatggacttctatctgcccttccttttattgttgcctgggtcataggcatggtgggaggctatctggcagatttccttctaaccaaaaagtttagactcatcactgtgaggaaaattgccacaattttaggaagtctcccctcttcagcactcattgtgtctctgccttacctcaattccggctatatcacagcaactgccttgctgacgctctcttgcggattaagcacattgtgtcagtcagggatttatatcaatgtcttagatattgctccaaggtattccagttttctcatgggagcatcaagaggattttcgagcatagcacctgtcattgtacccactgtcagtggatttcttcttagtcaggaccctgagtttgggtggaggaatgtcttcttcttgctgtttgccgttaacctgttaggactactcttctacctcatatttggagaagcagatgtccaagaatgggctaaagagagaaaactcactcgtttatga

SEQ ID NO: 10132 - DNA, 1250 bp, synthetic construct
  misc_feature 1..1250: note = Synthetic polypeptide
  source 1..1250: mol_type = other DNA
tcatgttacatgacctatcacagacatttgaagtacctactgacttcctcttccctgaaactcttgtccccttggcttccaggacaccgcactctcctggttttcttcttatcccaccacccattccttttcactttcctttgtttgttcctcccccatctattcaacctccaaacactgaagagccccagagttagtctttggttctcttctctatttatttcaatttcccaagttttatggctttaagtatcttctgtaggttattaactcccaatgttatgcctcaactcctacttctcttctaaacttaagaactgtatatccaacatgctcaacatcttctctttggtgcctaagaggcatctctgttttaacaagtccagtaggaagctcttgaccaccctaccttacaaacctgctccttccaagaactttcttcctaggaaagcagaacttcattcttcttgttgtttagaacaagaacctctcaaactccccttctccttgccttccacccacctgtaaaactgaaactcttatttggtgttttttccacgctgggatttatctggggtctgaccacatcttagctactgccatgaccctaatccaagatagcttcacttctcttctgaattattgcaatagcttcctaactgtacttcctccctatcgttttgttctcatttctgcagccaaagagatcctttcaaaatgtaagtcatatcatgtcccccttctgctgaaaaccctccagtggcccccatcccactcaaagtaaaagccaaagtacctgcaatggcccacatgtcttgaacaattcaggcctcatgatctagctttcctgacatctcttcttgtacccctggctcactccattctgtcataatcccctctttttgattctttgaacataccaggcgctctccaaccagctccaggggtgttccctctacttgttatgttctttccccagaggtcagcatgaccacctctctgttccaagtttatgttctgctcgctatggaatagccctcgtcttacatttctgcaatttcacaacgatagcacaaaatgtcatcatgaacatcaccatggtagccatggtcaacagcacaagccctcaatcccagctcaatgattcctctgaggtgctgcctgttgactcatttggtggcctaagtaaagccccaaagagtcttcctgcaaaggaatgttactgggatgctttactgccatcctcatag

SEQ ID NO: 10133 - DNA, 576 bp, synthetic construct; identical to SEQ ID NO: 6344
  misc_feature 1..576: note = Synthetic polypeptide
  source 1..576: mol_type = other DNA

SEQ ID NO: 10134 - DNA, 852 bp, synthetic construct
  misc_feature 1..852: note = Synthetic polypeptide
  source 1..852: mol_type = other DNA
gggctagaaatgaggagaatgctggttccaattggggcatactcatgagtgaggccagtcacttcacccctctgggtcccagaatcactctgtggaaccaaagagcttcgactagatggtccctaggtttcagctggcatgcggactgaagatctcccaaaggctgtggtgttcctggagcctcaatggtacagggtgctcgagaaggacagtgtgactctgaagtgccagggagcctactcccctgaggacaattccacacagtggtttcacaatgagagcctcatctcaagccaggcctcgagctacttcattgacgctgccacagtcgacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggctttttgggagtaaaaatgtgtcttcagagactgtgaacatcaccatcactcaaggtttggcagtgtcaaccatctcatcattctttccacctgggtaccaagtctctttctgcttggtgatggtactcctttttgcagtggacacaggactatatttctctgtgaagacaaacattcgaagctcaacaagagactggaaggaccataaatttaaatggagaaaggaccctcaagacaaatga

SEQ ID NO: 10135 - DNA, 849 bp, synthetic construct
  misc_feature 1..849: note = Synthetic polypeptide
  source 1..849: mol_type = other DNA
gggctagaaatgaggagaatgctggttccaattggggcatactcatgagtgaggccagtcacttcacccctctgggtcccagaatcactctgtggaaccaaagagcttcgactagatggtccctaggtttcagctggcatgcggactgatctcccaaaggctgtggtgttcctggagcctcaatggtacagggtgctcgagaaggacagtgtgactctgaagtgccagggagcctactcccctgaggacaattccacacagtggtttcacaatgagagcctcatctcaagccaggcctcgagctacttcattgacgctgccacagtcgacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggctttttgggagtaaaaatgtgtcttcagagactgtgaacatcaccatcactcaaggtttggcagtgtcaaccatctcatcattctttccacctgggtaccaagtctctttctgcttggtgatggtactcctttttgcagtggacacaggactatatttctctgtgaagacaaacattcgaagctcaacaagagactggaaggaccataaatttaaatggagaaaggaccctcaagacaaatga

SEQ ID NO: 10136 - DNA, 403 bp, synthetic construct
  misc_feature 1..403: note = Synthetic polypeptide
  source 1..403: mol_type = other DNA
gggctagaaatgaggagaatgctggttccaattggggcatactcatgagtgaggccagtcacttcacccctctgggtcccagaatcactctgtggaaccaaagagcttcgactagatggtccctaggtttcagctggcatgcggactgatctcccaaaggctgtggtgttcctggagcctcaatggtacagggtgctcgagaaggacagtgtgactctgaagtgccagggagcctactcccctgaggacaattccacacagtggtttcacaatgagagcctcatctcaagccaggcctcgagctacttcattgacgctgccacagtcgacgacagtggagagtacaggtgccagacaaacctctccaccctcagtgacccggtgcagctagaagtccatatcg

SEQ ID NO: 10137 - DNA, 321 bp, synthetic construct
  misc_feature 1..321: note = Synthetic polypeptide
  source 1..321: mol_type = other DNA
cagggcttctcagctgtgccgcacagggaccctgggcagtgtctggaggcagccaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgag

SEQ ID NO: 10138 - DNA, 1491 bp, synthetic construct
  misc_feature 1..1491: note = Synthetic polypeptide
  source 1..1491: mol_type = other DNA
cagggcttctcagctgtgccgcacagggaccctgggcagtgtctggaggcagccaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactcttgtccctttaaaaaatcaaagccgcaccccgcctccctggccagcaagaaacctaaaagggaaacaaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccaggacggcccacctccatggagacggcccacggcctcgccaccaccagccccacctggcctccacttggtggccccagccccgatcccagcgccgccgagctgaccccactctga

SEQ ID NO: 10139 - DNA, 1356 bp, synthetic construct
  misc_feature 1..1356: note = Synthetic polypeptide
  source 1..1356: mol_type = other DNA
cagggcttctcagctgtgccgcacagggaccctgggcagtgtctggaggcagccaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgcagtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactctaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccagccctggggcccgactcctgctctgttggtatagacgagtaa

SEQ ID NO: 10140 - DNA, 723 bp, synthetic construct
  misc_feature 1..723: note = Synthetic polypeptide
  source 1..723: mol_type = other DNA
cagggcttctcagctgtgccgcacagggaccctgggcagtgtctggaggcagccaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcaactctga

SEQ ID NO: 10141 - DNA, 1543 bp, synthetic construct
  misc_feature 1..1543: note = Synthetic polypeptide
  source 1..1543: mol_type = other DNA
cagggcttctcagctgtgccgcacagggaccctgggcagtgtctggaggcagccaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagatctcttggaaagtctcacaggcccgcttcattatggcatctgggcccaggacaactggagcagctccacgtggcgggagcggagcacctggccgggcctcgcctcaacccagggaaccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactcttgtccctttaaaaaatcaaagccgcaccccgcctccctggccagcaagaaacctaaaagggaaacaaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccaggacggcccacctccatggagacggcccacggcctcgccaccaccagcc

SEQ ID NO: 10142 - DNA, 1419 bp, synthetic construct
  misc_feature 1..1419: note = Synthetic polypeptide
  source 1..1419: mol_type = other DNA
cagggcttctcagctgtgccgcacagggaccctgggcagtgtctggaggcagccaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactcttgtccctttaaaaaatcaaagccgcaccccgcctccctggccagcaagaaacctaaaagggaaacaaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccagccctggggcccgactcctgctctgttggtatagacgagtaa

SEQ ID NO: 10143 - DNA, 1425 bp, synthetic construct
  misc_feature 1..1425: note = Synthetic polypeptide
  source 1..1425: mol_type = other DNA
cagggcttctcagctgtgccgcacagggaccctgggcagtgtctggaggcagccaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactctaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccaggacggcccacctccatggagacggcccacggcctcgccaccaccagccccacctggcctccacttggtggccccagccccgatcccagcgccgccgagctgaccccactctga

SEQ ID NO: 10144 - DNA, 1353 bp, synthetic construct
  misc_feature 1..1353: note = Synthetic polypeptide
  source 1..1353: mol_type = other DNA
cagggcttctcagctgtgccgcacagggaccctgggcagtgtctggaggcagccaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactctaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccagccctggggcccgactcctgctctgttggtatagacgagtaa

SEQ ID NO: 10145 - DNA, 864 bp, synthetic construct
  misc_feature 1..864: note = Synthetic polypeptide
  source 1..864: mol_type = other DNA
cagggcttctcagctgtgccgcacagggaccctgggcagtgtctggaggcagccaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgcagtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactcttgtccctttaaaaaatcaaagccgcaccccgcctcc

SEQ ID NO: 10146 - DNA, 381 bp, synthetic construct
  misc_feature 1..381: note = Synthetic polypeptide
  source 1..381: mol_type = other DNA
cagggcttctcagctgtgccgcacagggaccctgggcagtgtctggaggcagccaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcactacctcctgcaggagatctatggcattgagaacaagaacaaccaggagaccaagccctcggacgacgagaacagcgacaacagcaacgagtgtgtggtgtgcctgtccgac

SEQ ID NO: 10147 - DNA, 3012 bp, synthetic construct; identical to SEQ ID NO: 9762
  misc_feature 1..3012: note = Synthetic polypeptide
  source 1..3012: mol_type = other DNA

SEQ ID NO: 10148 - DNA, 1116 bp, synthetic construct
  misc_feature 1..1116: note = Synthetic polypeptide
  source 1..1116: mol_type = other DNA
gctgagggcacagcaggtgattggagtcagacagctaaggcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaa

SEQ ID NO: 10149 - DNA, 57 bp, synthetic construct
  misc_feature 1..57: note = Synthetic polypeptide
  source 1..57: mol_type = other DNA
gctgagggcacagcaggtgattggagtcagacagctaaggcactgaccccggagcag

SEQ ID NO: 10150 - DNA, 507 bp, synthetic construct
  misc_feature 1..507: note = Synthetic polypeptide
  source 1..507: mol_type = other DNA
gctgagggcacagcaggtgattggagtcagacagctaaggcactgaccccggagcagaagaaggagctgtctgacatcgctcaccgcatcgtggcacctgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgt

SEQ ID NO: 10151 - DNA, 488 bp, synthetic construct
  misc_feature 1..488: note = Synthetic polypeptide
  source 1..488: mol_type = other DNA
gctgagggcacagcaggtgattggagtcagacagctaaggcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattgggga

SEQ ID NO: 10152 - DNA, 1107 bp, synthetic construct
  misc_feature 1..1107: note = Synthetic polypeptide
  source 1..1107: mol_type = other DNA
gctgagggcacagcaggtgattggagtcagacagctaaggcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggtaaggataggcaggaggtgggcagggtgcctgggtggatgggactcggagaagagcccttctcactccacccctctccctgcttag

SEQ ID NO: 10153 - DNA, 1128 bp, synthetic construct
  misc_feature 1..1128: note = Synthetic polypeptide
  source 1..1128: mol_type = other DNA
gctgagggcacagcaggtgattggagtcagacagctaaggcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcaggtgggcctgcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaa

SEQ ID NO: 10154 - DNA, 442 bp, synthetic construct
  misc_feature 1..442: note = Synthetic polypeptide
  source 1..442: mol_type = other DNA
gctgagggcacagcaggtgattggagtcagacagctaaggcactgaccccggagcagaagaaggagctgtctgacatcgctcaccgcatcgtggcacctgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgc

SEQ ID NO: 10155 - DNA, 694 bp, synthetic construct
  misc_feature 1..694: note = Synthetic polypeptide
  source 1..694: mol_type = other DNA
gctgagggcacagcaggtgattggagtcagacagctaaggcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctgg

SEQ ID NO: 10156 - DNA, 559 bp, synthetic construct
  misc_feature 1..559: note = Synthetic polypeptide
  source 1..559: mol_type = other DNA
agtcagtcgtgtgttgagctgctaaactctaaagtaattttaggtggaagtgttggaaacatgctgctgagattattcaggacagggagttgaccaactgcaaagagtgattgacaccatcaaaaccaaccctgacgacagaagaatcatcatgtgcgcttggaatccaagagatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaagccaggtgactttatacacactttgggagatgcacatatttacctgaatcacatcgagccactgaaaattcagcttcagcgagaacccagacctttcccaaagctcaggattcttcgaaaagttgagaaaattgatgacttcaaagctgaagactttcagattgaagggtacaatccgcatccaactattaaaatggaaatggctgtttag

SEQ ID NO: 10157 - DNA, 367 bp, synthetic construct; identical to SEQ ID NO: 548
  misc_feature 1..367: note = Synthetic polypeptide
  source 1..367: mol_type = other DNA

SEQ ID NO: 10158 - DNA, 1710 bp, synthetic construct
  misc_feature 1..1710: note = Synthetic polypeptide
  source 1..1710: mol_type = other DNA
tgtactggatattttctatttgcctatccatatccagtctctacttttccttgctctgggccaacccatgtgggttggcatcaatggactccattgtcctttatcttccatttggacttgatcaatgggaaacattagcaagagatgggaaggtaagtgggaggagagaaaccgaagtctttaccctgctggtttccttcctgctggactgcagtgggttggctgtgtccctcgactaatgcctcctctcgtgctaggcagcctttggcaaactgctactctctgcaggttttgtaaaccaattctaccccagccccttcatgggcagcaatgacttcctgctgttgcaagccctgaggaggctgggatgcagatggaaaaggcccttgtgtctgggacacatttactcatcagggaggagagagagttttcaagaaccagactggcgatgtagcttgtggcagctacactctgtgggaggaagatttgaaatgtatcaaacagcttggattgactcattaccgcttctctctttcctggtcacgtctgttacctgatgggacgacaggtttcatcaaccagaaaggaattgattattacaacaagatcatcgatgatttgttaaaaaatggggttactcccattgtgaccctctaccactttgatttgcctcagactttagaagaccaaggaggttggttgtcagaggcaatcattgaatcctttgacaaatatgctcagttttgcttcagtacctttggggatcgtgtcaagcagtggatcaccataaatgaagctaatgttctttctgtgatgtcatatgacttaggtatgtttcctccgggtatccctcactttgggactggaggttatcaggcagctcataatttgattaaggctcatgccagatcctggcacagctatgattccttatttcgaaaaaagcagaaaggtatggtgtctctatcactttttgcggtctggttggaaccagcagatcccaactcagtgtctgaccaggaagctgctaaaagagccatcactttccatctggatttatttgctaaacccatattcatcgatggtgattatcctgaagttgtcaagtctcagattgcctccatgagtcaaaagcaaggctatccatcatcgaggcttccagaattcactgaagaagagaagaaaatgatcaaaggcactgctgatttttttgctgtgcaatattatacaactcgcttaatcaagtaccaggagaacaagaaaggagaactaggtattctccaggatgcggaaattgaattttttccagatccatcttggaaaaatgtggattggatctacgtggtaccatggggagtatgtaaactactgaaatatattaaggatacatataataaccctgtaatttacatcactgagaatgggtttccccagagtgacccagcgcctcttgatgacactcaacgctgggagtatttcagacaaacatttcaggaactgttcaaagctatccaacttgataaagtcaatcttcaagtatattgtgcatggtctcttctggataactttgagtggaaccagggatacagcagccggtttggtctcttccacgttgattttgaagacccagctagaccccgagtcccttacacatcggccaaggaataagccaagatcatccgaaacaatggccttgaagcacatctgtag

SEQ ID NO: 10159 - DNA, 789 bp, synthetic construct
  misc_feature 1..789: note = Synthetic polypeptide
  source 1..789: mol_type = other DNA
tgtactggatattttctatttgcctatccatatccagtctctacttttccttgctctgggccaacccatgtgggttggcatcaatggactccattgtcctttatcttccatttggacttgatcaatgggaaacattagcaagagatgggaaggtaagtgggaggagagaaaccgaagtctttaccctgctggtttccttcctgctggactgcagtgggttggctgtgtccctcgactaatgcctcctctcgtgctaggcagcctttggcaaactgctactctctgcaggttttgtaaaccaattctaccccagccccttcatgggcagcaatgacttcctgctgttgcaagccctgaggaggctgggatgcagatggaaaaggcccttgtgtctgggacacatttactcatcagggaggagagagagttttcaagaaccagactggcgatgtagcttgtggcagctacactctgtgggaggaagatttgaaatgtatcaaacagcttggattgactcattaccgcttctctctttcctggtcacgtctgttacctgatgggacgacaggtttcatcaaccagaaagctatccaacttgataaagtcaatcttcaagtatattgtgcatggtctcttctggataactttgagtggaaccagggatacagcagccggtttggtctcttccacgttgattttgaagacccagctagaccccgagtcccttacacatcggccaaggaataagccaagatcatccgaaacaatggccttgaagcacatctgtag

SEQ ID NO: 10160 - DNA, 587 bp, synthetic construct
  misc_feature 1..587: note = Synthetic polypeptide
  source 1..587: mol_type = other DNA
ttgtagaacggaagtcagtcactgccttgctggaaaccctcccatgcccctctgtgttctccaaacaaaacccagaggccctgggtggcccacaggatatctgtcctcagtcaccccgccatgctcactctactggagccccactggcttccttcggttctcatccaaccattttttggccaaggcccttactcttccttccacctggaccactcttccccactggagcttgacacgtgcagcttctcctccttcagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatg

SEQ ID NO: 10161 - DNA, 1246 bp, synthetic construct
  misc_feature 1..1246: note = Synthetic polypeptide
  source 1..1246: mol_type = other DNA
ttgtagaacggaagtcagtcactgccttgctggaaaccctcccatgcccctctgtgttctccaaacaaaacccagaggccctgggtggcccacaggatatctgtcctcagtcaccccgccatgctcactctactggagccccactggcttccttcggttctcatccaaccattttttggccaaggcccttactcttccttccacctggaccactcttccccactggagcttgacacgtgcagcttctcctccttcagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaagatctgggcttcaaggacctcacgctgcagccgcggggccctctggagccaggccccccaaagcccggggtcccccaggaacccggacgggggcagccagatgcagtgcctgagcccccaccggtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcagcggaagcagcagcagcaggaggggaactacctgcagcacgtccagctggaccagaggagcctggtgctgaacacggagcccgccgagtgccccgtgtgctactcggtgctggcgcccggcgaggccgtggtgctgcggagtgcctgcagggcaccatccgcaacagccaggaggcggaggtctcctgccccttcattgacaacacctactcgtgctcgggcaagctgctggagagggagatcaaggcgctcctga

SEQ ID NO: 10162 - DNA, 1768 bp, synthetic construct
  misc_feature 1..1768: note = Synthetic polypeptide
  source 1..1768: mol_type = other DNA
ttgtagaacggaagtcagtcactgccttgctggaaaccctcccatgcccctctgtgttctccaaacaaaacccagaggccctgggtggcccacaggatatctgtcctcagtcaccccgccatgctcactctactggagccccactggcttccttcggttctcatccaaccattttttggccaaggcccttactcttccttccacctggaccactcttccccactggagcttgacacgtgcagcttctcctccttcagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaagatctgggcttcaaggacctcacgctgcagccgcggggccctctggagccaggccccccaaagcccggggtcccccaggaacccggacgggggcagccagatgcagtgcctgagcccccaccggtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcagcggaagcagcagcagcaggaggggaactacctgcagcacgtccagctggaccagaggagcctggtgctgaacacggagcccgccgagtgccccgtgtgctactcggtgctggcgcccggcgaggccgtggtgctgcgtgagtgtctgcacaccttctgcagggagtgcctgcagggcaccatccgcaacagccaggaggcggaggtctcctgccccttcattgacaacacctactcgtgctcgggcaagctgctggagagggagatcaaggcgctcctgacccctgaggattaccagcgatttctagacctgggcatctccattgctgaaaaccgcagtgccttcagctaccattgcaagaccccagattgcaagggatggtgcttctttgaggatgatgtcaatgagttcacctgccctgtgtgtttccacgtcaactgcctgctctgcaaggccatccatgagcagatgaactgcaaggagtatcaggaggacctggccctgcgggctcagaacgatgtggctgcccggcagacgacagagatgctgaaggtgatgctgcagcagggcgaggccatgcgctgcccccagtgccagatcgtggtacagaagaaggacggctgcgactggatccgctgcaccgtctgccacaccgagatctgctgggtcaccaagggcccacgctggggccctgggggcccaggagacaccagcgggggctgccgctgcagggtaaatgggattccttgccacccaagctgtcagaactgccactga

SEQ ID NO: 10163 - DNA, 1054 bp, synthetic construct
  misc_feature 1..1054: note = Synthetic polypeptide
  source 1..1054: mol_type = other DNA
ttgtagaacggaagtcagtcactgccttgctggaaaccctcccatgcccctctgtgttctccaaacaaaacccagaggccctgggtggcccacaggatatctgtcctcagtcaccccgccatgctcactctactggagccccactggcttccttcggttctcatccaaccattttttggccaaggcccttactcttccttccacctggaccactcttccccactggagcttgacacgtgcagcttctcctccttcagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaagatctgggcttcaaggacctcacgctgcagccgcggggccctctggagccaggccccccaaagcccggggtcccccaggaacccggacgggggcagccagatgcagtgcctgagcccccaccggtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcagggagtgcctgcagggcaccatccgcaacagccaggaggcggaggtctcctgccccttcattga

SEQ ID NO: 10164 - DNA, 553 bp, synthetic construct
  misc_feature 1..553: note = Synthetic polypeptide
  source 1..553: mol_type = other DNA
ttgtagaacggaagtcagtcactgccttgctggaaaccctcccatgcccctctgtgttctccaaacaaaacccagaggccctgggtggcccacaggatatctgtcctcagtcaccccgccatgctcactctactggagccccactggcttccttcggttctcatccaaccattttttggccaaggcccttactcttccttccacctggaccactcttccccactggagcttgacacgtgcagcttctcctccttcagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcagattcctcatggtgcaaaatggccattccagctccatccagccatcacatcacaggaggaagggaagaaagacacccctccacactcttctaaagagcatagctcaaaaattgtacacacttcttccgttaattcctgtggaccagaactga

SEQ ID NO: 10165 - DNA, 2471 bp, synthetic construct; identical to SEQ ID NO: 576
  misc_feature 1..2471: note = Synthetic polypeptide
  source 1..2471: mol_type = other DNA

SEQ ID NO: 10166 - DNA, 1128 bp, synthetic construct
  misc_feature 1..1128: note = Synthetic polypeptide
  source 1..1128: mol_type = other DNA
ggccgggcatggtggctcacgcctataatcccagcactttgggagaccaaggcaggcggatcacctgaggtcgggagtttgagaccagcctgaccaacatggagaaaccccatctctactaaaaatacaaaattaaccaggcgtgacggttccaagtggacttattttggtcctgatggggagaatagctggtccaagaagtacccgtcgtgtgggggcctgctgcagtcccccatagacctgcacagtgacatcctccagtatgacgccagcctcacgcccctcgagttccaaggctacaatctgtctgccaacaagcagtttctcctgaccaacaatggccattcagtgaagctgaacctgccctcggacatgcacatccagggcctccagtctcgctacagtgccacgcagctgcacctgcactgggggaacccgaatgacccgcacggctctgagcacaccgtcagcggacagcacttcgccgccgagctgcacattgtccattataactcagacctttatcctgacgccagcactgccagcaacaagtcagaaggcctcgctgtcctggctgttctcattgagatgggctccttcaatccgtcctatgacaagatcttcagtcaccttcaacatgtaaagtacaaaggccaggaagcattcgtcccgggattcaacattgaagagctgcttccggagaggaccgctgaatattaccgctaccgggggtccctgaccacacccccttgcaaccccactgtgctctggacagttttccgaaaccccgtgcaaatttcccaggagcagctgctggctttggagacagccctgtactgcacacacatggacgacccttcccccagagaaatgatcaacaacttccggcaggtccagaagttcgatgagaggctggtatacacctccttctcccaagtgcaagtctgtactgcggcaggactgagtctgggcatcatcctctcactggccctggctggcattcttggcatctgtattgtggtggtggtgtccatttggcttttcagaaggaagagtatcaaaaaaggtgataacaagggagtcatttacaagccagccaccaagatggagactgaggcccacgcttga

SEQ ID NO: 10167 - DNA, 1095 bp, synthetic construct
  misc_feature 1..1095: note = Synthetic polypeptide
  source 1..1095: mol_type = other DNA
ggccgggcatggtggctcacgcctataatcccagcactttgggagaccaaggcaggcggatcacctgaggtcgggagtttgagaccagcctgaccaacatggagaaaccccatctctactaaaaatacaaaattaaccaggcgtgacggttccaagtggacttattttggtcctgatggggagaatagctggtccaagaagtacccgtcgtgtgggggcctgctgcagtcccccatagacctgcacagtgacatcctccagtatgacgccagcctcacgcccctcgagttccaaggctacaatctgtctgccaacaagcagtttctcctgaccaacaatggccattcagtgaagctgaacctgccctcggacatgcacatccagggcctccagtctcgctacagtgccacgcagctgcacctgcactgggggaacccgaatgacccgcacggctctgagcacaccgtcagcggacagcacttcgccgccgagctgcacattgtccattataactcagacctttatcctgacgccagcactgccagcaacaagtcagaaggcctcgctgtcctggctgttctcattgagatgggctccttcaatccgtcctatgacaagatcttcagtcaccttcaacatgtaaagtacaaaggccaggaagcattcgtcccgggattcaacattgaagagctgcttccggagaggaccgctgaatattaccgctaccgggggtccctgaccacacccccttgcaaccccactgtgctctggacagttttccgaaaccccgtgcaaatttcccaggagcagctgctggctttggagacagccctgtactgcacacacatggacgacccttcccccagagaaatgatcaacaacttccggcaggtccagaagttcgatgagaggctggtatacacctccttctcccaaggcatcatcctctcactggccctggctggcattcttggcatctgtattgtggtggtggtgtccatttggcttttcagaaggaagagtatcaaaaaaggtgataacaagggagtcatttacaagccagccaccaagatggagactgaggcccacgcttga

SEQ ID NO: 10168 - DNA, 915 bp, synthetic construct
  misc_feature 1..915: note = Synthetic polypeptide
  source 1..915: mol_type = other DNA
ggccgggcatggtggctcacgcctataatcccagcactttgggagaccaaggcaggcggatcacctgaggtcgggagtttgagaccagcctgaccaacatggagaaaccccatctctactaaaaatacaaaattaaccaggcgtgacggttccaagtggacttattttgtgaagctgaacctgccctcggacatgcacatccagggcctccagtctcgctacagtgccacgcagctgcacctgcactgggggaacccgaatgacccgcacggctctgagcacaccgtcagcggacagcacttcgccgccgagctgcacattgtccattataactcagacctttatcctgacgccagcactgccagcaacaagtcagaaggcctcgctgtcctggctgttctcattgagatgggctccttcaatccgtcctatgacaagatcttcagtcaccttcaacatgtaaagtacaaaggccaggaagcattcgtcccgggattcaacattgaagagctgcttccggagaggaccgctgaatattaccgctaccgggggtccctgaccacacccccttgcaaccccactgtgctctggacagttttccgaaaccccgtgcaaatttcccaggagcagctgctggctttggagacagccctgtactgcacacacatggacgacccttcccccagagaaatgatcaacaacttccggcaggtccagaagttcgatgagaggctggtatacacctccttctcccaaggcatcatcctctcactggccctggctggcattcttggcatctgtattgtggtggtggtgtccatttggcttttcagaaggaagagtatcaaaaaaggtgataacaagggagtcatttacaagccagccaccaagatggagactgaggcccacgcttga

SEQ ID NO: 10169 - DNA, 2003 bp, synthetic construct; identical to SEQ ID NO: 8385
  misc_feature 1..2003: note = Synthetic polypeptide
  source 1..2003: mol_type = other DNA

SEQ ID NO: 10170 - DNA, 949 bp, synthetic construct
  misc_feature 1..949: note = Synthetic polypeptide
  source 1..949: mol_type = other DNA
acaataagaatcaggtttgatgaacatcccttctgaatcttcccagcagtcccacacttcatgtacctatcagcactctcccagcagtacagtgagcactcacccacacagcaaccaaagcagcctgtccaacagtcatggcagtggcctcaacaccacaggcagtaattcggttgcacaggtctcactgtctcacccccagatgcacacacagccatctccacatcctccccatcgaccgcatggtttaccgcagcatccgcagcgttccccacacccagcaccacacccacagcaacacagccagctccagtcccctcacccccagcatccctctccacatcaacacatacagcaccatccgaaccatcagcatcagacgttaacacatcaggcacccccacccccacaacaggtatcctgtaattctggtgtttcaaatgattggtatgcgacacttgatatgctaaaagaaagctgtcgaattgccagcagtgttaattggtcagatgtagacctttcacagtttcaaggtctgatggagagtatgagacaggcagatctcaagaactggtctttagaccaggttcagtttgccgatctttgttcttctcttaatcagttctttacacaaactggccttatacattcacagagtaatgttcaacaaaatgtttgtcatggtgccatgcatccaacaaaaccttcccaacacattggaacaggaaatttgtacatagattctaggcaaaatctccctccttcagtgatgccaccccctggttatcctcatatcccacaggcactcagcactccaggaacaacgatggcaggccatcacagagccatgaaccagcagcacatgatgccttcccaagccttccagatgcggcgttccctgcctccagatgacatccaggatgactttgattgggattcaattgtgtag

SEQ ID NO: 10171 - DNA, 328 bp, synthetic construct
  misc_feature 1..328: note = Synthetic polypeptide
  source 1..328: mol_type = other DNA
acaataagaatcaggtttgatgaacatcccttctgaatcttcccagcagtcccacacttcatgtacctatcagcactctcccagcagtacagtgagcactcacccacacagcaaccaaagcagcctgtccaacagtcatggcagtggcctcaacaccacaggcagtaattcggttgcacaggtctcactgtctcacccccagatgcacacacagccatctccacatcctccccatcgaccgcatggtttaccgcagcatccgcagcgttccccacacccagcaccacacccacagcaacacagccagctccagtcccctcacccccag

SEQ ID NO: 10172 - DNA, 1425 bp, synthetic construct
  misc_feature 1..1425: note = Synthetic polypeptide
  source 1..1425: mol_type = other DNA
ctattgacagcacatttgttaaattcccccaaattcagatattgaaatcctaatccccaagtggtggtatctggaggtgaagggtttcacccttggaaagtaattaaccatgaggttggagctcttgtgatgggattagtactcttataagaagagacacaagagagtttgcttcttctctgtccccaccaggtgaagatacagcaagaaggcatctactcgcaaaccaagaagaaggccctcaccaggaaccgagttacttgcatcttcatcttgaacttcctggtctccagaagaattccatgtggatggctcatgaacaaaaatgagaaacacgacgataaactggtaatgttcaccaatcaatctgaagattctgaaagatgtgaaagcatggagctggacaaaaaaatccaggatctgattgagagaaatgcgtctcctcatccaaaacggttcaccccagaggccatgccaactcacagaaatctatgttctctgaagactccaggaaaaacagcttccatggcacattttgtacagggcacatctagaatgattgccgcagaaagttctacggagcataaagagtgtgctgaaccatcaacaagaaagaacttgatgaattctcttgaacaaaagataaggtgtttggaaaaacaaagaaaagagctcctggaagttaaccagcaatgggatcagcaatttagaagtatgaaagagttatatgaaagaaaggtagcagagctgaagacgaaactggacgccgcggaaagattcctcagcacgcgggagaaggatccgcatcagaggcagagaaaggacgacaggcagagagaggacgacaggcagcgcgacctgacccgggaccggctgcagcgggaggagaaggaaaaggaacgcctaaatgaagaattacatgaattgaaagaagagaataaacttttaaagggaaaaaatactcttgcgaacaaggaaaaggaacattacgaatgtgaaataaaacgcctcaataaggctcttcaggatgccttgaatatcaagtgttcattttccgaggactgtttgaggaagtctcgagtggaattctgccatgaggagatgagaacagaaatggaagttctgaagcagcaggtgcaaatatacgaagaagacttcaaaaaggaacgatcggatcgagagagacttaatcaagagaaagaggagctacagcaaattaatgaaacttcccaatcccagttgaacaggctgaattcccagataaaagcttgtcagatggagaaagaaaaactagaaaagcaattaaaacagatgtattgcccaccctgtaactgcggcttggttttccacctgcaagatccatgggtaccaacaggccctggagctgtgcagaagcaacgggagcacccagtttatcctcagtaa

SEQ ID NO: 10173 - DNA, 694 bp, synthetic construct
  misc_feature 1..694: note = Synthetic polypeptide
  source 1..694: mol_type = other DNA
tgatgtggtttggctgtgtctccacccaaatctcatcttgaattcccacatttgtgggagggacccactgggaggtaagtgaatcatgagagcaggtccttcccatgctgttctcctgatactgagtaagtctcatgagatctgatggttattataaggggggattttcctgcacaagctctctctttgcctgctgccatccatgtaagatgtgacttgctcctccttgctttctgccaagattgtgagacttccccagccacgtggaactgtgtgcaacaatggtgaatgtctaaacatggaaaaggtctatatctcaaccaattgcccctctcagtgcaatgaaaatcctgtggatggccacggactccagtgccactgtgaggaaggacaggcacctgtagcctgtgaagaaaccttacatgttaccaatatcaccatcttggttgttgtgcttgtcctggttattgtcggtatcggagttcttatactattagttcgttaccgaaaatgtatcaagttgaagcaagttcagagcccacctacagaaaccctgggagtggagaacaaaggatactttggtgatgagcagcagataaggactgagccaatcctgccagaaattcatttcctaaataaacctgcaagtaaagattcaagaggaatcgcagatcccaatcaaagtgccaagtga

SEQ ID NO: 10174 - DNA, 760 bp, synthetic construct
  misc_feature 1..760: note = Synthetic polypeptide
  source 1..760: mol_type = other DNA
tgatgtggtttggctgtgtctccacccaaatctcatcttgaattcccacatttgtgggagggacccactgggaggtaagtgaatcatgagagcaggtccttcccatgctgttctcctgatactgagtaagtctcatgagatctgatggttattataaggggggattttcctgcacaagctctctctttgcctgctgccatccatgtaagatgtgacttgctcctccttgctttctgccaagattgtgagacttccccagccacgtggaactgtgtgcaacaatggtgaatgtctaaacatggaaaaggtctatatctcaaccaattgcccctctcagtgcaatgaaaatcctgtggatggccacggactccagtgccactgtgaggaaggacaggcacctgtagcctgtgaagaaaccttacatgttaccaatatcaccatcttggttgttgtgcttgtcctggttattgtcggtatcggagttcttatactattagttcgttaccgaaaatgtatcaagttgaagcaagttcagagcccacctacagaaaccctgggagtggagaacaaaggatactttggtgatgagcagcagataaggactgagccaatcctgccagaaattcatttcctaaatcagagaactccagaatccttggaaagcctgcccactagtttttcaagtccccactacatcacactgaaacctgcaagtaaagattcaagaggaatcgcagatcccaatcaaagtgccaagtga

SEQ ID NO: 10175 - DNA, 664 bp, synthetic construct
  misc_feature 1..664: note = Synthetic polypeptide
  source 1..664: mol_type = other DNA
tgatgtggtttggctgtgtctccacccaaatctcatcttgaattcccacatttgtgggagggacccactgggaggtaagtgaatcatgagagcaggtccttcccatgctgttctcctgatactgagtaagtctcatgagatctgatggttattataaggggggattttcctgcacaagctctctctttgcctgctgccatccatgtaagatgtgacttgctcctccttgctttctgccaagattgtgagacttccccagccacgtggaactgtgtgcaacaatggtgaatgtctaaacatggaaaaggtctatatctcaaccaattgcccctctcagtgcaatgaaaatcctgtggatggccacggactccagtgccactgtgaggaaggacaggcacctgtagcctgtgaagaaaccttacatgttaccaatatcaccatcttggttgttgtgcttgtcctggttattgtcggtatcggagttcttatactattagttcgttaccgaaaatgtatcaagttgaagcaagttcagagcccacctacagaaaccctgggagtggagaacaaaggatactttggtgatgagcagcagataaggactgagccaatcctgccagaaattcatttcctaaatcacctcttatatggaaggcatcaatga

SEQ ID NO: 10176 - DNA, 420 bp, synthetic construct
  misc_feature 1..420: note = Synthetic polypeptide
  source 1..420: mol_type = other DNA
ctacctttctaacagatcctttgttttgtttaggcttctaaccctcctttatgtgactcagagaaaggagacctcattccaagttccaggattaattctggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaaga

SEQ ID NO: 10177 - DNA, 529 bp, synthetic construct
  misc_feature 1..529: note = Synthetic polypeptide
  source 1..529: mol_type = other DNA
ctacctttctaacagatcctttgttttgtttaggcttctaaccctcctttatgtgactcagagaaaggagacctcattccaagttccaggattaattctggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaa

SEQ ID NO: 10178 - DNA, 772 bp, synthetic construct
  misc_feature 1..772: note = Synthetic polypeptide
  source 1..772: mol_type = other DNA
ctacctttctaacagatcctttgttttgtttaggcttctaaccctcctttatgtgactcagagaaaggagacctcattccaagttccaggattaattctggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaaggctcgatcaagtcatccgccaaagaagcctgtccagtttggaactgttcctctcctgtgcacagaaacagttaagtgctttaatagctacggaaccagttgacattgaataa

SEQ ID NO: 10179 - DNA, 250 bp, synthetic construct
  misc_feature 1..250: note = Synthetic polypeptide
  source 1..250: mol_type = other DNA
ctacctttctaacagatcctttgttttgtttaggcttctaaccctcctttatgtgactcagagaaaggagacctcattccaagttccaggattaattctggcactactgcagtcttcagttaagcaacaagtagaagctattgaaaaacagtacatttctgcaattgagaaacaggcacacaagtgtgaggagttgctaaatgctcagagtgcccttttttcaatccttcctgcgattggctgcttttag

SEQ ID NO: 10180 - DNA, 533 bp, synthetic construct
  misc_feature 1..533: note = Synthetic polypeptide
  source 1..533: mol_type = other DNA
ctacctttctaacagatcctttgttttgtttaggcttctaaccctcctttatgtgactcagagaaaggagacctcattccaagttccaggattaattctggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaa

SEQ ID NO: 10181 - DNA, 706 bp, synthetic construct
  misc_feature 1..706: note = Synthetic polypeptide
  source 1..706: mol_type = other DNA
caccctcctacctcaggtggtccgcaacatgacctccgagttcttcgctgcccagctccgggcccagatctctgacgacaccactcacccgatctcctactacaagcccgagttctacacgccggatgacgggggcactgctcacctgtctgtcgtcgcagaggacggcagtgctgtgtccgccaccagcaccatcaacctctactttggctccaaggtccgctccccggtcagcgggatcctgttcaataatgaaatggacgacttcagctctcccagcatcaccaacgagtttggggtacccccctcacctgccaatttcatccagccagggaagcagccgctctcgtccatgtgcccgacgatcatggtgggccaggacggccaggtccggatggtggtgggagctgctgggggcacacagatcaccacggccactgcactggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactga

SEQ ID NO: 10182 - DNA, 386 bp, synthetic construct
  misc_feature 1..386: note = Synthetic polypeptide
  source 1..386: mol_type = other DNA
caccctcctacctcaggtggtccgcaacatgacctccgagttcttcgctgcccagctccgggcccagatctctgacgacaccactcacccgatctcctactacaagcccgagttctacacgccggatgacgggggcactgctcacctgtctgtcgtcgcagaggacggcagtgctgtgtccgccaccagcaccatcaacctctactttggctccaaggtccgctccccggtcagcgggatcctgttcaataatgaaatggacgacttcagctctcccagcatcaccaacgagtttggggtacccccctcacctgccaatttcatccagccagggaagcagccgctctcgtccatgtgcccgacgatcatggtgggccaggacggcc

SEQ ID NO: 10183 - DNA, 75 bp, synthetic construct
  misc_feature 1..75: note = Synthetic polypeptide
  source 1..75: mol_type = other DNA
caccctcctacctcaggtggtccgcaacatgacctccgagttcttcgctgcccagctccgggcccagatctctga

SEQ ID NO: 10184 - DNA, 565 bp, synthetic construct
  misc_feature 1..565: note = Synthetic polypeptide
  source 1..565: mol_type = other DNA
ttaaaaatattctttccctttgatccagctagaaaaattgtgatatagggatattctcacaagtgttcaagaaatgcaaaattccaacatttgcaaaagcaagaaaactggacagcctaaatgcccagcagtacagtcataagctggagatgctcagaacctcatagaagcagccagcactggggccgccatctccgtgaaggtggtcgccaacatcgctgccaacctgattgcgttcctggctgtgctggactttatcaatgctgccctctcctggctgggagacatggtggacatccaagggctcagcttccagctcatctgctcctacatcctgcggcctgtagccttcttgatgggtgtggcgtgggaggactgcccagtggtagctgagctgctggggatcaagctgtttctgaacgagtttgtggcctatcaagacctctccaagtacaagcaacgccgcctggcaggggccgaggagtgggtcggcgacaggaagcagtggatctccagacgaggtcttgctatgttgaccaggctggtcttgaactcctggccttaa

SEQ ID NO: 10185 - DNA, 844 bp, synthetic construct
  misc_feature 1..844: note = Synthetic polypeptide
  source 1..844: mol_type = other DNA
ttaaaaatattctttccctttgatccagctagaaaaattgtgatatagggatattctcacaagtgttcaagaaatgcaaaattccaacatttgcaaaagcaagaaaactggacagcctaaatgcccagcagtacagtcataagctggagatgctcagaacctcatagaagcagccagcactggggccgccatctccgtgaaggtggtcgccaacatcgctgccaacctgattgcgttcctggctgtgctggactttatcaatgctgccctctcctggctgggagacatggtggacatccaagggctcagcttccagctcatctgctcctacatcctgcggcctgtagccttcttgatgggtgtggcgtgggaggactgcccagtggtagctgagctgctggggatcaagctgtttctgaacgagtttgtggcctatcaagacctctccaagtacaagcaacgccgcctggcaggggccgaggagtgggtcggcgacaggaagcagtggatctccgtcagagctgaagtcctcacgacgtttgccctctgtggatttgccaatttcagctccattgggatcatgctgggaggcttgacctccatggtcccccaacggaagagcgacttctcccagatagtgctccgggcgctcttcacgggagcctgtgtgtccctggtgaacgcctgtatggcagggatcctctacatgcccaggggggctgaagttgactgcatgtccctcttgaacacgaccctcagcagcagtagctttgagatttaccagtgctgccgtgaggccttccagaggatattcaaaagtacacctgccgagtcccagccctga

SEQ ID NO: 10186 - DNA, 883 bp, synthetic construct
  misc_feature 1..883: note = Synthetic polypeptide
  source 1..883: mol_type = other DNA
ttaaaaatattctttccctttgatccagctagaaaaattgtgatatagggatattctcacaagtgttcaagaaatgcaaaattccaacatttgcaaaagcaagaaaactggacagcctaaatgcccagcagtacagtcataagctggagatgctcagaacctcatagaagcagccagcactggggccgccatctccgtgaaggtggtcgccaacatcgctgccaacctgattgcgttcctggctgtgctggactttatcaatgctgccctctcctggctgggagacatggtggacatccaagggctcagcttccagctcatctgctcctacatcctgcggcctgtagccttcttgatgggtgtggcgtgggaggactgcccagtggtagctgagctgctggggatcaagctgtttctgaacgagtttgtggcctatcaagacctctccaagtacaagcaacgccgcctggcaggggccgaggagtgggtcggcgacaggaagcagtggatctccgtcagagctgaagtcctcacgacgtttgccctctgtggatttgccaatttcagctccattgggatcatgctgggaggcttgacctccatggtcccccaacggaagagcgacttctcccagatagtgctccgggcgctcttcacgggagcctgtgtgtccctggtgaacgcctgtatggcagggatcctctacatgcccaggggggctgaagttgactgcatgtccctcttgaacacgaccctcagcagcagtagctttgagatttaccagtgctgccgtgaggccttccagagcgtcaatccagagttcagcccagaggccctggacaactgctgtcggttttacaaccacacgatctgtgcacagtga

SEQ ID NO: 10187 - DNA, 1429 bp, synthetic construct
  misc_feature 1..1429: note = Synthetic polypeptide
  source 1..1429: mol_type = other DNA
atgtggtttggctctgtgtcaccaccttgaattgtaatccccacgtgttgagggagaaacccagtgggaggtgattggatcacgggggtggtttccctcatgctgttctcatgatagtgagtgagctctcatgatatctgatggtttaaaagtggcacttctgcctttgctcgttttctcctgccgccataaaagacttgctttgcttccccttctgccatgatttaagtttcctgaagtccctgcagccaagtagaactgccatggtaagtgtgactgtggcaagtgcaagtgtgaccagggatggtatggggatgcttgccagtacccaactaactgtgacttgacaaagaagaaaagtaaccaaatgtgcaagaattcacaagacatcatctgctctaatgcaggtacatgtcactgtggcaggtgtaagtgtgataattcagatggaagtggacttgtgtatggtaaattttgtgagtgtgacgatagagaatgcatagacgatgaaacagaagaaatatgtggaggccatgggaagtgttactgtggaaactgctactgcaaggctggttggcatggagataaatgtgaattccagtgcgatatcaccccctgggaaagcaagcgaagatgcacgtctccagatggcaaaatctgcagtaacagagggacttgtgtatgtggtgaatgtacctgtcacgatgttgatccgactggggactggggagatattcatggggacacctgtgaatgtgatgagagggactgtagagctgtctatgaccgatattctgatgacttctgttcaggtcatggacagtgtaattgcggaagatgtgactgcaaagcaggctggtatgggaagaagtgtgagcacccacagtcctgcacgctgtcagctgaggagagcatcaggaagtgccagggaagctcggatctgccttgctctgggaggggtaaatgtgaatgtggcaaatgcacctgctatcctccaggagatcgccgggtgtatggcaagacttgtgagtgtgatgatcgccgctgtgaagacctcgatggtgtggtctgtggaggccacggcacatgttcctgtggtcgctgtgtttgtgagagaggatggtttggaaagctctgccaacatccgcggaagtgtaacatgacggaagaacaaagcaagaatctgtgtgaatcagcagatggcatattgtgctcggggaagggttcttgtcattgtgggaagtgcatttgttctgctgaagagtggtatatttctggggagttctgtgactgtgatgacagagactgcgacaaacatgatggtctcatttgtacagggaatggaatatgtagctgtggaaactgtgaatgctgggatggatggaatggaaatgcatgtgaaatctggcttggctcagaatatccttaa

SEQ ID NO: 10188 - DNA, 595 bp, synthetic construct
  misc_feature 1..595: note = Synthetic polypeptide
  source 1..595: mol_type = other DNA
ggccaggcgcggtggctcacgcctgtaatcccagcacttagggaggctgaggcaggcggatcacgaggtcaggagatcaagaccatcctggctaacacggtgaaaccccagcgctaataaaaatacaaaaaaaattagccggatgaatggctatcaaagaaggatcaaaaatgcaactgagaaaatgatggctcttgttgctgagctgtccatgaaacaagccctaaccattgaactccaaaaggaagtcagggagaaagaagacttcatcttcacttgcaattccaggatagaaaaaggtctgccactcaataaggaaattgagaaagaatggttgaaagtccttcgagatgaagaaatgcacgccttggccatcgctgaaaagtctcaggagttcttggaagcagataatcgccagctgcccaatggtgtttacacaactgcagagcagcgtccgaatgcctacatcccagaagcagatgccactcttcctttgccaaaaccttatggtgctttggctccttttaaacccagtgaacctggagccaatatgaggcacataaggaaacctgttataaagccagttgaaatctga

SEQ ID NO: 10189 - DNA, 353 bp, synthetic construct
  misc_feature 1..353: note = Synthetic polypeptide
  source 1..353: mol_type = other DNA
ggacagatgcggtggctcgtgcctgtaattgcagcactttgagaggccgaggaatccagccggctgtctttgctttcccatgtgctacacttatcactgtgatgttggccttcatcatgtacatgaccctgcggaatgccactcagcaaaaggacatggtggaggtggctgattttgacttttcccccatgtctgacaagaacccggagccaccctctggggtcaggtgctgctgccagatgtgctgtgggcctttcttgctggagactccatctgagtacctggaaattgttcgtgagaaccacgggctgctcccgcccctctataagtctgtcaaaacttacaccgtgtga

SEQ ID NO: 10190 - DNA, 317 bp, synthetic construct
  misc_feature 1..317: note = Synthetic polypeptide
  source 1..317: mol_type = other DNA
ggacagatgcggtggctcgtgcctgtaattgcagcactttgagaggccgaggaatccagccggctgtctttgctttcccatgtgctacacttatcactgtgatgttggccttcatcatgtacatgaccctgcggaatgccactcagcaaaaggacatggtggagaacccggagccaccctctggggtcaggtgctgctgccagatgtgctgtgggcctttcttgctggagactccatctgagtacctggaaattgttcgtgagaaccacgggctgctcccgcccctctataagtctgtcaaaacttacaccgtgtga

SEQ ID NO: 10191 - DNA, 934 bp, synthetic construct
  misc_feature 1..934: note = Synthetic polypeptide
  source 1..934: mol_type = other DNA
gggtgcaagcagtccttggctctagtccaggcctggccaccaacctttgggaggcctggggcagtgctctctctgggcctgcacatccctgtggcaaagggagatcagtcaccccaacatcgtcgctctggaggatgtccacgagagcccttcccacctctacctggccatggaactggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaagcccgaaaacctcctgtatgccacgccctttgaggactcgaagatcatggtctctgactttggactctccaaaatccaggctgggaacatgctaggcaccgcctgtgggacccctggatatgtggccccagagctcttggagcagaaaccctacgggaaggccgtagatgtgtgggccctgggcgtcatctcctacatcctgctgtgtgggtacccccccttctacgacgagagcgaccctgagctcttcagccagatcctgagggccagctatgagtttgactctcctttctgggatgacatctcagaatcagccaaagacttcatccggcaccttctggagcgagacccccagaagaggttcacctgccaacaggccttgcggcacctttggatctctggggacacagccttcgacagggacatcttaggctctgtcagtgagcagatccggaagaactttgctcggacacactggaagcgagccttcaatgccacctcgttcctgcgccacatccggaagctggggcagatcccagagggcgagggggcctctgagcagggcatggcccgccacagccactcaggcctccgtgctggccagccccccaagtggtga

SEQ ID NO: 10192 - DNA, 1003 bp, synthetic construct
  misc_feature 1..1003: note = Synthetic polypeptide
  source 1..1003: mol_type = other DNA
gggtgcaagcagtccttggctctagtccaggcctggccaccaacctttgggaggcctggggcagtgctctctctgggcctgcacatccctgtggcaaagggagatcagtcaccccaacatcgtcgctctggaggatgtccacgagagcccttcccacctctacctggccatggaactggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaagcccgaaaacctcctgtatgccacgccctttgaggactcgaagatcatggtctctgactttggactctccaaaatccaggctgggaacatgctaggcaccgcctgtgggacccctggatatgccgagccagtgacactgagcggcatggctgcgtgtgtgcctgtgcgtgcgtctgtctgtctctggcccccagccccagagctcttggagcagaaaccctacgggaaggccgtagatgtgtgggccctgggcgtcatctcctacatcctgctgtgtgggtacccccccttctacgacgagagcgaccctgagctcttcagccagatcctgagggccagctatgagtttgactctcctttctgggatgacatctcagaatcagccaaagacttcatccggcaccttctggagcgagacccccagaagaggttcacctgccaacaggccttgcggcacctttggatctctggggacacagccttcgacagggacatcttaggctctgtcagtgagcagatccggaagaactttgctcggacacactggaagcgagccttcaatgccacctcgttcctgcgccacatccggaagctggggcagatcccagagggcgagggggcctctgagcagggcatggcccgccacagccactcaggcctccgtgctggccagccccccaagtggtga

SEQ ID NO: 10193 - DNA, 580 bp, synthetic construct
  misc_feature 1..580: note = Synthetic polypeptide
  source 1..580: mol_type = other DNA
gggtgcaagcagtccttggctctagtccaggcctggccaccaacctttgggaggcctggggcagtgctctctctgggcctgcacatccctgtggcaaagggagatcagtcaccccaacatcgtcgctctggaggatgtccacgagagcccttcccacctctacctggccatggaactggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaagcccgaaaacctcctgtatgccacgccctttgaggactcgaagatcatggtctctgactttggactctccaaaatccaggctgggaacatgctaggcaccgcctgtgggacccctggatatgtggccccagagctcttggagcagaaaccctacgggaaggccgtagatgtgtgggccctgggcgtcatctcctacatcctgctgtgtgggtacccccccttctacgacgagagcgaccctgagctcttcagccagatcctgagg

SEQ ID NO: 10194 - DNA, 182 bp, synthetic construct
  misc_feature 1..182: note = Synthetic polypeptide
  source 1..182: mol_type = other DNA
gggtgcaagcagtccttggctctagtccaggcctggccaccaacctttgggaggcctggggcagtgctctctctgggcctgcacatccctgtggcaaagggagatcagtcaccccaacatcgtcgctctggaggatgtccacgagagcccttcccacctctacctggccatggaactggtga

SEQ ID NO: 10195 - DNA, 575 bp, synthetic construct
  misc_feature 1..575: note = Synthetic polypeptide
  source 1..575: mol_type = other DNA
gggtgcaagcagtccttggctctagtccaggcctggccaccaacctttgggaggcctggggcagtgctctctctgggcctgcacatccctgtggcaaagggagatcagtcaccccaacatcgtcgctctggaggatgtccacgagagcccttcccacctctacctggccatggaactggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaagcccgaaaacctcctgtatgccacgccctttgaggactcgaagatcatggtctctgactttggactctccaaaatccaggctgggaacatgctaggcaccgcctgtgggacccctggatatgtggccccagagctcttggagcagaaaccctacgggaaggccgtagatgtgtgggccctgggcgtcatctcctacatcctgctgtgtgggtacccccccttctacgacgagagcgaccctgagctcttcagccagatcc

SEQ ID NO: 10196 - DNA, 166 bp, synthetic construct
  misc_feature 1..166: note = Synthetic polypeptide
  source 1..166: mol_type = other DNA
gggtgcaagcagtccttggctctagtccaggcctggccaccaacctttgggaggcctggggcagtgctctctctgggcctgcacatccctgtggcaaagggagatcagtcaccccaacatcgtcgctctggaggatgtccacgagagcccttcccacctctacctg

SEQ ID NO: 10197 - DNA, 161 bp, synthetic construct
  misc_feature 1..161: note = Synthetic polypeptide
  source 1..161: mol_type = other DNA
gggtgcaagcagtccttggctctagtccaggcctggccaccaacctttgggaggcctggggcagtgctctctctgggcctgcacatccctgtggcaaagggagatcagtcaccccaacatcgtcgctctggaggatgtccacgagagcccttcccacctct

SEQ ID NO: 10198 - DNA, 88 bp, synthetic construct
  misc_feature 1..88: note = Synthetic polypeptide
  source 1..88: mol_type = other DNA
cctctctccttcattttcctcactgaaacaaaatgtacggaccaggtgactctgaggcttctttcagttataagatactatgtattag

SEQ ID NO: 10199 - DNA, 1946 bp, synthetic construct
  misc_feature 1..1946: note = Synthetic polypeptide
  source 1..1946: mol_type = other DNA
gccaggcaccgcgtctcacacctgtaatcccagcactttgggaggccgaggcaggtggttcacctgaggccaggagttcaagaccagcctgaccaccatgggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccgtggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcaccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtga

SEQ ID NO: 10200 - DNA, 2084 bp, synthetic construct
  misc_feature 1..2084: note = Synthetic polypeptide
  source 1..2084: mol_type = other DNA
gccaggcaccgcgtctcacacctgtaatcccagcactttgggaggccgaggcaggtggttcacctgaggccaggagttcaagaccagcctgaccaccatgggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccgtggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcaccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagaaaagcgccctcatcaagttagccaacatccgggcagcggaaaaggttgaggaaaagagctttggcggctcgcacgtcatgcaggtcatctacacggacgacgccggcaggccccagactgcctacctgcagtgcaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtga

SEQ ID NO: 10201 - DNA, 543 bp, synthetic construct
  misc_feature 1..543: note = Synthetic polypeptide
  source 1..543: mol_type = other DNA
tgatgtggtttggctgtgtccctacccaaatctgatcttgcattcccacatgttgtgggaggggcctggtgggaggtaattgaatcatggggacaggtctttcccatgctgttctcgtgatagtgggtaagtctcatgacatctgatggtgatataagaaggagtttccctgcacaagctctctttttgcctgctgccatccatgttagacgtgactttgctcctcctttgccttcttccatgattgtgaggcctccccagccatgtggaactacagtgaccaacaccttcaggacgaacaatatccagatccagagccgggaccagaggctgctgacactgtcgctggacaaggacgatcaacgcactttcagggatgtggtcagattcgaggttgctccctgcccagaaccatgttctggggcccagaagtccaaggcaccgtggctcaatttgcatgggcaacaggaggtggaagcaatcaaagccaagcccaagccccttctgatgcccatcaacacattctctggtattgtccagtga

SEQ ID NO: 10202 - DNA, 717 bp, synthetic construct
  misc_feature 1..717: note = Synthetic polypeptide
  source 1..717: mol_type = other DNA
tctgccactgtctagctgttgattttcatgttccagctgctccggggcctcgcctactgtcaccaccgcaagatcctgcaccgggacctgaagccccagaacctgctcatcaacgagaggggggagctgaagctggccgactttggactggccagggccaagtcagtgcccacaaagacttactccaatgaggtggtgaccctgtggtacaggccccccgatgtgctgctgggatccacagagtactccacccccattgatatgtggggcgtgggctgcatccactacgagatggccacagggaggcccctcttcccgggctccacagtcaaggaggagctgcacctcatctttcgcctcctcgggacccccacagaagagacgtggcccggcgtgaccgccttctctgagttccgcacctacagcttcccctgctacctcccgcagccgctcatcaaccacgcgcccaggttggatacggatggcatccacctcctgagcagcctgctcctgtatgaatccaagagtcgcatgtcagcagaggctgccctgagtcactcctacttccggtctctgggagagcgtgtgcaccagcttgaagacactgcctccatcttctccctgaaggagatccagctccagaaggacccaggctaccgaggcttggccttccagcagccaggacgagggaagaacaggcggcagagcatcttctga

SEQ ID NO: 10203 - DNA, 101 bp, synthetic construct
  misc_feature 1..101: note = Synthetic polypeptide
  source 1..101: mol_type = other DNA
tctgccactgtctagctgttgattttcatgttccagctgctccggggcctcgcctactgtcaccaccgcaagatcctgcaccgggacctgaagccccagaa

SEQ ID NO: 10204 - DNA, 53 bp, synthetic construct
  misc_feature 1..53: note = Synthetic polypeptide
  source 1..53: mol_type = other DNA
tctgccactgtctagctgttgattttcatgttccagctgctccggggcctcgc

SEQ ID NO: 10205 - DNA, 761 bp, synthetic construct
  misc_feature 1..761: note = Synthetic polypeptide
  source 1..761: mol_type = other DNA
tatggtttgaatgtttgtcccctctaaaactcatattaaaaattaatccccaatgtggcagtattgagaggtggtgcctttaagaggtgattgagtcaagagggctctgcactaatgaatagattaatccatttatggattactggattaatagtttaacgggttaatgaattaccacgggactgggacttctagctttgtaagaagaggaagagagacccgagctagcacactcagtccccttgctatgtgatgttctttaccatctcaggactctgcacagagtccccaacagcaagaaggccctcaccagatacagccccttgacctgggacttctcagcctccataaccatttttggccatataaaccaccatctttcggggttgaaagattctcattgtctagtttttctgcaagccccacctgtgccctggatcattttagccagctttctctggattctcggaaatccctggacgtcttccacggctactgcaggatttagccaaatttgggtgctatttcccttttgtggagggacttttcatcacaatgagaaggacgtcttaggactccaggactttgagagagaaagtgtctctacaagtcaaagcaggaatatcagccttcttacactaggacaactccaaaattgtgtgattggcaaattgacaatcatcgatttgttgactgaacacctgttaggtgtaaggcacggtgtcatatgctttccttggggcttgccttcaagcagctaa

SEQ ID NO: 10206 - DNA, 2105 bp, synthetic construct; identical to SEQ ID NO: 9726
  misc_feature 1..2105: note = Synthetic polypeptide
  source 1..2105: mol_type = other DNA

SEQ ID NO: 10207 - DNA, 1592 bp, synthetic construct; identical to SEQ ID NO: 9727
  misc_feature 1..1592: note = Synthetic polypeptide
  source 1..1592: mol_type = other DNA

SEQ ID NO: 10208 - DNA, 2147 bp, synthetic construct; identical to SEQ ID NO: 9728
  misc_feature 1..2147: note = Synthetic polypeptide
  source 1..2147: mol_type = other DNA

SEQ ID NO: 10209 - DNA, 1960 bp, synthetic construct
  misc_feature 1..1960: note = Synthetic polypeptide
  source 1..1960: mol_type = other DNA
aggagtggcctcactgtgctctgttctggactaaaatgctatgttctgcactgggtaccacatttaaagggagtattgccaactacggcatgtttagctgaaagagaatgagctgggaaggcttttaacaatattttgagaagaatagtcaagatagaggatatttttctgaagagaaaacaaaacctggctggaaaagacatctaattaagcatttgaaagacagttatatgaaagagtgatttaccttattctgtaacagcacagggctgaattatggccaatatgtttaaaatagtatagagagaagatttcagctcaatagggagaaatgtgctaatatgtagagctgtccaaaaatcaaattgactcttttggaaagcagtgggttgattctctcatatcacccaagaatacagttatttctgtgaatccatccacaaagctgcaagaaggtggctctgtgaccatgacctgttccagcgagggtctaccagctccagagattttctggagtaagaaattagataatgggaatctacagcacctttctggaaatgcaactctcaccttaattgctatgaggatggaagattctggaatttatgtgtgtgaaggagttaatttgattgggaaaaacagaaaagaggtggaattaattgttcaagagaaaccatttactgttgagatctcccctggaccccggattgctgctcagattggagactcagtcatgttgacatgtagtgtcatgggctgtgaatccccatctttctcctggagaacccagatagacagccctctgagcgggaaggtgaggagtgaggggaccaattccacgctgaccctgagccctgtgagttttgagaacgaacactcttatctgtgcacagtgacttgtggacataagaaactggaaaagggaatccaggtggagctctactcattccctagagatccagaaatcgagatgagtggtggcctcgtgaatgggagctctgtcactgtaagctgcaaggttcctagcgtgtacccccttgaccggctggagattgaattacttaagggggagactattctggagaatatagagtttttggaggatacggatatgaaatctctagagaacaaaagtttggaaatgaccttcatccctaccattgaagatactggaaaagctcttgtttgtcaggctaagttacatattgatgacatggaattcgaacccaaacaaaggcagagtacgcaaacactttatgtcaatgttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccttaatttctacaaaaatggaagattctggggtttatttatgtgaaggaattaaccaggctggaagaagcagaaaggaagtggaattaattatccaagttactccaaaagacataaaacttacagcttttccttctgagagtgtcaaagaaggagacactgtcatcatctcttgtacatgtggaaatgttccagaaacatggataatcctgaagaaaaaagcggagacaggagacacagtactaaaatctatagatggcgcctataccatccgaaaggcccagttgaaggatgcgggagtatatgaatgtgaatctaaaaacaaagttggctcacaattaagaagtttaacacttgatgttcaaggaagagaaaacaacaaagactatttttctcctgagcttctcgtgctctattttgcatcctccttaataatacctgccattggaatgataatttactttgcaagaaaagccaacatgaaggggtcatatagtcttgtagaagcacagaagtcaaaagtgtag

SEQ ID NO: 10210 - DNA, 1684 bp, synthetic construct
  misc_feature 1..1684: note = Synthetic polypeptide
  source 1..1684: mol_type = other DNA
aggagtggcctcactgtgctctgttctggactaaaatgctatgttctgcactgggtaccacatttaaagggagtattgccaactacggcatgtttagctgaaagagaatgagctgggaaggcttttaacaatattttgagaagaatagtcaagatagaggatatttttctgaagagaaaacaaaacctggctggaaaagacatctaattaagcatttgaaagacagttatatgaaagagtgatttaccttattctgtaacagcacagggctgaattatggccaatatgtttaaaatagtatagagagaagatttcagctcaatagggagaaatgtgctaatatgtagagctgtccaaaaatcaaattgactcttttggaaagcagtgggttgattctctcatatcacccaagaatacagttatttctgtgaatccatccacaaagctgcaagaaggtggctctgtgaccatgacctgttccagcgagggtctaccagctccagagattttctggagtaagaaattagataatgggaatctacagcacctttctggaaatgcaactctcaccttaattgctatgaggatggaagattctggaatttatgtgtgtgaaggagttaatttgattgggaaaaacagaaaagaggtggaattaattgttcaagcattccctagagatccagaaatcgagatgagtggtggcctcgtgaatgggagctctgtcactgtaagctgcaaggttcctagcgtgtacccccttgaccggctggagattgaattacttaagggggagactattctggagaatatagagtttttggaggatacggatatgaaatctctagagaacaaaagtttggaaatgaccttcatccctaccattgaagatactggaaaagctcttgtttgtcaggctaagttacatattgatgacatggaattcgaacccaaacaaaggcagagtacgcaaacactttatgtcaatgttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccttaatttctacaaaaatggaagattctggggtttatttatgtgaaggaattaaccaggctggaagaagcagaaaggaagtggaattaattatccaagttactccaaaagacataaaacttacagcttttccttctgagagtgtcaaagaaggagacactgtcatcatctcttgtacatgtggaaatgttccagaaacatggataatcctgaagaaaaaagcggagacaggagacacagtactaaaatctatagatggcgcctataccatccgaaaggcccagttgaaggatgcgggagtatatgaatgtgaatctaaaaacaaagttggctcacaattaagaagtttaacacttgatgttcaaggaagagaaaacaacaaagactatttttctcctgagcttctcgtgctctattttgcatcctccttaataatacctgccattggaatgataatttactttgcaagaaaagccaacatgaaggggtcatatagtcttgtagaagcacagaagtcaaaagtgtag

SEQ ID NO: 10211 - DNA, 1363 bp, synthetic construct
  misc_feature 1..1363: note = Synthetic polypeptide
  source 1..1363: mol_type = other DNA
aggagtggcctcactgtgctctgttctggactaaaatgctatgttctgcactgggtaccacatttaaagggagtattgccaactacggcatgtttagctgaaagagaatgagctgggaaggcttttaacaatattttgagaagaatagtcaagatagaggatatttttctgaagagaaaacaaaacctggctggaaaagacatctaattaagcatttgaaagacagttatatgaaagagtgatttaccttattctgtaacagcacagggctgaattatggccaatatgtttaaaatagtatagagagaagatttcagctcaatagggagaaatgtgctaatatgtagagctgtccaaaaatcaaattgactcttttggaaagcagtgggttgattctctcatatcacccaagaatacagttatttctgtgaatccatccacaaagctgcaagaaggtggctctgtgaccatgacctgttccagcgagggtctaccagctccagagattttctggagtaagaaattagataatgggaatctacagcacctttctggaaatgcaactctcaccttaattgctatgaggatggaagattctggaatttatgtgtgtgaaggagttaatttgattgggaaaaacagaaaagaggtggaattaattgttcaagttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccttaatttctacaaaaatggaagattctggggtttatttatgtgaaggaattaaccaggctggaagaagcagaaaggaagtggaattaattatccaagttactccaaaagacataaaacttacagcttttccttctgagagtgtcaaagaaggagacactgtcatcatctcttgtacatgtggaaatgttccagaaacatggataatcctgaagaaaaaagcggagacaggagacacagtactaaaatctatagatggcgcctataccatccgaaaggcccagttgaaggatgcgggagtatatgaatgtgaatctaaaaacaaagttggctcacaattaagaagtttaacacttgatgttcaaggaagagaaaacaacaaagactatttttctcctgagcttctcgtgctctattttgcatcctccttaataatacctgccattggaatgataatttactttgcaagaaaagccaacatgaaggggtcatatagtcttgtagaagcacagaagtcaaaagtgtag

SEQ ID NO: 10212 - DNA, 693 bp, synthetic construct
  misc_feature 1..693: note = Synthetic polypeptide
  source 1..693: mol_type = other DNA
gccaggcatggtggcatgcagccgtagtcccaactgctcaggaggcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaacggctacaacttcaagtccgacatctggtccctgggctgtctgctgtacgagatggcagccctccagagccccttctatggagataagatgaatctcttctccctgtgccagaagatcgagcagtgtgactaccccccactccccggggagcactactccgagaagttacgagaactggtcagcatgtgcatctgccctgacccccaccagagacctgacatcggatacgtgcaccaggtggccaagcagatgcacatctggatgtccagcacctga

SEQ ID NO: 10213 - DNA, 410 bp, synthetic construct
  misc_feature 1..410: note = Synthetic polypeptide
  source 1..410: mol_type = other DNA
gccaggcatggtggcatgcagccgtagtcccaactgctcaggaggcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatcca

SEQ ID NO: 10214 - DNA, 557 bp, synthetic construct
  misc_feature 1..557: note = Synthetic polypeptide
  source 1..557: mol_type = other DNA
gccaggcatggtggcatgcagccgtagtcccaactgctcaggaggcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaacggctacaacttcaagtccgacatctggtccctgggctgtctgctgtacgagatggcagccctccagagccccttctatggagataagatgaatctcttctccctgtgccagaagatcgagcagtgtgactaccccccact

SEQ ID NO: 10215 - DNA, 373 bp, synthetic construct
  misc_feature 1..373: note = Synthetic polypeptide
  source 1..373: mol_type = other DNA
gccaggcatggtggcatgcagccgtagtcccaactgctcaggaggcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctag

SEQ ID NO: 10216 - DNA, 417 bp, synthetic construct
  misc_feature 1..417: note = Synthetic polypeptide
  source 1..417: mol_type = other DNA
gccaggcatggtggcatgcagccgtagtcccaactgctcaggaggcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaac

SEQ ID NO: 10217 - DNA, 232 bp, synthetic construct
  misc_feature 1..232: note = Synthetic polypeptide
  source 1..232: mol_type = other DNA
gccaggcatggtggcatgcagccgtagtcccaactgctcaggaggcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtgg

SEQ ID NO: 10218 - DNA, 411 bp, synthetic construct
  misc_feature 1..411: note = Synthetic polypeptide
  source 1..411: mol_type = other DNA
gccaggcatggtggcatgcagccgtagtcccaactgctcaggaggcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccat

SEQ ID NO: 10219 - DNA, 265 bp, synthetic construct
  misc_feature 1..265: note = Synthetic polypeptide
  source 1..265: mol_type = other DNA
gccaggcatggtggcatgcagccgtagtcccaactgctcaggaggcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgag

SEQ ID NO: 10220 - DNA, 380 bp, synthetic construct; identical to SEQ ID NO: 682
  misc_feature 1..380: note = Synthetic polypeptide
  source 1..380: mol_type = other DNA

SEQ ID NO: 10221 - DNA, 422 bp, synthetic construct; identical to SEQ ID NO: 683
  misc_feature 1..422: note = Synthetic polypeptide
  source 1..422: mol_type = other DNA

SEQ ID NO: 10222 - DNA, 271 bp, synthetic construct; identical to SEQ ID NO: 684
  misc_feature 1..271: note = Synthetic polypeptide
  source 1..271: mol_type = other DNA

SEQ ID NO: 10223 - DNA, 197 bp, synthetic construct; identical to SEQ ID NO: 685
  misc_feature 1..197: note = Synthetic polypeptide
  source 1..197: mol_type = other DNA

SEQ ID NO: 10224 - DNA, 524 bp, synthetic construct; identical to SEQ ID NO: 686
  misc_feature 1..524: note = Synthetic polypeptide
  source 1..524: mol_type = other DNA

SEQ ID NO: 10225 - DNA, 229 bp, synthetic construct
  misc_feature 1..229: note = Synthetic polypeptide
  source 1..229: mol_type = other DNA
ccccgtcagaatagaatctccttgtatgcaggatcaagactggaaaccactgcatcctggggatcccatgtttttaactcttgatgggaagacgatcccactgggcggagactgtaccgtgtaccccgtgtttgtgaatgaggccgcatattacgaaaagaaagaagcttttgcaaagacaactaaactaacgctcaatgcaaaaagtattcgctgctgtttacattag

SEQ ID NO: 10226 - DNA, 784 bp, synthetic construct
  misc_feature 1..784: note = Synthetic polypeptide
  source 1..784: mol_type = other DNA
ccgggcgtggtggctcacacctgtaatcccagcactctgggaggccaaggcaggcggatcacgacgtcagaatgcagagagcagtttgcagcagaagaatgaagccatcacatcctttgaaggaaaaaccaaccaagttatgtccagcatgaaacaaatggaagaaaggttgcagcactcggagcgggcgaggcagggggctgaggagcggagccacaagctgcagcaggagctgggcgggaggatcggcgccctgcagctgcagctctcccagctgcacgagcaatgctcaagcctggagaaagaattgaaatcagaaaaagagcaaagacaggctcttcagcgcgaattacagcacgagaaagacacttcctctctactcaggatggagctgcaacaagtggaaggactgaaaaaggagttgcgggagcttcaggacgagaaggcagagctgcagaagatctgcgaggagcaggaacaagccctccaggaaatgggcctgcacctcagccagtccaagctgaagatggaagatataaaagaagtgaaccaggcactgaagggccacgcctggctgaaagatgacgaagcgacacactgtaggcagtgtgagaaggagttctccatttcccggagaaagcaccactgccggaactgtggccacatcttctgcaacacctgctccagcaacgagctggccctgccctcctaccccaagccggtgcgagtgtgcgacagctgccacaccctgctcctgcagcgctgctcctccacggcctcctga

SEQ ID NO: 10227 - DNA, 103 bp, synthetic construct
  misc_feature 1..103: note = Synthetic polypeptide
  source 1..103: mol_type = other DNA
ccgggcgtggtggctcacacctgtaatcccagcactctgggaggccaaggcaggcggatcacgacgtcagaatgcagagagcagtttgcagcagaagaatgaa

SEQ ID NO: 10228 - DNA, 609 bp, synthetic construct
  misc_feature 1..609: note = Synthetic polypeptide
  source 1..609: mol_type = other DNA
ccgggcgtggtggctcacacctgtaatcccagcactctgggaggccaaggcaggcggatcacgacgtcagaatgcagagagcagtttgcagcagaagaatgaagccatcacatcctttgaaggaaaaaccaaccaagttatgtccagcatgaaacaaatggaagaaaggttgcagcactcggagcgggcgaggcagggggctgaggagcggagccacaagctgcagcaggagctgggcgggaggatcggcgccctgcagctgcagctctcccagctgcacgagcaatgctcaagcctggagaaagaattgaaatcagaaaaagagcaaagacaggctcttcagcgcgaattacagcacgagaaagacacttcctctctactcaggatggagctgcaacaagtggaaggactgaaaaaggagttgcgggagcttcaggacgagaaggcagagctgcagaagatctgcgaggagcaggaacaagccctccaggaaatgggcctgcacctcagccagtccaagctgaagatggaagatataaaagaagtgaaccaggcactgaagggccacgcctggctgaaagatgacgaagcgacacactgtaggcagtg

SEQ ID NO: 10229 - DNA, 1269 bp, synthetic construct; identical to SEQ ID NO: 616
  misc_feature 1..1269: note = Synthetic polypeptide
  source 1..1269: mol_type = other DNA

SEQ ID NO: 10230 - DNA, 1134 bp, synthetic construct; identical to SEQ ID NO: 617
  misc_feature 1..1134: note = Synthetic polypeptide
  source 1..1134: mol_type = other DNA

SEQ ID NO: 10231 - DNA, 501 bp, synthetic construct; identical to SEQ ID NO: 618
  misc_feature 1..501: note = Synthetic polypeptide
  source 1..501: mol_type = other DNA

SEQ ID NO: 10232 - DNA, 1321 bp, synthetic construct; identical to SEQ ID NO: 619
  misc_feature 1..1321: note = Synthetic polypeptide
  source 1..1321: mol_type = other DNA

SEQ ID NO: 10233 - DNA, 1197 bp, synthetic construct; identical to SEQ ID NO: 620
  misc_feature 1..1197: note = Synthetic polypeptide
  source 1..1197: mol_type = other DNA

SEQ ID NO: 10234 - DNA, 1203 bp, synthetic construct; identical to SEQ ID NO: 621
  misc_feature 1..1203: note = Synthetic polypeptide
  source 1..1203: mol_type = other DNA

SEQ ID NO: 10235 - DNA, 1131 bp, synthetic construct; identical to SEQ ID NO: 622
  misc_feature 1..1131: note = Synthetic polypeptide
  source 1..1131: mol_type = other DNA

SEQ ID NO: 10236 - DNA, 642 bp, synthetic construct; identical to SEQ ID NO: 623
  misc_feature 1..642: note = Synthetic polypeptide
  source 1..642: mol_type = other DNA

SEQ ID NO: 10237 - DNA, 526 bp, synthetic construct
  misc_feature 1..526: note = Synthetic polypeptide
  source 1..526: mol_type = other DNA
tgatatggcttgtctgtgttcccacccaaatctcatcttgaattcccacatgttgtgggaggtacacagtgggaggtaattgaattgtgggggtagatctttcccatgctgttctcgtgatagtgagtaagtctcatgagatctgatggttctataagggggagtttccctgcacaagctctctgtttgcctgctgccatccatgtaagatgtgacttgcttctccttgccttctgccatgattgtgaggcttccccagccacatgaaactgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagaga

SEQ ID NO: 10238 - DNA, 1314 bp, synthetic construct
  misc_feature 1..1314: note = Synthetic polypeptide
  source 1..1314: mol_type = other DNA
tgatatggcttgtctgtgttcccacccaaatctcatcttgaattcccacatgttgtgggaggtacacagtgggaggtaattgaattgtgggggtagatctttcccatgctgttctcgtgatagtgagtaagtctcatgagatctgatggttctataagggggagtttccctgcacaagctctctgtttgcctgctgccatccatgtaagatgtgacttgcttctccttgccttctgccatgattgtgaggcttccccagccacatgaaactgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaagggatgccaagggagcagagatgcctgcagcccgtgggagcaagtcctggcctttgcagttgcaaaaactggctgcaagctgctccagccccagaggaactggccaagctccagagggcctccttggagggcctcagagggagagagaactgctcagtaa

SEQ ID NO: 10239 - DNA, 1218 bp, synthetic construct
  misc_feature 1..1218: note = Synthetic polypeptide
  source 1..1218: mol_type = other DNA
tgatatggcttgtctgtgttcccacccaaatctcatcttgaattcccacatgttgtgggaggtacacagtgggaggtaattgaattgtgggggtagatctttcccatgctgttctcgtgatagtgagtaagtctcatgagatctgatggttctataagggggagtttccctgcacaagctctctgtttgcctgctgccatccatgtaagatgtgacttgcttctccttgccttctgccatgattgtgaggcttccccagccacatgaaactgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaggcttatttcaaaacctttgtccctcagttccaggaggcagcatttgccaatggaaagctctag

SEQ ID NO: 10240 - DNA, 1197 bp, synthetic construct
  misc_feature 1..1197: note = Synthetic polypeptide
  source 1..1197: mol_type = other DNA
tgatatggcttgtctgtgttcccacccaaatctcatcttgaattcccacatgttgtgggaggtacacagtgggaggtaattgaattgtgggggtagatctttcccatgctgttctcgtgatagtgagtaagtctcatgagatctgatggttctataagggggagtttccctgcacaagctctctgtttgcctgctgccatccatgtaagatgtgacttgcttctccttgccttctgccatgattgtgaggcttccccagccacatgaaactgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaaagagagagcaacagagatggggaggaatccagctctgcctga

SEQ ID NO: 10241 - DNA, 919 bp, synthetic construct
  misc_feature 1..919: note = Synthetic polypeptide
  source 1..919: mol_type = other DNA
tgatatggcttgtctgtgttcccacccaaatctcatcttgaattcccacatgttgtgggaggtacacagtgggaggtaattgaattgtgggggtagatctttcccatgctgttctcgtgatagtgagtaagtctcatgagatctgatggttctataagggggagtttccctgcacaagctctctgtttgcctgctgccatccatgtaagatgtgacttgcttctccttgccttctgccatgattgtgaggcttccccagccacatgaaactgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcagttaagcctgagcccttgccacacggatttccttctcacccgcttcctccccgcaccactctggggatcagaagtatcagtgccaagtggtccctttcatctcctcataattcttccccagccacttagtgggttagtcaggccctgccttctcttcagccagccctgcagtc

SEQ ID NO: 10242 - DNA, 629 bp, synthetic construct
  misc_feature 1..629: note = Synthetic polypeptide
  source 1..629: mol_type = other DNA
tgatatggcttgtctgtgttcccacccaaatctcatcttgaattcccacatgttgtgggaggtacacagtgggaggtaattgaattgtgggggtagatctttcccatgctgttctcgtgatagtgagtaagtctcatgagatctgatggttctataagggggagtttccctgcacaagctctctgtttgcctgctgccatccatgtaagatgtgacttgcttctccttgccttctgccatgattgtgaggcttccccagccacatgaaactgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactgggtaaggatttttgagaatggaaaaaaagatgacttcatccataataaaataatcaattcatatgtcca

SEQ ID NO: 10243 - DNA, 1784 bp, synthetic construct
  misc_feature 1..1784: note = Synthetic polypeptide
  source 1..1784: mol_type = other DNA
aggagtggcctcactgtgctctgttctggactaaaatgctatgttctgcactgggtaccacatttaaagggagtattgccaactacggcatgtttagctgaaagagaatgagctgggaaggcttttaacaatattttgagaagaatagtcaagatagaggatatttttctgaagagaaaacaaaacctggctggaaaagacatctaattaagcatttgaaagacatatcacccaagaatacagttatttctgtgaatccatccacaaagctgcaagaaggtggctctgtgaccatgacctgttccagcgagggtctaccagctccagagattttctggagtaagaaattagataatgggaatctacagcacctttctggaaatgcaactctcaccttaattgctatgaggatggaagattctggaatttatgtgtgtgaaggagttaatttgattgggaaaaacagaaaagaggtggaattaattgttcaagagaaaccatttactgttgagatctcccctggaccccggattgctgctcagattggagactcagtcatgttgacatgtagtgtcatgggctgtgaatccccatctttctcctggagaacccagatagacagccctctgagcgggaaggtgaggagtgaggggaccaattccacgctgaccctgagccctgtgagttttgagaacgaacactcttatctgtgcacagtgacttgtggacataagaaactggaaaagggaatccaggtggagctctactcattccctagagatccagaaatcgagatgagtggtggcctcgtgaatgggagctctgtcactgtaagctgcaaggttcctagcgtgtacccccttgaccggctggagattgaattacttaagggggagactattctggagaatatagagtttttggaggatacggatatgaaatctctagagaacaaaagtttggaaatgaccttcatccctaccattgaagatactggaaaagctcttgtttgtcaggctaagttacatattgatgacatggaattcgaacccaaacaaaggcagagtacgcaaacactttatgtcaatgttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccttaatttctacaaaaatggaagattctggggtttatttatgtgaaggaattaaccaggctggaagaagcagaaaggaagtggaattaattatccaagttactccaaaagacataaaacttacagcttttccttctgagagtgtcaaagaaggagacactgtcatcatctcttgtacatgtggaaatgttccagaaacatggataatcctgaagaaaaaagcggagacaggagacacagtactaaaatctatagatggcgcctataccatccgaaaggcccagttgaaggatgcgggagtatatgaatgtgaatctaaaaacaaagttggctcacaattaagaagtttaacacttgatgttcaaggaagagaaaacaacaaagactatttttctcctgagcttctcgtgctctattttgcatcctccttaataatacctgccattggaatgataatttactttgcaagaaaagccaacatgaaggggtcatatagtcttgtagaagcacagaagtcaaaagtgtag

SEQ ID NO: 10244 - DNA, 1508 bp, synthetic construct
  misc_feature 1..1508: note = Synthetic polypeptide
  source 1..1508: mol_type = other DNA
aggagtggcctcactgtgctctgttctggactaaaatgctatgttctgcactgggtaccacatttaaagggagtattgccaactacggcatgtttagctgaaagagaatgagctgggaaggcttttaacaatattttgagaagaatagtcaagatagaggatatttttctgaagagaaaacaaaacctggctggaaaagacatctaattaagcatttgaaagacatatcacccaagaatacagttatttctgtgaatccatccacaaagctgcaagaaggtggctctgtgaccatgacctgttccagcgagggtctaccagctccagagattttctggagtaagaaattagataatgggaatctacagcacctttctggaaatgcaactctcaccttaattgctatgaggatggaagattctggaatttatgtgtgtgaaggagttaatttgattgggaaaaacagaaaagaggtggaattaattgttcaagcattccctagagatccagaaatcgagatgagtggtggcctcgtgaatgggagctctgtcactgtaagctgcaaggttcctagcgtgtacccccttgaccggctggagattgaattacttaagggggagactattctggagaatatagagtttttggaggatacggatatgaaatctctagagaacaaaagtttggaaatgaccttcatccctaccattgaagatactggaaaagctcttgtttgtcaggctaagttacatattgatgacatggaattcgaacccaaacaaaggcagagtacgcaaacactttatgtcaatgttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccttaatttctacaaaaatggaagattctggggtttatttatgtgaaggaattaaccaggctggaagaagcagaaaggaagtggaattaattatccaagttactccaaaagacataaaacttacagcttttccttctgagagtgtcaaagaaggagacactgtcatcatctcttgtacatgtggaaatgttccagaaacatggataatcctgaagaaaaaagcggagacaggagacacagtactaaaatctatagatggcgcctataccatccgaaaggcccagttgaaggatgcgggagtatatgaatgtgaatctaaaaacaaagttggctcacaattaagaagtttaacacttgatgttcaaggaagagaaaacaacaaagactatttttctcctgagcttctcgtgctctattttgcatcctccttaataatacctgccattggaatgataatttactttgcaagaaaagccaacatgaaggggtcatatagtcttgtagaagcacagaagtcaaaagtgtag

SEQ ID NO: 10245 - DNA, 1187 bp, synthetic construct
  misc_feature 1..1187: note = Synthetic polypeptide
  source 1..1187: mol_type = other DNA
aggagtggcctcactgtgctctgttctggactaaaatgctatgttctgcactgggtaccacatttaaagggagtattgccaactacggcatgtttagctgaaagagaatgagctgggaaggcttttaacaatattttgagaagaatagtcaagatagaggatatttttctgaagagaaaacaaaacctggctggaaaagacatctaattaagcatttgaaagacatatcacccaagaatacagttatttctgtgaatccatccacaaagctgcaagaaggtggctctgtgaccatgacctgttccagcgagggtctaccagctccagagattttctggagtaagaaattagataatgggaatctacagcacctttctggaaatgcaactctcaccttaattgctatgaggatggaagattctggaatttatgtgtgtgaaggagttaatttgattgggaaaaacagaaaagaggtggaattaattgttcaagttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccttaatttctacaaaaatggaagattctggggtttatttatgtgaaggaattaaccaggctggaagaagcagaaaggaagtggaattaattatccaagttactccaaaagacataaaacttacagcttttccttctgagagtgtcaaagaaggagacactgtcatcatctcttgtacatgtggaaatgttccagaaacatggataatcctgaagaaaaaagcggagacaggagacacagtactaaaatctatagatggcgcctataccatccgaaaggcccagttgaaggatgcgggagtatatgaatgtgaatctaaaaacaaagttggctcacaattaagaagtttaacacttgatgttcaaggaagagaaaacaacaaagactatttttctcctgagcttctcgtgctctattttgcatcctccttaataatacctgccattggaatgataatttactttgcaagaaaagccaacatgaaggggtcatatagtcttgtagaagcacagaagtcaaaagtgtag

SEQ ID NO: 10246 - DNA, 853 bp, synthetic construct
  misc_feature 1..853: note = Synthetic polypeptide
  source 1..853: mol_type = other DNA
tatgttcactccacttggatttgagctggccttgggatttgcatcagctactagaatgtggcagcagcaatgttgtgccaactccaggcttagccacttagagccctgacagcttctgctgtggctcaccttggagccctgagccaccaaataaggaattcaacaaccctgctgaggagaggcccagacagctcccagatcttcagccaccacagctgaggacccagatatggacctgatgcccagaaccctggacgggcagatcaccatggagaagacgcccagttacttcgtcacgcgggaggcccccgcgcgcatctcggccatgtccaaggacaccaagctcatcgtggtggtgcgggacccggtgaccagggccatctcggactacacgcagacgctgtccaagcggcccgacatccccaccttcgagagcttgacgttcaaaaacaggacagcgggcctcatcgacacgtcgtggagcgccatccagatcggcatctacgccaagcacctggagcactggctgcgccacttccccatccgccagatgctcttcgtgagcggcgagcggctcatcagcgacccggccggggagctgggccgcgtgcaagacttcctgggcctcaagaggatcatcacggacaagcacttctacttcaacaagaccaagggcttcccctgcctgaagaaggcggagggcagcagccggccccattgcctgggcaagaccaagggcaggacccatcctgagatcgaccgcgaggtggtgcgcaggctgcgcgagttctaccggcctttcaacctcaagttctaccagatgaccgggcacgactttggctgggatggataa

SEQ ID NO: 10247 - DNA, 1085 bp, synthetic construct
  misc_feature 1..1085: note = Synthetic polypeptide
  source 1..1085: mol_type = other DNA
acagcatgaaggttaagagcggaggacacagagtgaacacctacctcttcatgatgcaagcccaaggcattctgatccgggacaacgtgagaacaatcggtgctcaggtttatgagcaggtgcttcggagtgcttatgccaagaggaacagcagtgtaaatgactcagattatcctcttgacttgaaccacagtgaaaccttcctgcaaactacaacatttcttcctgaagacttcacctactttgcaaaccatacctgccctgaaagactcccttccatgaagggcccaatagacataaacatgagtgaaattggaatggattacattcatgaactcttctccaaagacccaaccatcaagctcggaggtcactggaagccttctgattgcatgcctcggtggaaggtggcgatccttatccccttccggaaccgccacgagcacctcccagtcctgttcagacacctgcttcccatgctccagcgccagcgcttgcagtttgcattttatgtggttgaacaagttggtacccaaccctttaatcgagccatgcttttcaacgttggctttcaagaggcaatgaaagacttggattgggactgtttgatttttcatgatgtagatcacataccggaaagtgatcgcaactattatggatgtggacagatgccgaggcattttgcaaccaaattggataagtatatgtatctgcttccttataccgagttctttggcggagtgagtggcttaacagtggaacaatttcggaaaatcaatggctttcctaatgctttctggggttggggtggagaagatgacgacctctggaacagagtacagaatgcaggctattctgtgagccggccagagggtgacacaggaaagtacaagtccattcctcatcaccatcgaggagaagtccagtttcttggaaggtatgctctgctgaggaagtcaaaagaacggcaagggctggatggcctcaacaacctgaactactttgcaaacatcacatacgacgccttgtataaaaacataactgtcaacctgacacccgagctggctcaggtgaacgagtactga

SEQ ID NO: 10248 - DNA, 577 bp, synthetic construct
  misc_feature 1..577: note = Synthetic polypeptide
  source 1..577: mol_type = other DNA
cagtgcaaagggtcactttctggggaacaacacagtcatcgacatcctgcggcaggcagggctggaggtggaccacacacccgccgggcaggccatacacagccctgccccccagagcccagcgccctctcctgaggggacctcgacgagcccggccccagtgaccccagctgccgctgtccccgaagcaccctctgtgacccccaccgccccaccagaggatgaggatccagccctgtccccacacctcctgctccccgacagcctcagccagctggaggagtttggccggcagaggaagtggcacaagaggcagagcacacaccagcggccgcggcagttcaatgacctctgggtccgcatcgaggacagcaccaccgcctcaccacccccgctgcccctgcagcccacccacagctcggggaccgccaagccccccttccagctttcagaccagctacaacagcaggacccgccagggcccgccagcagctcggcacccaccctgggccttctccccgccatcgccaccaccatcgctgtctgcttcctgctgcatagccttgggccctcctga

SEQ ID NO: 10249 - DNA, 519 bp, synthetic construct; identical to SEQ ID NO: 9679
  misc_feature 1..519: note = Synthetic polypeptide
  source 1..519: mol_type = other DNA

SEQ ID NO: 10250 - DNA, 213 bp, synthetic construct; identical to SEQ ID NO: 9680
  misc_feature 1..213: note = Synthetic polypeptide
  source 1..213: mol_type = other DNA

SEQ ID NO: 10251 - DNA, 773 bp, synthetic construct
  misc_feature 1..773: note = Synthetic polypeptide
  source 1..773: mol_type = other DNA
tttcttggttccctgaccaggaaacgaggtaactgatggacagccgaggcagccccttaggcggcttaggcctcccctgtggagcatccctgaggcggactccggccagcccgagtgacgcgatccaaagagcactcccgggtaggaaattgccccggtggaatgcctcaccagagcagcgtgtagcagttccctgtggaggattaacacagtggctgaacaccgggaaggaactggcacttggagtccggacatctgaaacttgagtcatggaggtctggcatggcttagtgatcgcggtggtgtccctcttcctgcaggcctgcttcctcaccgccatcaactacctgctcagcaggcacatggcccacaagagtgaacagatactgaaagcggccagtctccaggttcccaggcccagccctggccaccatcatccacctgctgtcaaagagatgaaggagactcagacagagagagacatcccaatgtctgattccctttacaggcatgacagcgacacaccctcagatagcttggatagctcctgcagttcgcctcctgcctgccaggccacagaggatgtggattacacacaagtcgtcttttctgaccctggagaactaaaaaatgactccccgctggactatgagaacataaaggaaatcacagattatgtcaatgtcaatccagaaagacacaagcccagtttctggtattttgtcaaccctgctctgtctgagccagcggaatatgatcaagtggccatgtga

SEQ ID NO: 10252 - DNA, 1110 bp, synthetic construct; identical to SEQ ID NO: 8310
  misc_feature 1..1110: note = Synthetic polypeptide
  source 1..1110: mol_type = other DNA

SEQ ID NO: 10253 - DNA, 175 bp, synthetic construct
  misc_feature 1..175: note = Synthetic polypeptide
  source 1..175: mol_type = other DNA
tgaaaggaccccaggcatcagtattcagagactgcgattgttacattagcgtgactttttgcaacttatgtgactttggctccagaaacatgacaaggaggactttcctgcctcttggagatcagaggaggaaatggcagcagaagccgcagctctgcgggtctactttcagtga

SEQ ID NO: 10254 - DNA, 1911 bp, synthetic construct
  misc_feature 1..1911: note = Synthetic polypeptide
  source 1..1911: mol_type = other DNA
tgtgatggttaatactgagtgtcaattgattgaattgaaggatacaaagtgttgatcctgggtgtgtctgtgagggtgttgtcaaaagagattaacatttgagtcggtgggctgggagaggcagacccacccttaatctgggtaggcaccacctaatccagcatgactagaatataaggaggcagaaaaatatgaaaagagagactggcctagcttcccagcctagatctttcttccgtactggatgcttcctgcccttgaacatcagactccaggttcttcagttttggaactcaaactggctctccttgcacctcagcctgcagatggcctattgtgggaccttgtgatcatgctggcaagcgactcccaagcccagccctgtggtgggtgaatgggaaggggaaggaattaatgtggaatttcagagaactgagtgaaaacagccagcaggcagccaacatcctctcgggagcctgtggcctgcagcgtggggatcgtgtggcagtgatgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgcgatgggtggctgaacttcaagaaactactaaatgaggcatccaccactcatcactgtgtggagactggaagccaggaagcatctgccatctacttcactagtgggaccagtggtcttcccaagatggcagaacattcctactcgagcctgggcctcaaggccaagatggatgctggttggacaggcctgcaagcctctgatataatgtggaccatatcagacacaggttggatactgaacatcttgggctcacttttggaatcttggacattaggagcatgcacatttgttcatctcttgccaaagtttgacccactggttattctaaagacactctccagttatccaatcaagagtatgatgggtgcccctattgtttaccggatgttgctacagcaggatctttccagttacaagttcccccatctacagaactgcctcgctggaggggagtcccttcttccagaaactctggagaactggagggcccagacaggactggacatccgagaattctatggccagacagaaacgggattaacttgcatggtttccaagacaatgaaaatcaaaccaggatacatgggaacggctgcttcctgttatgatgtacaggttatagatgataagggcaacgtcctgccccccggcacagaaggagacattggcatcagggtcaaacccatcaggcctataggcatcttctctggctatgtggaaaatcccgacaagacagcagccaacattcgaggagacttttggctccttggagaccggggaatcaaagatgaagatgggtatttccagtttatgggacgggcagatgatatcattaactccagcgggtaccggattggaccctcggaggtagagaatgcactgatgaagcaccctgctgtggttgagacggctgtgatcagcagcccagaccccgtccgaggagaggtggtgaaggcatttgtgatcctggcctcgcagttcctatcccatgacccagaacagctcaccaaggagctgcagcagcatgtgaagtcagtgacagccccatacaagtacccaagaaagatagagtttgtcttgaacctgcccaagactgtcacagggaaaattcaacgaaccaaacttcgagacaaggagtggaagatgtccggaaaagcccgtgcgcagtga

SEQ ID NO: 10255 - DNA, 804 bp, synthetic construct
  misc_feature 1..804: note = Synthetic polypeptide
  source 1..804: mol_type = other DNA
tgtgatggttaatactgagtgtcaattgattgaattgaaggatacaaagtgttgatcctgggtgtgtctgtgagggtgttgtcaaaagagattaacatttgagtcggtgggctgggagaggcagacccacccttaatctgggtaggcaccacctaatccagcatgactagaatataaggaggcagaaaaatatgaaaagagagactggcctagcttcccagcctagatctttcttccgtactggatgcttcctgcccttgaacatcagactccaggttcttcagttttggaactcaaactggctctccttgcacctcagcctgcagatggcctattgtgggaccttgtgatcatgctggcaagcgactcccaagcccagccctgtggtgggtgaatgggaaggggaaggaattaatgtggaatttcagagaactgagtgaaaacagccagcaggcagccaacatcctctcgggagcctgtggcctgcagcgtggggatcgtgtggcagtgatgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgcgatgggtggctgaacttcaagaaactactaaaatataaagtgagacacagagaagttaaataa

SEQ ID NO: 10256 - DNA, 531 bp, synthetic construct
  misc_feature 1..531: note = Synthetic polypeptide
  source 1..531: mol_type = other DNA
tgtgatggttaatactgagtgtcaattgattgaattgaaggatacaaagtgttgatcctgggtgtgtctgtgagggtgttgtcaaaagagattaacatttgagtcggtgggctgggagaggcagacccacccttaatctgggtaggcaccacctaatccagcatgactagaatataaggaggcagaaaaatatgaaaagagagactggcctagcttcccagcctagatctttcttccgtactggatgcttcctgcccttgaacatcagactccaggttcttcagttttggaactcaaactggctctccttgcacctcagcctgcagatggcctattgtgggaccttgtgatcatgctggcaagcgactcccaagcccagccctgtggtgggtgaatgggaaggggaaggaattaatgtggaatttcagagaactgagtgaaaacagccagcaggcagccaacatcctctcgggagcctgtggcctgcagcgtggggatcgtgtggcagtgatgctgccccgagtgcctgag

SEQ ID NO: 10257 - DNA, 494 bp, synthetic construct
  misc_feature 1..494: note = Synthetic polypeptide
  source 1..494: mol_type = other DNA
tgtgatggttaatactgagtgtcaattgattgaattgaaggatacaaagtgttgatcctgggtgtgtctgtgagggtgttgtcaaaagagattaacatttgagtcggtgggctgggagaggcagacccacccttaatctgggtaggcaccacctaatccagcatgactagaatataaggaggcagaaaaatatgaaaagagagactggcctagcttcccagcctagatctttcttccgtactggatgcttcctgcccttgaacatcagactccaggttcttcagttttggaactcaaactggctctccttgcacctcagcctgcagatggcctattgtgggaccttgtgatcatgctggcaagcgactcccaagcccagccctgtggtgggtgaatgggaaggggaaggaattaatgtggaatttcagagaactgagtgaaaacagccagcaggcagccaacatcctctcgggagcctgtggcctgcagcgtgg

SEQ ID NO: 10258 - DNA, 1335 bp, synthetic construct
  misc_feature 1..1335: note = Synthetic polypeptide
  source 1..1335: mol_type = other DNA
aggggaaaataataacttacgtgtgtggaaacacctggcagacactcttcccaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatga

SEQ ID NO: 10259 - DNA, 1197 bp, synthetic construct
  misc_feature 1..1197: note = Synthetic polypeptide
  source 1..1197: mol_type = other DNA
aggggaaaataataacttacgtgtgtggaaacacctggcagacactcttcccaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatga

SEQ ID NO: 10260 - DNA, 2084 bp, synthetic construct
  misc_feature 1..2084: note = Synthetic polypeptide
  source 1..2084: mol_type = other DNA
gccaggcacggcgtctcacacctgtaatcccagcactttgggaggccgaggcaggtggttcacctgaggccaggagttcaagaccagcctgaccaccatgggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccatggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcgccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagaaaagcgccctcatcaagttagccaacatccgggcagcggaaaaggttgaggaaaagagctttggcggctcgcacgtcatgcaggtcatctacacggacgacgccggcaggccccagactgcctacctgcagtgcaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtga

SEQ ID NO: 10261 - DNA, 1946 bp, synthetic construct
  misc_feature 1..1946: note = Synthetic polypeptide
  source 1..1946: mol_type = other DNA
gccaggcacggcgtctcacacctgtaatcccagcactttgggaggccgaggcaggtggttcacctgaggccaggagttcaagaccagcctgaccaccatgggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccatggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcgccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtga

SEQ ID NO: 10262 - DNA, 647 bp, synthetic construct
  misc_feature 1..647: note = Synthetic polypeptide
  source 1..647: mol_type = other DNA
gccaggcacggcgtctcacacctgtaatcccagcactttgggaggccgaggcaggtggttcacctgaggccaggagttcaagaccagcctgaccaccatgggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggac

SEQ ID NO: 10263 - DNA, 182 bp, synthetic construct
  misc_feature 1..182: note = Synthetic polypeptide
  source 1..182: mol_type = other DNA
gccaggcacggcgtctcacacctgtaatcccagcactttgggaggccgaggcaggtggttcacctgaggccaggagttcaagaccagcctgaccaccatgggatctggccccaaaggaccgcaatggcacatctgaccccttcgtccgagtgcgctacaagggccggacacgggagacctcg

SEQ ID NO: 10264 - DNA, 1486 bp, synthetic construct
  misc_feature 1..1486: note = Synthetic polypeptide
  source 1..1486: mol_type = other DNA
acagtaggacagggcaccagtcagagtcatgagaccgcctttccaggacttagctaccagatgacttttctagacacagcctgcatcagaagggaacttgctgccttgaaaggaaagatccagtccaggagtcatcacttgctaactgaagagtccttgggcccttataaccagcagcaatacacagtttgtgaagaaatatgggaacctttttagcttggagcttggtgacatatctgcagttcttattactggcttgcccttaatcaaagaagcccttatccacatggaccaaaactttgggaaccgccccgtgacccctatgcgagaacatatctttaagaaaaatggattgattatgtcaagtggccaggcatggaaggagcaaagaaggttcactctgacagcactaaggaactttggtttaggaaagaagagcttagaggaacgcattcaggaggaggcccaacacctcactgaagcaataaaagaggagaacggacagccttttgaccctcatttcaagatcaacaatgcagtttccaatatcatttgctccatcaccttcggagaacgctttgagtaccaggatagttggtttcagcagctgctgaagttactagatgaagtcacatacttggaggcttcaaagacatgccagctctacaatgtctttccatggataatgaaattcctgcctggaccccaccaaactctcttcagcaactggaaaaaactgaaattgtttgtttctcatatgattgacaaacacagaaaggattggaatcctgcagaaacaagagactttattgatgcttaccttaaagaaatgtcaaagcacacaggcaatcctacttcaagtttccatgaagaaaacctcatctgcagcaccctggacctcttctttgccggaaccgagacaacttccacaactctgcgatgggctctgctttatatggccctctacccagaaatccaagaaaaagtacaagctgagattgacagagtgattggccaggggcagcagccgagcacagccgcccgggagtccatgccctacaccaatgctgtcatccatgaggtgcagagaatgggcaacatcatccccctgaacgttcccagggaagtgacagttgataccactttggctgggtaccacctgcccaagggtaccatgatcctgaccaatttgacggcgctgcacagggaccccacagagtgggccacccctgacacattcaatccggaccattttctggagaatggacagtttaagaaaagggaagcctttatgcctttctcaataggaaagcgggcatgcctcggagaacagttggccaggactgagctgtttattttcttcacttcccttatgcaaaaatttaccttcaggcccccaaacaatgagaagctgagcctgaagtttagaatgggtatcaccatttccccagtcagtcaccgcctctgcgctgttcctcaggtgtaa

SEQ ID NO: 10265 - DNA, 662 bp, synthetic construct
  misc_feature 1..662: note = Synthetic polypeptide
  source 1..662: mol_type = other DNA
tgtaatgggttgaattgtgtcctgcgtctccaccaaaaaaaaaaaaaaaatggttgaagccctaacccccagtacctcagaatgtgaccttatttggaaatagggtcattgcagatgtaacgttaagatgaggtcatactcaatgagtatgagctctaatccaccctaagaaaagagacacacacatgaggagaaaatgtcacgtgaagatagaggcagggactgcagggctgcagctgcaaaccaagacacaccaggggcttccggcaaccacaggaagctgggaataggcaaggaaagattccccctacaggtttccggggaagcacagccacgctgacacattgatttggacttctagctatcagagcagtgggacaataaatttctgttgtttaaactactcgtttgtgtgggcctttggagtgacgctgtgggaactcatgactctgggccagactccctacgtggacattgaccccttcgagatggccgcatacctgaaagatggttaccgaatagcccagccaatcaactgtcctgatgaattatttgctgtgatggcctgttgctgggccttagatccagaggagaggcccaagtttcagcagctggtacagtgcctaacagagtttcatgcagccctgggggcctacgtctga

SEQ ID NO: 10266 - DNA, 2585 bp, synthetic construct
  misc_feature 1..2585: note = Synthetic polypeptide
  source 1..2585: mol_type = other DNA
aataataaggaacaaattgttgatacaggcaacaatttgggatgaatcccaaagacattatgctgaatgggagaaatcatttttgaaacggttgtatactgtatgattccatttattcgacgttctcaaaaagaaaacaatattcatggaaaacagttcattcggctcctaaagaagtagcagtgtccaaggaacaagaagagaaatctgatagcctagttaaatatttcagtgttgtttggtgtaagccttcaaagaaaaaacataaaaagtgggaaggtgatgctgttcttattgtaaaaggaaagtcatttatattaaagaatttggaaggcaaagacattggaagaggcattggttataaattcaaagagcttgaaaagattgaagagggccaaacactgatgatttgtggaaaagaaatagaagtcatgggtgtaatctctccagatgacttcagcagtggcaggtgttttcagcttggaggaggaagtactgctatctcgcattcttctcaggttgccaggaaatgtttctctaaccctttcaaaagtgtttgtaaaccaagttcaaaggaaaatagacagaatgatttccaaaattgcaaaccacgccatgacccatatacgccaaattccctcgttatgccacgaccagataagaatcaccagtgggtattcaataagaactgtttccctcttgtggatgtagtgattgatccttaccttgtatatcatcttcgaccacatcagaaagaaggaatcatattcctttatgaatgtgtaatgggaatgagaatgaatggcagatgtggagctattcttgctgatgaaatgggtttagggaagacattgcaatgtatttcgctcatctggaccctgcagtgtcagggaccctatggaggcaagccagtaataaagaagacactaattgtcacacctggaagcttggtgaataattggaagaaagaatttcaaaaatggctaggaagtgaaaggatcaagatatttactgttgatcaggaccacaaagttgaagaattcatcaagtctatattttattctgttcttattatcagttatgaaatgttacttcgttccctggatcaaattaagaatataaaatttgatcttctaatctgtgacgaggggcatcgtttgaagaacagtgccattaagacaactacagccctcattagcctttcttgtgagaaaagaataattctaactggtactccaattcagaatgatctgcaagaattttttgcattaattgattttgtaaatccaggaatattaggctctttgtcatcttataggaaaatatatgaagaacccatcattttatcgagagaaccttctgcttctgaggaagaaaaggagttaggagaaagaagagcagctgaacttacttgcctcactggactctttatccttagaagaacccaagaaattataaataaatatctcccacctaaaatagagaatgttgtcttttgccgaccaggagcactacagattgagctttatcgaaagctgttaaattctcaggttgtcaggttctgccttcaagggttgttggaaaatagtccccatctaatatgtataggagctcttaaaaaactgtgcaatcacccctgccttttgttcaactctataaaggaaaaggaatgtagctcaacttgtgataaaaatgaagaaaagagtctatacaaaggcttgctaagtgtgtttcctgctgactacaaccctctcctgtttactgaaaaggagtcaggaaaactacaggtgttgtccaagctcttagcggttatccacgaacttcgacctactgaaaaggtggtgttggtatccaactatacacaaaccttgaacattttacaagaagtatgtaagcgtcatggatatgcttatacaagacttgatggacaaacaccaatctctcaaaggcagcagattgttgatggctttaacagtcaacactcttctttttttatttttttgttaagttcaaaagctggtggtgtaggacttaacctcattggaggatctcacttaattctctatgacattgattggaatccagccactgacattcaggcaatgtctagagtatggagagatggtcagaaatatcctgtacatatttacagactcctaactacaggtacaatagaagaaaagatctatcaaaggcagatcagtaagcaaggtctttgtggggcagttgtcgacctcaccaagacatctgaacatattcagttttcagtagaagaacttaaaaatttgttcacattacatgaaagttcagattgtgttactcatgatctgcttgactgtgagtgtacaggagaagaagttcatacaggtgattcgttggaaaaattcattgtctctagagattgtcagcttggtccacatcaccagaaatctaactccctgaaacctctttctatgtcccagctgaagcaatggaaacatttttctggagatcatttaaatcttacagatccttttcttgaaagaataacagaaaatgtgtcattcatttttcagaatataaccactcaagctactggcacatag

SEQ ID NO: 10267 - DNA, 172 bp, synthetic construct
  misc_feature 1..172: note = Synthetic polypeptide
  source 1..172: mol_type = other DNA
aataataaggaacaaattgttgatacaggcaacaatttgggatgaatcccaaagacattatgctgaatgggagaaatcatttttgaaacggttgtatactgtatgattccatttattcgacgttctcaaaaagaaaacaatattcatggaaaacagttcattcggctcctaa

SEQ ID NO: 10268 - DNA, 180 bp, synthetic construct
  misc_feature 1..180: note = Synthetic polypeptide
  source 1..180: mol_type = other DNA
aataataaggaacaaattgttgatacaggcaacaatttgggatgaatcccaaagacattatgctgaatgggagaaatcatttttgaaacggttgtatactgtatgattccatttattcgacgttctcaaaaagaaaacaatattcatggaaaacagttcattcggctcctaaagaagtag

SEQ ID NO: 10269 - DNA, 229 bp, synthetic construct
  misc_feature 1..229: note = Synthetic polypeptide
  source 1..229: mol_type = other DNA
aataataaggaacaaattgttgatacaggcaacaatttgggatgaatcccaaagacattatgctgaatgggagaaatcatttttgaaacggttgtatactgtatgattccatttattcgacgttctcaaaaagaaaacaatattcatggaaaacagttcattcggctcctaaagaagtagcagtgtccaaggaacaagaagagaaatctgatagcctagttaaatattt

SEQ ID NO: 10270 - DNA, 14244 bp, synthetic construct
  misc_feature 1..14244: note = Synthetic polypeptide
  source 1..14244: mol_type = other DNA
gcttcccatctcatgaagagtcaaagtccaagtccttactatgatctacaagaccctaaccatttggccttcacatcacctccctgacctcatttccttctcctctccccatgcacagtgcaccaggcacagtgatatccttgttttccctgacatggtgagcacttttgggcctttgcacttgcccccctttttcctaaatgctcttgcctcagatggtgcatgacttacttcctttcctcctacaggtctttgctcataggtcaccctctcagtgtggccttctctgattctttcccgacctcttctttcctgatttactttctccattgcgcttaccaccatctgacataagaatgtgacagtgcgcattttcgctgtggaagtgggcattgcatccctgcagactggaggtgtgatgggaccaaagactgttcagatgacgcggatgaaattggctgcgctgttgtgacctgccagcagggctatttcaagtgccagagtgagggacaatgcatccccaactcctgggtgtgtgaccaagatcaagactgtgatgatggctcagatgaacgtcaagattgctcacaaagtacatgctcaagtcatcagataacatgctccaatggtcagtgtatcccaagtgaatacaggtgcgaccacgtcagagactgccccgatggagctgatgagaatgactgccagtacccaacatgtgagcagcttacttgtgacaatggggcctgctataacaccagtcagaagtgtgattggaaagttgattgcagggactcctcagatgaaatcaactgcactgagatatgcttgcacaatgagttttcatgtggcaatggagagtgtatccctcgtgcttatgtctgtgaccatgacaatgattgccaagacggcagtgacgaacatgcttgcaactatccgacctgcggtggttaccagttcacttgccccagtggccgatgcatttatcaaaactgggtttgtgatggagaagatgactgtaaagataatggagatgaagatggatgtgaaagcggtcctcatgatgttcataaatgttccccaagagaatggtcttgcccagagtcgggacgatgcatctccatttataaagtttgtgatgggattttagattgcccaggaagagaagatgaaaacaacactagtaccggaaaatactgtagtatgactctgtgctctgccttgaactgccagtaccagtgccatgagacgccgtatggaggagcgtgtttttgtcccccaggttatatcatcaaccacaatgacagccgtacctgtgttgagtttgatgattgccagatatggggaatttgtgaccagaagtgtgaaagccgacctggccgtcacctgtgccactgtgaagaagggtatatcttggagcgtggacagtattgcaaagctaatgattcctttggcgaggcctccattatcttctccaatggtcgggatttgttaattggtgatattcatggaaggagcttccggatcctagtggagtctcagaatcgtggagtggccgtgggtgtggctttccactatcacctgcaaagagttttttggacagacaccgtgcaaaataaggttttttcagttgacattaatggtttaaatatccaagaggttctcaatgtttctgttgaaaccccagagaacctggctgtggactgggttaataataaaatctatctagtggaaaccaaggtcaaccgcatagatatggtaaatttggatggaagctatcgggttacccttataactgaaaacttggggcatcctagaggaattgccgtggacccaactgttggttatttatttttctcagattgggagagcctttctggggaacctaagctggaaagggcattcatggatggcagcaaccgtaaagacttggtgaaaacaaagctgggatggcctgctggggtaactctggatatgatatcgaagcgtgtttactgggttgactctcggtttgattacattgaaactgtaacttatgatggaattcaaaggaagactgtagttcatggaggctccctcattcctcatccctttggagtaagcttatttgaaggtcaggtgttctttacagattggacaaagatggccgtgctgaaggcaaacaagttcacagagaccaacccacaagtgtactaccaggcttccctgaggccctatggagtgactgtttaccattccctcagacagccctatgctaccaatccgtgtaaagataacaatgggggctgtgagcaggtctgtgtcctcagccacagaacagataatgatggtttgggtttccgttgcaagtgcacattcggcttccaactggatacagatgagcgccactgcattgctgttcagaatttcctcattttttcatcccaagttgctattcgtgggatcccgttcaccttgtctacccaggaagatgtcatggttccagtttcggggaatccttctttctttgtcgggattgattttgacgcccaggacagcactatctttttttcagatatgtcaaaacacatgatttttaagcaaaagattgatggcacaggaagagaaattctcgcagctaacagggtggaaaatgttgaaagtttggcttttgattggatttcaaagaatctctattggacagactctcattacaagagtatcagtgtcatgaggctagctgataaaacgagacgcacagtagttcagtatttaaataacccacggtcggtggtagttcatccttttgccgggtatctattcttcactgattggttccgtcctgctaaaattatgagagcatggagtgacggatctcacctcttgcctgtaataaacactactcttggatggcccaatggcttggccatcgattgggctgcttcacgattgtactgggtagatgcctattttgataaaattgagcacagcacctttgatggtttagacagaagaagactgggccatatagagcagatgacacatccgtttggacttgccatctttggagagcatttattttttactgactggagactgggtgccattattcgagtcaggaaagcagatggtggagaaatgacagttatccgaagtggcattgcttacatactgcatttgaaatcgtatgatgtcaacatccagactggttctaacgcctgtaatcaacccacgcatcctaacggtgactgcagccacttctgcttcccggtgccaaatttccagcgagtgtgtgggtgcccttatggaatgaggctggcttccaatcacttgacatgcgagggggacccaaccaatgaaccacccacagagcagtgtggcttattttccttcccctgtaaaaatggcagatgtgtgcccaattactatctctgtgatggagtcgatgattgtcatgataacagtgatgagcaactatgtggcacacttaataatacctgttcatcttcggcgttcacctgtggccatggggagtgcattcctgcacactggcgctgtgacaaacgcaacgactgtgtggatggcagtgatgagcacaactgccccacccacgcacctgcttcctgccttgacacccaatacacctgtgataatcaccagtgtatctcaaagaactgggtctgtgacacagacaatgattgtggggatggatctgatgaaaagaactgcaattcgacagagacatgccaacctagtcagtttaattgccccaatcatcgatgtattgacctatcgtttgtctgtgatggtgacaaggattgtgttgatggatctgatgaggttggttgtgtattaaactgtactgcttctcaattcaagtgtgccagtggggataaatgtattggcgtcacaaatcgttgtgatggtgtttttgattgcagtgacaactcggatgaagcaggctgtccaaccaggcctcctggtatgtgccactcagatgaatttcagtgccaagaagatggtatctgcatcccgaacttctgggaatgtgatgggcatccagactgcctctatggatctgatgagcacaatgcctgtgtccccaagacttgcccttcatcatatttccactgtgacaacggaaactgcatccacagggcatggctctgtgatcgggacaatgactgcggggatatgagtgatgagaaggactgccctactcagccctttcgctgtcctagttggcaatggcagtgtcttggccataacatctgtgtgaatctgagtgtagtgtgtgatggcatctttgactgccccaatgggacagatgagtccccactttgcaatgggaacagctgctcagatttcaatggtggttgtactcacgagtgtgttcaagagccctttggggctaaatgcctatgtccattgggattcttacttgccaatgattctaagacctgtgaagacatagatgaatgtgatattctaggctcttgtagccagcactgttacaatatgagaggttctttccggtgctcgtgtgatacaggctacatgttagaaagtgatgggaggacttgcaaagttacagcatctgagagtctgctgttacttgtggcaagtcagaacaaaattattgccgacagtgtcacctcccaggtccacaatatctattcattggtcgagaatggttcttacattgtagctgttgattttgattcaattagtggtcgtatcttttggtctgatgcaactcagggtaaaacctggagtgcgtttcaaaatggaacggacagaagagtggtatttgacagtagcatcatcttgactgaaactattgcaatagattgggtaggtcgtaatctttactggacagactatgctctggaaacaattgaagtctccaaaattgatgggagccacaggactgtgctgattagtaaaaacctaacaaatccaagaggactagcattagatcccagaatgaatgagcatctactgttctggtctgactggggccaccaccctcgcatcgagcgagccagcatggacggcagcatgcgcactgtcattgtccaggacaagatcttctggccctgcggcttaactattgactaccccaacagactgctctacttcatggactcctatcttgattacatggacttttgtgattataatggacaccatcggagacaggtgatagccagtgatttgattatacggcacccctatgccctaactctctttgaagactctgtgtactggactgaccgtgctactcgtcgggttatgcgagccaacaagtggcatggagggaaccagtcagttgtaatgtataatattcaatggccccttgggattgttgcggttcatccttcgaaacaaccaaattccgtgaatccatgtgccttttcccgctgcagccatctctgcctgctttcctcacaggggcctcatttttactcctgtgtttgtccttcaggatggagtctgtctcctgatctcctgaattgcttgagagatgatcaacctttcttaataactgtaaggcaacatataatttttggaatctcccttaatcctgaggtgaagagcaatgatgctatggtccccatagcagggatacagaatggtttagatgttgaatttgatgatgctgagcaatacatctattgggttgaaaatccaggtgaaattcacagagtgaagacagatggcaccaacaggacagtatttgcttctatatctatggtggggccttctatgaacctggccttagattggatttcaagaaacctttattctaccaatcctagaactcagtcaatcgaggttttgacactccacggagatatcagatacagaaaaacattgattgccaatgatgggacagctcttggagttggctttccaattggcataactgttgatcctgctcgtgggaagctgtactggtcagaccaaggaactgacagtggggttcctgccaagatcgccagtgctaacatggatggcacatctgtgaaaactctctttactgggaacctcgaacacctggagtgtgtcactcttgacatcgaagagcagaaactctactgggcagtcactggaagaggagtgattgaaagaggaaacgtggatggaacagatcgaatgatcctggtacaccagctttcccacccctggggaattgcagtccatgattctttcctttattatactgatgaacagtatgaggtcattgaaagagttgataaggccactggggccaacaaaatagtcttgagagataatgttccaaatctgaggggtcttcaagtttatcacagacgcaatgccgccgaatcctcaaatggctgtagcaacaacatgaatgcctgtcagcagatttgcctgcctgtaccaggaggattgttttcctgcgcctgtgccactggatttaaactcaatcctgataatcggtcctgctctccatataactctttcattgttgtttcaatgctgtctgcaatcagaggctttagcttggaattgtcagatcattcagaaaccatggtgccggtggcaggccaaggacgaaacgcactgcatgtggatgtggatgtgtcctctggctttatttattggtgtgattttagcagctcagtggcatctgataatgcgatccgtagaattaaaccagatggatcttctctgatgaacattgtgacacatggaataggagaaaatggagtccggggtattgcagtggattgggtagcaggaaatctttatttcaccaatgcctttgtttctgaaacactgatagaagttctgcggatcaatactacttaccgccgtgttcttcttaaagtcacagtggacatgcctaggcatattgttgtagatcccaagaacagatacctcttctgggctgactatgggcagagaccaaagattgagcgttctttccttgactgtaccaatcgaacagtgcttgtgtcagagggcattgtcacaccacggggcttggcagtggaccgaagtgatggctacgtttattgggttgatgattctttagatataattgcaaggattcgtatcaatggagagaactctgaagtgattcgttatggcagtcgttacccaactccttatggcatcactgtttttgaaaattctatcatatgggtagataggaatttgaaaaagatcttccaagccagcaaggaaccagagaacacagagccacccacagtgataagagacaatatcaactggctaagagatgtgaccatctttgacaagcaagtccagccccggtcaccagcagaggtcaacaacaacccttgcttggaaaacaatggtgggtgctctcatctctgctttgctctgcctggattgcacaccccaaaatgtgactgtgcctttgggaccctgcaaagtgatggcaagaattgtgccatttcaacagaaaatttcctcatctttgccttgtctaattccttgagaagcttacacttggaccctgaaaaccatagcccacctttccaaacaataaatgtggaaagaactgtcatgtctctagactatgacagtgtaagtgatagaatctacttcacacaaaatttagcctctggagttggacagatttcctatgccaccctgtcttcagggatccatactccaactgtcattgcttcaggtatagggactgctgatggcattgcctttgactggattactagaagaatttattacagtgactacctcaaccagatgattaattccatggctgaagatgggtctaaccgcactgtgatagcccgcgttccaaaaccaagagcaattgtgttagatccctgccaagggtacctgtactgggctgactgggatacacatgccaaaatcgagagagccacattgggaggaaacttccgcgtacccattgtgaacagcagtctggtcatgcccagtgggctgactctggactatgaagaggaccttctctactgggtggatgctagtctgcagaggattgaacgcagcactctgacgggcgtggatcgtgaagtcattgtcaatgcagccgttcatgcttttggcttgactctctatggccagtatatttactggactgacttgtacacacaaagaatttaccgagctaacaaatatgacgggtcaggtcagattgcaatgaccacaaatttgctctcccagcccaggggaatcaacactgttgtgaagaaccagaaacaacagtgtaacaatccttgtgaacagtttaatgggggctgcagccatatctgtgcaccaggtccaaatggtgccgagtgccagtgtccacatgagggcaactggtatttggccaacaacaggaagcactgcattgtggacaatggtgaacgatgtggtgcatcttccttcacctgctccaatgggcgctgcatctcggaagagtggaagtgtgataatgacaacgactgtggggatggcagtgatgagatggaaagtgtctgtgcacttcacacctgctcaccgacagccttcacctgtgccaatgggcgatgtgtccaatactcttaccgctgtgattactacaatgactgtggtgatggcagtgatgaggcagggtgcctgttcagggactgcaatgccaccacggagtttatgtgcaataacagaaggtgcatacctcgtgagtttatctgcaatggtgtagacaactgccatgataataacacttcagatgagaaaaattgccctgatcgcacttgccagtctggatacacaaaatgtcataattcaaatatttgtattcctcgcgtttatttgtgtgacggagacaatgactgtggagataacagtgatgaaaaccctacttattgcaccactcacacgtgcagcagcagtgagttccaatgcgcatctgggcgctgtattcctcaacattggtattgtgatcaagaaacagattgttttgatgcctctgatgaacctgcctcttgtggtcactctgagcgaacatgcctagctgatgagttcaagtgtgatggtgggaggtgcatcccaagcgaatggatctgtgacggtgataatgactgtggggatatgagtgacgaggataaaaggcaccagtgtcagaatcaaaactgctcggattccgagtttctctgtgtaaatgacagacctccggacaggaggtgcattccccagtcttgggtctgtgatggcgatgtggattgtactgacggctacgatgagaatcagaattgcaccaggagaacttgctctgaaaatgaattcacctgtggttacggactgtgtatcccaaagatattcaggtgtgaccggcacaatgactgtggtgactatagcgacgagaggggctgcttataccagacttgccaacagaatcagtttacctgtcagaacgggcgctgcattagtaaaaccttcgtctgtgatgaggataatgactgtggagacggatctgatgagctgatgcacctgtgccacaccccagaacccacgtgtccacctcacgagttcaagtgtgacaatgggcgctgcatcgagatgatgaaactctgcaaccacctagatgactgtttggacaacagcgatgagaaaggctgtggcattaatgaatgccatgacccttcaatcagtggctgcgatcacaactgcacagacaccttaaccagtttctattgttcctgtcgtcctggttacaagctcatgtctgacaagcggacttgtgttgatattgatgaatgcacagagatgccttttgtctgtagccagaagtgtgagaatgtaataggctcctacatctgtaagtgtgccccaggctacctccgagaaccagatggaaagacctgccggcaaaacagtaacatcgaaccctatctcatttttagcaaccgttactatttgagaaatttaactatagatggctatttttactccctcatcttggaaggactggacaatgttgtggcattagattttgaccgagtagagaagagattgtattggattgatacacagaggcaagtcattgagagaatgtttctgaataagacaaacaaggagacaatcataaaccacagactaccagctgcagaaagtctggctgtagactgggtttccagaaagctctactggttggatgcccgcctggatggcctctttgtctctgacctcaatggtggacaccgccgcatgctggcccagcactgtgtggatgccaacaacaccttctgctttgataatcccagaggacttgcccttcaccctcaatatgggtacctctactgggcagactggggtcaccgcgcatacattgggagagtaggcatggatggaaccaacaagtctgtgataatctccaccaagttagagtggcctaatggcatcaccattgattacaccaatgatctactctactgggcagatgcccacctgggttacatagagtactctgatttggagggccaccatcgacacacggtgtatgatggggcactgcctcaccctttcgctattaccatttttgaagacactatttattggacagattggaatacaaggacagtggaaaagggaaacaaatatgatggatcaaatagacagacactggtgaacacaacacacagaccatttgacatccatgtgtaccatccatataggcagcccattgtgagcaatccctgtggtaccaacaatggtggctgttctcatctctgcctcatcaagccaggaggaaaagggttcacttgcgagtgtccagatgacttccgcacccttcagctgagtggcagcacctactgcatgcccatgtgctccagcacccagttcctgtgcgctaacaatgaaaagtgcattcctatctggtggaaatgtgatggacagaaagactgctcagatggctctgatgaactggccctttgcccgcagcgcttctgccgactgggacagttccagtgcagtgacggcaactgcaccagcccgcagactttatgcaatgctcaccaaaattgccctgatgggtctgatgaagaccgtcttctttgtgagaatcaccactgtgactccaatgaatggcagtgcgccaacaaacgttgcatcccagaatcctggcagtgtgacacatttaacgactgtgaggataactcagatgaagacagttcccactgtgccagcaggacctgccggccgggccagtttcggtgtgctaatggccgctgcatcccgcaggcctggaagtgtgatgtggataatgattgtggagaccactcggatgagcccattgaagaatgcatgagctctgcccatctctgtgacaacttcacagaattcagctgcaaaacaaattaccgctgcatcccaaagtgggccgtgtgcaatggtgtagatgactgcagggacaacagtgatgagcaaggctgtgaggagaggacatgccatcctgtgggggatttccgctgtaaaaatcaccactgcatccctcttcgttggcagtgtgatgggcaaaatgactgtggagataactcagatgaggaaaactgtgctccccgggagtgcacagagagcgagtttcgatgtgtcaatcagcagtgcattccctcgcgatggatctgtgaccattacaacgactgtggggacaactcagatgaacgggactgtgagatgaggacctgccatcctgaatattttcagtgtacaagtggacattgtgtacacagtgaactgaaatgcgatggatccgctgactgtttggatgcgtctgatgaagctgattgtcccacacgctttcctgatggtgcatactgccaggctactatgttcgaatgcaaaaaccatgtttgtatcccgccatattggaaatgtgatggcgatgatgactgtggcgatggttcagatgaagaacttcacctgtgcttggatgttccctgtaattcaccaaaccgtttccggtgtgacaacaatcgctgcatttatagtcatgaggtgtgcaatggtgtggatgactgtggagatggaactgatgagacagaggagcactgtagaaaaccgacccctaaaccttgtacagaatatgaatataagtgtggcaatgggcattgcattccacatgacaatgtgtgtgatgatgccgatgactgtggtgactggtccgatgaactgggttgcaataaaggaaaagaaagaacatgtgctgaaaatatatgcgagcaaaattgtacccaattaaatgaaggaggatttatctgctcctgtacagctgggttcgaaaccaatgtttttgacagaacctcctgtctagatatcaatgaatgtgaacaatttgggacttgtccccagcactgcagaaataccaaaggaagttatgagtgtgtctgtgctgatggcttcacgtctatgagtgaccgccctggaaaacgatgtgcagctgagggtagctctcctttgttgctactgcctgacaatgtccgaattcgaaaatataatctctcatctgagaggttctcagagtatcttcaagatgaggaatatatccaagctgttgattatgattgggatcccaaggacataggcctcagtgttgtgtattacactgtgcgaggggagggctctaggtttggtgctatcaaacgtgcctacatccccaactttgaatccggccgcaataatcttgtgcaggaagttgacctgaaactgaaatacgtaatgcagccagatggaatagcagtggactgggttggaaggcatatttactggtcagatgtcaagaataaacgcattgaggtggctaaacttgatggaaggtacagaaagtggctgatttccactgacctggaccaaccagctgctattgctgtgaatcccaaactagggcttatgttctggactgactggggaaaggaacctaaaatcgagtctgcctggatgaatggagaggaccgcaacatcctggttttcgaggaccttggttggccaactggcctttctatcgattatttgaacaatgaccgaatctactggagtgacttcaaggaggacgttattgaaaccataaaatatgatgggactgataggagagtcattgcaaaggaagcaatgaacccttacagcctggacatctttgaagaccagttatactggatatctaaggaaaagggagaagtatggaaacaaaataaatttgggcaaggaaagaaagagaaaacgctggtagtgaacccttggctcactcaagttcgaatctttcatcaactcagatacaataagtcagtgcccaacctttgcaaacagatctgcagccacctctgccttctgagacctggaggatacagctgtgcctgtccccaaggctccagctttatagaggggagcaccactgagtgtgatgcagccatcgaactgcctatcaacctgccccccccatgcaggtgcatgcacggaggaaattgctattttgatgagactgacctccccaaatgcaagtgtcctagcggctacaccggaaaatattgtgaaatggcgttttcaaaaggcatctctccaggaacaaccgcagtagctgtgctgttgacaatcctcttgatcgtcgtaattggagctctggcaattgcaggattcttccactatagaaggaccggctcccttttgcctgctctgcccaagctgccaagcttaagcagtctcgtcaagccctctgaaaatgggaatggggtgaccttcagatcaggggcagatcttaacatggatattggagtgtctggttttggacctgagactgctattgacaggtcaatggcaatgagtgaagactttgtcatggaaatggggaagcagcccataatatttgaaaacccaatgtactcagccagagacagtgctgtcaaagtggttcagccaatccaggtgactgtatctgaaaatgtggataataagaattatggaagtcccataaacccttctgagatagttccagagacaaacccaacttcaccagctgctgatggaactcaggtgacaaaatggaatctcttcaaacgaaaatctaaacaaactaccaactttgaaaatccaatctatgcacagatggagaacgagcaaaaggaaagtgttgctgcgacaccacctccatcaccttcgctccctgctaagcctaagcctccttcgagaagagacccaactccaacctattctgcaacagaagacacttttaaagacaccgcaaatcttgttaaagaagactctgaagtatag

SEQ ID NO: 10271 - DNA, 3954 bp, synthetic construct
  misc_feature 1..3954: note = Synthetic polypeptide
  source 1..3954: mol_type = other DNA
gcttcccatctcatgaagagtcaaagtccaagtccttactatgatctacaagaccctaaccatttggccttcacatcacctccctgacctcatttccttctcctctccccatgcacagtgcaccaggcacagtgatatccttgttttccctgacatggtgagcacttttgggcctttgcacttgcccccctttttcctaaatgctcttgcctcagatggtgcatgacttacttcctttcctcctacaggtctttgctcataggtcaccctctcagtgtggccttctctgattctttcccgacctcttctttcctgatttactttctccattgcgcttaccaccatctgacataagaatgtgacagtgcgcattttcgctgtggaagtgggcattgcatccctgcagactggaggtgtgatgggaccaaagactgttcagatgacgcggatgaaattggctgcgctgttgtgacctgccagcagggctatttcaagtgccagagtgagggacaatgcatccccaactcctgggtgtgtgaccaagatcaagactgtgatgatggctcagatgaacgtcaagattgctcacaaagtacatgctcaagtcatcagataacatgctccaatggtcagtgtatcccaagtgaatacaggtgcgaccacgtcagagactgccccgatggagctgatgagaatgactgccagtacccaacatgtgagcagcttacttgtgacaatggggcctgctataacaccagtcagaagtgtgattggaaagttgattgcagggactcctcagatgaaatcaactgcactgagatatgcttgcacaatgagttttcatgtggcaatggagagtgtatccctcgtgcttatgtctgtgaccatgacaatgattgccaagacggcagtgacgaacatgcttgcaactatccgacctgcggtggttaccagttcacttgccccagtggccgatgcatttatcaaaactgggtttgtgatggagaagatgactgtaaagataatggagatgaagatggatgtgaaagcggtcctcatgatgttcataaatgttccccaagagaatggtcttgcccagagtcgggacgatgcatctccatttataaagtttgtgatgggattttagattgcccaggaagagaagatgaaaacaacactagtaccggaaaatactgtagtatgactctgtgctctgccttgaactgccagtaccagtgccatgagacgccgtatggaggagcgtgtttttgtcccccaggttatatcatcaaccacaatgacagccgtacctgtgttgagtttgatgattgccagatatggggaatttgtgaccagaagtgtgaaagccgacctggccgtcacctgtgccactgtgaagaagggtatatcttggagcgtggacagtattgcaaagctaatgattcctttggcgaggcctccattatcttctccaatggtcgggatttgttaattggtgatattcatggaaggagcttccggatcctagtggagtctcagaatcgtggagtggccgtgggtgtggctttccactatcacctgcaaagagttttttggacagacaccgtgcaaaataaggttttttcagttgacattaatggtttaaatatccaagaggttctcaatgtttctgttgaaaccccagagaacctggctgtggactgggttaataataaaatctatctagtggaaaccaaggtcaaccgcatagatatggtaaatttggatggaagctatcgggttacccttataactgaaaacttggggcatcctagaggaattgccgtggacccaactgttgggaagactgtagttcatggaggctccctcattcctcatccctttggagtaagcttatttgaaggtcaggtgttctttacagattggacaaagatggccgtgctgaaggcaaacaagttcacagagaccaacccacaagtgtactaccaggcttccctgaggccctatggagtgactgtttaccattccctcagacagccctatgctaccaatccgtgtaaagataacaatgggggctgtgagcaggtctgtgtcctcagccacagaacagataatgatggtttgggtttccgttgcaagtgcacattcggcttccaactggatacagatgagcgccactgcattggaagagaaattctcgcagctaacagggtggaaaatgttgaaagtttggcttttgattggatttcaaagaatctctattggacagactctcattacaagagtatcagtgtcatgaggctagctgataaaacgagacgcacagtagttcagtatttaaataacccacggtcggtggtagttcatccttttgccgggtatctattcttcactgattggttccgtcctgctaaaattatgagagcatggagtgacggatctcacctcttgcctgtaataaacactactcttggatggcccaatggcttggccatcgattgggctgcttcacgattgtactgggtagatgcctattttgataaaattgagcacagcacctttgatggtttagacagaagaagactgggccatatagagcagatgacacatccgtttggacttgccatctttggagagcatttattttttactgactggagactgggtgccattattcgagtcaggaaagcagatggtggagaaatgacagttatccgaagtggcattgcttacatactgcatttgaaatcgtatgatgtcaacatccagactggttctaacgcctgtaatcaacccacgcatcctaacggtgactgcagccacttctgcttcccggtgccaaatttccagcgagtgtgtgggtgcccttatggaatgaggctggcttccaatcacttgacatgcgagggggacccaaccaatgaaccacccacagagcagtgtggcttattttccttcccctgtaaaaatggcagatgtgtgcccaattactatctctgtgatggagtcgatgattgtcatgataacagtgatgagcaactatgtggcacacttaataatacctgttcatcttcggcgttcacctgtggccatggggagtgcattcctgcacactggcgctgtgacaaacgcaacgactgtgtggatggcagtgatgagcacaactgccccacccacgcacctgcttcctgccttgacacccaatacacctgtgataatcaccagtgtatctcaaagaactgggtctgtgacacagacaatgattgtggggatggatctgatgaaaagaactgcaattcgacagagacatgccaacctagtcagtttaattgccccaatcatcgatgtattgacctatcgtttgtctgtgatggtgacaaggattgtgttgatggatctgatgaggttggttgtgtattaaactgtactgcttctcaattcaagtgtgccagtggggataaatgtattggcgtcacaaatcgttgtgatggtgtttttgattgcagtgacaactcggatgaagcaggctgtccaaccaggcctcctggtatgtgccactcagatgaatttcagtgccaagaagatggtatctgcatcccgaacttctgggaatgtgatgggcatccagactgcctctatggatctgatgagcacaatgcctgtgtccccaagacttgcccttcatcatatttccactgtgacaacggaaactgcatccacagggcatggctctgtgatcgggacaatgactgcggggatatgagtgatgagaaggactgccctactcagccctttcgctgtcctagttggcaatggcagtgtcttggccataacatctgtgtgaatctgagtgtagtgtgtgatggcatctttgactgccccaatgggacagatgagtccccactttgcagtaagtttcctgaccacagtttactggccataaactcattctga

SEQ ID NO: 10272 - DNA, 296 bp, synthetic construct
  misc_feature 1..296: note = Synthetic polypeptide
  source 1..296: mol_type = other DNA
gctgggtgtgatggttcatgcctatagtcacagcactttaggaagcggtggcgggcggatcacttgagctcaggagtttaagtccagcctggccaacatggagaaaccctgtctctactaaaaatacaaaaattaacccgaccatagtaacctgggaggaggagcacctggtgtgtgtgcagaaaggggaggtccccaaccggggctggagacactggctggagggagagatgctgtatctggaactgactgcaagggatgcagtgtgcgagcaggtcttcaggaaggtcagatag

SEQ ID NO: 10273 - DNA, 1951 bp, synthetic construct
  misc_feature 1..1951: note = Synthetic polypeptide
  source 1..1951: mol_type = other DNA
ggccaggtgcagtgactcacacttgtaatcccagcactttgggaggccgaggcacgtggatcacttgagagcaggaaagtccaatccaaccttttatctccagaagggctttcaaacatatgtgctcaggaaaaaaccaccaggttcacttcttcctaaagcacatcagattgatagagaatttaaagtccagaaagccttgttttcaattggattccccgttcccaagcctatactgtactgcagtgatacttctgtcattggaacagaattttacgtaatggaacatgtgcagggtcgaatcttccgtgatttaacaattcctggacttagcccagcagaacgttcagccatatatgtggccacggtagaaacattggctcagttacgttccttgaatatacagtcactgcagctggaaggatatggtataggtgctgggtactgcaaaagacaggtatcaacctggacaaagcaatatcaagctgcagctcatcaggacatccctgccatgcaacagctatcggagtggctaatgaagaacttgcccgataatgacaatgaagagaatttgattcatggagatttcagactagataacatagttttccaccctaaagagtgtcgagttatagcagtgctggattgggagctgtcaaccattggtcatcctttgtcagacttagctcatttttccctgttctacttttggccaaggacagttccaatgataaatcaaggttcttatagtgaaaactcagggataccatcaatggaagaactgatttcaatatattgccgctgcaggggaattaattctattcttcctaactggaatttctttcttgccctttcatattttaagatggctggaatagcacagggagtatatagcagatatcttctgggaaataattcatctgaggatagctttttatttgccaatattgtgcaacctctggcagaaactggactacaactctccaaacgaactttcagtactgtactaccacagattgatactactggacagttgtttgtacagactcggaaaggtcaggaagttcttattaaggtgaagcatttcatgaaacaacacattcttccagctgaaaaggaggtaactgagttctatgttcaaaatgaaaattcagtggacaagtggggaaaacctttagtgattgataaactcaaggaaatggccaaagtcgagggtctctggaacttgtttttgccagctgtcagcggactcagccacgtggactatgccttgattgctgaagaaacaggaaaatgcttttttgctccagatgtctttaactgccaagcaccagacacagggaatatggaggttctgcacctgtatggaagtgaggaacagaagaaacagtggcttgagcctcttcttcaagggaacattacctcttgcttctgtatgacagaacctgatgtagcttcaagtgatgccacgaatattgaatgcagcatccaacgagatgaagatagctatgtaattaacggcaaaaaatggtggagcagtggagctgggaatcccaagtgcaaaattgcaattgttttgggaagaactcaaaatacttctctctccagagaggttgtggctcactggattgctgaaagccgcattgccattgagaagatccgcttgttgactctgaaagctgctcacagcatggacactctgggcagtgctggcgctaagaaagagattgcaatgatcaaagtggctgccccacgggctgtcagcaaaatcgttgactgggccatccaggtgtgcggaggtgctggtgtttcccaggattaccctctggctaacatgtatgctataacccgagttttgcgtttagcagatggacctgacgaagttcatctttcagcaatcgcaacaatggagctgcgggaccaagccaaaagactgacagccaagatataa

SEQ ID NO: 10274 - DNA, 2263 bp, synthetic construct
  misc_feature 1..2263: note = Synthetic polypeptide
  source 1..2263: mol_type = other DNA
ggccaggtgcagtgactcacacttgtaatcccagcactttgggaggccgaggcacgtggatcacttgagagcaggaaagtccaatccaaccttttatctccagaagggctttcaaacatatgtgctcaggaaaaaaccaccaggttcacttcttcctaaagcacatcagattgatagagaatttaaagtccagaaagccttgttttcaattggattccccgttcccaagcctatactgtactgcagtgatacttctgtcattggaacagaattttacgtaatggaacatgtgcagggtcgaatcttccgtgatttaacaattcctggacttagcccagcagaacgttcagccatatatgtggccacggtagaaacattggctcagttacgttccttgaatatacagtcactgcagctggaaggatatggtataggtgctgggtactgcaaaagacaggtatcaacctggacaaagcaatatcaagctgcagctcatcaggacatccctgccatgcaacagctatcggagtggctaatgaagaacttgcccgataatgacaatgaagagaatttgattcatggagatttcagactagataacatagttttccaccctaaagagtgtcgagttatagcagtgctggattgggagctgtcaaccattggtcatcctttgtcagacttagctcatttttccctgttctacttttggccaaggacagttccaatgataaatcaaggttcttatagtgaaaactcagggataccatcaatggaagaactgatttcaatatattgccgctgcaggggaattaattctattcttcctaactggaatttctttcttgccctttcatattttaagatggctggaatagcacagggagtatatagcagatatcttctgggaaataattcatctgaggatagctttttatttgccaatattgtgcaacctctggcagaaactggactacaactctccaaacgaactttcagtactgtactaccacagattgatactactggacagttgtttgtacagactcggaaaggtcaggaagttcttattaaggtgaagcatttcatgaaacaacacattcttccagctgaaaaggaggtaactgagttctatgttcaaaatgaaaattcagtggacaagtggggaaaacctttagtgattgataaactcaaggaaatggccaaagtcgagggtctctggaacttgtttttgccagctgtcagcggactcagccacgtggactatgccttgattgctgaagaaacaggaaaatgcttttttgctccagatgtctttaactgccaagcaccagacacagggaatatggaggttctgcacctgtatggaagtgaggaacagaagaaacagtggcttgagcctcttcttcaagggaacattacctcttgcttctgtatgacagaacctgatgtagcttcaagtgatgccacgaatattgaatgcagcatccaacgagatgaagatagctatgtaattaacggcaaaaaatggtggagcagtggagctgggaatcccaagtgcaaaattgcaattgttttgggaagaactcaaaatacttctctctccagacacaaacagcacagcatgattcttgttcccatgaacacacctggagtaaaaataataaggcctttgtcagtttttggctacacagataattttcatggaggacattttgagatccattttaatcaagtgcgagttcctgccacaaatctaatactaggtgaaggtaggggatttgaaatttcccaaggccgccttggacctggcagaatccaccactgtatgagaacagtaggtttggcggaacgcgctttgcagatcatgtgtgagcgggcaacacaaaggatagctttcaagaagaagttgtatgcacatgaggttgtggctcactggattgctgaaagccgcattgccattgagaagatccgcttgttgactctgaaagctgctcacagcatggacactctgggcagtgctggcgctaagaaagagattgcaatgatcaaagtggctgccccacgggctgtcagcaaaatcgttgactgggccatccaggtgtgcggaggtgctggtgtttcccaggattaccctctggctaacatgtatgctataacccgagttttgcgtttagcagatggacctgacgaagttcatctttcagcaatcgcaacaatggagctgcgggaccaagccaaaagactgacagccaagatataa

SEQ ID NO: 10275 - DNA, 1222 bp, synthetic construct
  misc_feature 1..1222: note = Synthetic polypeptide
  source 1..1222: mol_type = other DNA
ggccaggtgcagtgactcacacttgtaatcccagcactttgggaggccgaggcacgtggatcacttgagagcaggaaagtccaatccaaccttttatctccagaagggctttcaaacatatgtgctcaggaaaaaaccaccaggttcacttcttcctaaagcacatcagattgatagagaatttaaagtccagaaagccttgttttcaattggattccccgttcccaagcctatactgtactgcagtgatacttctgtcattggaacagaattttacgtaatggaacatgtgcagggtcgaatcttccgtgatttaacaattcctggacttagcccagcagaacgttcagccatatatgtggccacggtagaaacattggctcagttacgttccttgaatatacagtcactgcagctggaaggatatggtataggtgctgggtactgcaaaagacaggtatcaacctggacaaagcaatatcaagctgcagctcatcaggacatccctgccatgcaacagctatcggagtggctaatgaagaacttgcccgataatgacaatgaagagaatttgattcatggagatttcagactagataacatagttttccaccctaaagagtgtcgagttatagcagtgctggattgggagctgtcaaccattggtcatcctttgtcagacttagctcatttttccctgttctacttttggccaaggacagttccaatgataaatcaaggttcttatagtgaaaactcagggataccatcaatggaagaactgatttcaatatattgccgctgcaggggaattaattctattcttcctaactggaatttctttcttgccctttcatattttaagatggctggaatagcacagggagtatatagcagatatcttctgggaaataattcatctgaggatagctttttatttgccaatattgtgcaacctctggcagaaactggactacaactctccaaacgaactttcagtactgtactaccacagattgatactactggacagttgtttgtacagactcggaaaggtcaggaagttcttattaaggtgaagcatttcatgaaacaacacattcttccagctgaaaagacacagggaatatggaggttctgcacctgtatggaagtgaggaacagaagaaacagtggcttgagcctcttcttcaagggaacattacctcttgcttctgtatga

SEQ ID NO: 10276 - DNA, 1351 bp, synthetic construct
  misc_feature 1..1351: note = Synthetic polypeptide
  source 1..1351: mol_type = other DNA
ggccaggtgcagtgactcacacttgtaatcccagcactttgggaggccgaggcacgtggatcacttgagagcaggaaagtccaatccaaccttttatctccagaagggctttcaaacatatgtgctcaggaaaaaaccaccaggttcacttcttcctaaagcacatcagattgatagagaatttaaagtccagaaagccttgttttcaattggattccccgttcccaagcctatactgtactgcagtgatacttctgtcattggaacagaattttacgtaatggaacatgtgcagggtcgaatcttccgtgatttaacaattcctggacttagcccagcagaacgttcagccatatatgtggccacggtagaaacattggctcagttacgttccttgaatatacagtcactgcagctggaaggatatggtataggtgctgggtactgcaaaagacaggtatcaacctggacaaagcaatatcaagctgcagctcatcaggacatccctgccatgcaacagctatcggagtggctaatgaagaacttgcccgataatgacaatgaagagaatttgattcatggagatttcagactagataacatagttttccaccctaaagagtgtcgagttatagcagtgctggattgggagctgtcaaccattggtcatcctttgtcagacttagctcatttttccctgttctacttttggccaaggacagttccaatgataaatcaaggttcttatagtgaaaactcagggataccatcaatggaagaactgatttcaatatattgccgctgcaggggaattaattctattcttcctaactggaatttctttcttgccctttcatattttaagatggctggaatagcacagggagtatatagcagatatcttctgggaaataattcatctgaggatagctttttatttgccaatattgtgcaacctctggcagaaactggactacaactctccaaacgaactttcagtactgtactaccacagattgatactactggacagttgtttgtacagactcggaaaggtcaggaagttcttattaaggtgaagcatttcatgaaacaacacattcttccagctgaaaaggaggtaactgagttctatgttcaaaatgaaaattcagtggacaagtggggaaaacctttagtgattgataaactcaaggaaatggccaaagtcgagggtctctggaacttgtttttgccagctgtcagcggactcagccacgtggactatgccttgattgctgaagaaacaggaaaatgcttttttgctccagatgtctttaactgccaagcaccaggttactacattaattga

SEQ ID NO: 10277 - DNA, 541 bp, synthetic construct
  misc_feature 1..541: note = Synthetic polypeptide
  source 1..541: mol_type = other DNA
tgatgtggtttggctgtgtccacacccaaatctcatcttgaattcccacatgttgtgggagggacccagttggaggtaattgaatcatgggggtaggtctttcctgtgctgttcttgtgatagtgaataagtctcacaagatctgatggtggtataagaaggagtttccctgcacaagctctctttttgcctgctgccatccatctaagatgtgacttgctcctccttgccttctgccatgattgtgaggcctccccagccatgtggaactacagtgaccaacaccttcaggacgaacaatatccagatccagagccgggaccagaggctgctgacactgtcgctggacaaggacgatcaacgcactttcagggatgtggtcagattcgaggttgctccctgcccagaaccatgttctggggcccagaagtccaaggcaccgtggctcaatttgcatgggcaacaggaggtggaagcaatcaaagccaagcccaagccccttctgatgcccatcaacacattctctggtattgtccagtga

SEQ ID NO: 10278 - DNA, 1133 bp, synthetic construct; identical to SEQ ID NO: 7332
  misc_feature 1..1133: note = Synthetic polypeptide
  source 1..1133: mol_type = other DNA

SEQ ID NO: 10279 - DNA, 1172 bp, synthetic construct; identical to SEQ ID NO: 7333
  misc_feature 1..1172: note = Synthetic polypeptide
  source 1..1172: mol_type = other DNA

SEQ ID NO: 10280 - DNA, 1295 bp, synthetic construct; identical to SEQ ID NO: 9886
  misc_feature 1..1295: note = Synthetic polypeptide
  source 1..1295: mol_type = other DNA

SEQ ID NO: 10281 - DNA, 632 bp, synthetic construct; identical to SEQ ID NO: 9887
  misc_feature 1..632: note = Synthetic polypeptide
  source 1..632: mol_type = other DNA

SEQ ID NO: 10282 - DNA, 935 bp, synthetic construct
  misc_feature 1..935: note = Synthetic polypeptide
  source 1..935: mol_type = other DNA
ccaaagcattgcctggtctatagtgggaaatcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaa

SEQ ID NO: 10283 - DNA, 383 bp, synthetic construct
  misc_feature 1..383: note = Synthetic polypeptide
  source 1..383: mol_type = other DNA
ccaaagcattgcctggtctatagtgggaaatcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctga

SEQ ID NO: 10284 - DNA, 199 bp, synthetic construct
  misc_feature 1..199: note = Synthetic polypeptide
  source 1..199: mol_type = other DNA
ccaaagcattgcctggtctatagtgggaaatcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaa

SEQ ID NO: 10285 - DNA, 476 bp, synthetic construct
  misc_feature 1..476: note = Synthetic polypeptide
  source 1..476: mol_type = other DNA
ccaaagcattgcctggtctatagtgggaaatcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaagatctttgataccatactttaatctgtatcttcagtttctgaacataagtatgcaaaatctttttaaggtgcatactctgctgcgtccctgctattttctaggacaaaaataa

SEQ ID NO: 10286 - DNA, 971 bp, synthetic construct
  misc_feature 1..971: note = Synthetic polypeptide
  source 1..971: mol_type = other DNA
ccaaagcattgcctggtctatagtgggaaatcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggctggtagcaagttctggatcttatacccaacacacagcaacatccagaaataa

SEQ ID NO: 10287 - DNA, 890 bp, synthetic construct
  misc_feature 1..890: note = Synthetic polypeptide
  source 1..890: mol_type = other DNA
ccaaagcattgcctggtctatagtgggaaatcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatgaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaa

SEQ ID NO: 10288 - DNA, 653 bp, synthetic construct
  misc_feature 1..653: note = Synthetic polypeptide
  source 1..653: mol_type = other DNA
ccaaagcattgcctggtctatagtgggaaatcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggtctgggagaactgatcttgctgaaaatacaacaggaagcagtatcgtgccaggcaaggcaaaccctcgtcagtgtgaagcaatggccatcgttgcagcccaagtcatggggttttgtgtggcagtaa

SEQ ID NO: 10289 - DNA, 569 bp, synthetic construct
  misc_feature 1..569: note = Synthetic polypeptide
  source 1..569: mol_type = other DNA
ccaaagcattgcctggtctatagtgggaaatcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggctgctgggggatgcttcagtttccttcacagaaaactaaatag

SEQ ID NO: 10290 - DNA, 632 bp, synthetic construct
  misc_feature 1..632: note = Synthetic polypeptide
  source 1..632: mol_type = other DNA
ccaaagcattgcctggtctatagtgggaaatcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggtctgggagaactgatcttgctgaaaatacaacaggaagcagtatcgtgccaggcaaggcaaaccctcgtcagtgtgaagcaatggccatcgttgcagcccaagtcatggggttttgtgtggcagtaaccgttggaggcggcaatggccattttgagttggatgttttcaagccaatgatgattaaaaatttatgttacactcaggctgctgggggatgcttcagtttccttcacagaaaactaaatagtgggaatccggaccaataa

SEQ ID NO: 10291 - DNA, 943 bp, synthetic construct; identical to SEQ ID NO: 9889
  misc_feature 1..943: note = Synthetic polypeptide
  source 1..943: mol_type = other DNA

SEQ ID NO: 10292 - DNA, 80 bp, synthetic construct; identical to SEQ ID NO: 6364
  misc_feature 1..80: note = Synthetic polypeptide
  source 1..80: mol_type = other DNA

SEQ ID NO: 10293 - DNA, 217 bp, synthetic construct; identical to SEQ ID NO: 6365
  misc_feature 1..217: note = Synthetic polypeptide
  source 1..217: mol_type = other DNA

SEQ ID NO: 10294 - DNA, 2484 bp, synthetic construct; identical to SEQ ID NO: 9884
  misc_feature 1..2484: note = Synthetic polypeptide
  source 1..2484: mol_type = other DNA

SEQ ID NO: 10295 - DNA, 560 bp, synthetic construct; identical to SEQ ID NO: 6322
  misc_feature 1..560: note = Synthetic polypeptide
  source 1..560: mol_type = other DNA

SEQ ID NO: 10296 - DNA, 180 bp, synthetic construct
  misc_feature 1..180: note = Synthetic polypeptide
  source 1..180: mol_type = other DNA
cagtgaagtgcagaagtgaagggtctggactcatgatcttgattgattcacatcctggctctgtgagagtcgttgggctggatatttaacctcgctgtgtctcagctttctcataagatgagctcacagtgcctgcactttaccccagtagccctgaagtgtgggccccgtaccctctgt

SEQ ID NO: 10297 - DNA, 311 bp, synthetic construct
  misc_feature 1..311: note = Synthetic polypeptide
  source 1..311: mol_type = other DNA
cagtgaagtgcagaagtgaagggtctggactcatgatcttgattgattcacatcctggctctgtgagagtcgttgggctggatatttaacctcgctgtgtctcagctttctcataagatgagctcacagtgcctgcactttaccccagtagccctgaagtgtgggccccgtaccctctgtacccagcggagttagcgcctgctctacctcctcctgctttcacctatcccgcttcactgcatgcccagatgcgctggctccctccctccgaggctacttctcagggctggaagtcccgtcagttctgctga

SEQ ID NO: 10298 - DNA, 380 bp, synthetic construct
  misc_feature 1..380: note = Synthetic polypeptide
  source 1..380: mol_type = other DNA
cagtgaagtgcagaagtgaagggtctggactcatgatcttgattgattcacatcctggctctgtgagagtcgttgggctggatatttaacctcgctgtgtctcagctttctcataagatgagctcacagtgcctgcactttaccccagtagccctgaagtgtgggccccgtaccctctgtacccagcggagttagcgcctgctctacctcctcctgctttcacctatcccgcttcactgcatgcccagtgtttctctcctgaggcaaagcccaacacacctgtcttttgtccacttctccagcaaattagatttgtctctgggaatgtgtttgtaacataccaacctactgcagaccagcagagggagctcccatgttga

SEQ ID NO: 10299 - DNA, 335 bp, synthetic construct
  misc_feature 1..335: note = Synthetic polypeptide
  source 1..335: mol_type = other DNA
cagtgaagtgcagaagtgaagggtctggactcatgatcttgattgattcacatcctggctctgtgagagtcgttgggctggatatttaacctcgctgtgtctcagctttctcataagatgagctcacagtgcctgcactttaccccagtagccctgaagtgtgggccccgtaccctctgtacccagcggagttagcgcctgctctacctcctcctgctttcacctatcccgcttcactgcatgcccagctctgtgaaggtcagactgtgaggagaagccaccccttgagcgctccgtctcctgatagtgccagcctggcctggtttcctgtttga

SEQ ID NO: 10300 - DNA, 260 bp, synthetic construct
  misc_feature 1..260: note = Synthetic polypeptide
  source 1..260: mol_type = other DNA
cagtgaagtgcagaagtgaagggtctggactcatgatcttgattgattcacatcctggctctgtgagagtcgttgggctggatatttaacctcgctgtgtctcagctttctcataagatgagctcacagtgcctgcactttaccccagtagccctgaagtgtgggccccgtaccctctgtacccagcggagttagcgcctgctctacctcctcctgctttcacctatcccgcttcactgcatgcccaggaaaccctgtag

SEQ ID NO: 10301 - DNA, 395 bp, synthetic construct
  misc_feature 1..395: note = Synthetic polypeptide
  source 1..395: mol_type = other DNA
cagtgaagtgcagaagtgaagggtctggactcatgatcttgattgattcacatcctggctctgtgagagtcgttgggctggatatttaacctcgctgtgtctcagctttctcataagatgagctcacagtgcctgcactttaccccagtagccctgaagtgtgggccccgtaccctctgtacccagcggagttagcgcctgctctacctcctcctgctttcacctatcccgcttcactgcatgcccaggtaattgatacccatcggccaggacttcactcacttcaccaccagtcctttcaaacttggttcccgagagcacaccatacaactaacacctatccagctaacagatccaccctcaagagattaatgatcccctctaaatcaagctga

SEQ ID NO: 10302 - DNA, 2781 bp, synthetic construct; identical to SEQ ID NO: 7524
  misc_feature 1..2781: note = Synthetic polypeptide
  source 1..2781: mol_type = other DNA

SEQ ID NO: 10303 - DNA, 459 bp, synthetic construct; identical to SEQ ID NO: 6510
  misc_feature 1..459: note = Synthetic polypeptide
  source 1..459: mol_type = other DNA

SEQ ID NO: 10304 - DNA, 504 bp, synthetic construct; identical to SEQ ID NO: 6511
  misc_feature 1..504: note = Synthetic polypeptide
  source 1..504: mol_type = other DNA

SEQ ID NO: 10305 - DNA, 336 bp, synthetic construct; identical to SEQ ID NO: 7520
  misc_feature 1..336: note = Synthetic polypeptide
  source 1..336: mol_type = other DNA

SEQ ID NO: 10306 - DNA, 346 bp, synthetic construct; identical to SEQ ID NO: 7521
  misc_feature 1..346: note = Synthetic polypeptide
  source 1..346: mol_type = other DNA

SEQ ID NO: 10307 - DNA, 282 bp, synthetic construct; identical to SEQ ID NO: 7621
  misc_feature 1..282: note = Synthetic polypeptide
  source 1..282: mol_type = other DNA

SEQ ID NO: 10308 - DNA, 285 bp, synthetic construct; identical to SEQ ID NO: 6477
  misc_feature 1..285: note = Synthetic polypeptide
  source 1..285: mol_type = other DNA

SEQ ID NO: 10309 - DNA, 238 bp, synthetic construct; identical to SEQ ID NO: 6378
  misc_feature 1..238: note = Synthetic polypeptide
  source 1..238: mol_type = other DNA

SEQ ID NO: 10310 - DNA, 1965 bp, synthetic construct; identical to SEQ ID NO: 8289
  misc_feature 1..1965: note = Synthetic polypeptide
  source 1..1965: mol_type = other DNA

SEQ ID NO: 10311 - DNA, 1207 bp, synthetic construct
  misc_feature 1..1207: note = Synthetic polypeptide
  source 1..1207: mol_type = other DNA
tgatatggtttgaatgtgtgttccctccgatatctcatgtagaattgtaatttccagtttggagaaaaggcctggtgggaggtgaattggtcacgggggcagatttccccttgctgttctcaggatagtgagtgcgttctcgcgagatctgtttgtttaaaagtgtgtagcacctccctcttcactatcttcctcctgctctggctgtgtgaagatctgcctccttcctcttcggcttcatgcatgatcgtaagtttcctgaggcctcctcagccatgcttcctgcatagcctgcagaaataatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcaacttcgaaaggcgatgttggaaaaagacggataatttgcctagtgggattgggcctggtggtcttcttcttcagttttctactttcaatatttcgttccaagtaccacggctatccttatagctttttaattaaatga

SEQ ID NO: 10312 - DNA, 994 bp, synthetic construct
  misc_feature 1..994: note = Synthetic polypeptide
  source 1..994: mol_type = other DNA
tgatatggtttgaatgtgtgttccctccgatatctcatgtagaattgtaatttccagtttggagaaaaggcctggtgggaggtgaattggtcacgggggcagatttccccttgctgttctcaggatagtgagtgcgttctcgcgagatctgtttgtttaaaagtgtgtagcacctccctcttcactatcttcctcctgctctggctgtgtgaagatctgcctccttcctcttcggcttcatgcatgatcgtaagtttcctgaggcctcctcagccatgcttcctgcatagcctgcagaaataatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgatgccgctatcaccatggggatggttcttctaa

SEQ ID NO: 10313 - DNA, 1108 bp, synthetic construct
  misc_feature 1..1108: note = Synthetic polypeptide
  source 1..1108: mol_type = other DNA
tgatatggtttgaatgtgtgttccctccgatatctcatgtagaattgtaatttccagtttggagaaaaggcctggtgggaggtgaattggtcacgggggcagatttccccttgctgttctcaggatagtgagtgcgttctcgcgagatctgtttgtttaaaagtgtgtagcacctccctcttcactatcttcctcctgctctggctgtgtgaagatctgcctccttcctcttcggcttcatgcatgatcgtaagtttcctgaggcctcctcagccatgcttcctgcatagcctgcagaaataatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcaacttcgaaaggcgatgttggaaaaagacggactttttaa

SEQ ID NO: 10314 - DNA, 1033 bp, synthetic construct
  misc_feature 1..1033: note = Synthetic polypeptide
  source 1..1033: mol_type = other DNA
tgatatggtttgaatgtgtgttccctccgatatctcatgtagaattgtaatttccagtttggagaaaaggcctggtgggaggtgaattggtcacgggggcagatttccccttgctgttctcaggatagtgagtgcgttctcgcgagatctgtttgtttaaaagtgtgtagcacctccctcttcactatcttcctcctgctctggctgtgtgaagatctgcctccttcctcttcggcttcatgcatgatcgtaagtttcctgaggcctcctcagccatgcttcctgcatagcctgcagaaataatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgacatcttag

SEQ ID NO: 10315 - DNA, 1210 bp, synthetic construct
  misc_feature 1..1210: note = Synthetic polypeptide
  source 1..1210: mol_type = other DNA
tgatatggtttgaatgtgtgttccctccgatatctcatgtagaattgtaatttccagtttggagaaaaggcctggtgggaggtgaattggtcacgggggcagatttccccttgctgttctcaggatagtgagtgcgttctcgcgagatctgtttgtttaaaagtgtgtagcacctccctcttcactatcttcctcctgctctggctgtgtgaagatctgcctccttcctcttcggcttcatgcatgatcgtaagtttcctgaggcctcctcagccatgcttcctgcatagcctgcagaaataatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcaacttcgaaaggcgatgttggaaaaagacggataatttgcctagtgggattgggcctggtggtcttcttcttcagttttctactttcaatatttcgttccaagtaccacggctatccttatagtgatctggactttgagtga

SEQ ID NO: 10316 - DNA, 630 bp, synthetic construct; identical to SEQ ID NO: 9907
  misc_feature 1..630: note = Synthetic polypeptide
  source 1..630: mol_type = other DNA

SEQ ID NO: 10317 - DNA, 711 bp, synthetic construct; identical to SEQ ID NO: 9908
  misc_feature 1..711: note = Synthetic polypeptide
  source 1..711: mol_type = other DNA

SEQ ID NO: 10318 - DNA, 277 bp, synthetic construct; identical to SEQ ID NO: 9898
  misc_feature 1..277: note = Synthetic polypeptide
  source 1..277: mol_type = other DNA

SEQ ID NO: 10319 - DNA, 406 bp, synthetic construct; identical to SEQ ID NO: 9899
  misc_feature 1..406: note = Synthetic polypeptide
  source 1..406: mol_type = other DNA

SEQ ID NO: 10320 - DNA, 475 bp, synthetic construct; identical to SEQ ID NO: 9900
  misc_feature 1..475: note = Synthetic polypeptide
  source 1..475: mol_type = other DNA

SEQ ID NO: 10321 - DNA, 430 bp, synthetic construct; identical to SEQ ID NO: 9901
  misc_feature 1..430: note = Synthetic polypeptide
  source 1..430: mol_type = other DNA

SEQ ID NO: 10322 - DNA, 490 bp, synthetic construct; identical to SEQ ID NO: 9902
  misc_feature 1..490: note = Synthetic polypeptide
  source 1..490: mol_type = other DNA

SEQ ID NO: 10323 - DNA, 247 bp, synthetic construct; identical to SEQ ID NO: 9903
  misc_feature 1..247: note = Synthetic polypeptide
  source 1..247: mol_type = other DNA

SEQ ID NO: 10324 - DNA, 355 bp, synthetic construct; identical to SEQ ID NO: 9904
  misc_feature 1..355: note = Synthetic polypeptide
  source 1..355: mol_type = other DNA

SEQ ID NO: 10325 - DNA, 368 bp, synthetic construct; identical to SEQ ID NO: 6482
  misc_feature 1..368: note = Synthetic polypeptide
  source 1..368: mol_type = other DNA

SEQ ID NO: 10326 - DNA, 239 bp, synthetic construct
  misc_feature 1..239: note = Synthetic polypeptide
  source 1..239: mol_type = other DNA
agccaccatgaactgtgtgccaggattaatgcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaa

SEQ ID NO: 10327 - DNA, 158 bp, synthetic construct; identical to SEQ ID NO: 7602
  misc_feature 1..158: note = Synthetic polypeptide
  source 1..158: mol_type = other DNA

SEQ ID NO: 10328 - DNA, 1607 bp, synthetic construct
  misc_feature 1..1607: note = Synthetic polypeptide
  source 1..1607: mol_type = other DNA
tgcggtaggcagctataatggccccccagagaggcccacatcctaatccctaaaacccgtgaatatgtctggttacaaggcaaaaaggactttgcaaatctttgcgaatgtgattaagcaaaggatcgtgagatggggatattctcccgatgatctggcttggccccatgttatcacaagggtccttataagtgaaaaaggagcagcagtgccagagtgaggagtgaggaagactctgcagccattgctggacttgaagacggaggaaggggctgtgagcccgggaatgcaagtgccctctaggaactggaaagggcaagaaaatggattctgccccagaccctcggggaggagtgcagacctgccaaccctcatttcaggcttccgatctccagaagcgtaaggtgtggatggaggagtgtgcgctgtccagcgtgctgcagacacacctgcgggaggaccacgagggcaccatccgcggcgtcttgggccgactgggcggcctcactgaagagtccacgcggtgtgtcctgcaggggcatgacctgctgttgcgctcagccctccggaggctggcactccgcggcaacgccctggccaccctgacgcagatgcggctatcggggaagaagcacctcctgcaggagctgcgggaacagcgtgcactggagcaggggtcctcccagtgcctggacgagcatcagtggcagctgctcagggccctggaggcgcgtgtgctggaggaggccagccggctagaggaggaagcacagcagacacggctgcagctccagcagcggctcctggccgaggcccaggaggtggggcagcttctgcagcagcacatggagtgcgccattgggcaggcgctgctggtgcatgcacggaatgcagccaccaagagccgggccaaggacagggatgacttcaagaggacactgatggaggcggcagtggagagcgtctacgtgaccagcgctggtgtcagccgcctggtgcaggcgtattaccagcaaatcggaaggatcatggaggaccacgaggagagaaaactgcagcacctgaagaccctgcagggtgagaggatggaaaattacaaactgcggaaaaagcaagaactcagcaacccttcgtcgggcagcaggacggcaggtggcgctcatgagacctcccaggcggtccaccagaggatgctgtcccagcagaagaggttcctggcccagttcccagtgcaccagcagatgcgtctgcacgcccagcagcagcaggcaggagtcatggaccttctggaagcccagctggagacccagctacaggaagctgaacagaacttcatctccgagctggcagccttggcccgagtgccccttgctgaaagcaaactgttgcctgctaagcgtgggctgctagagaagcccctaaggactaaaaggaagaagcccctgccccaggaaagaggggacctgggggtgcccaacaatgaggaccttgcctccggggaccagacctcaggctcactcagcagcaaaaggctgagtcagcaagaaagtgaagctggggacagtgggaactcaaagaagatgctaaagagaagaagcaacttgtag

SEQ ID NO: 10329 - DNA, 698 bp, synthetic construct; identical to SEQ ID NO: 9922
  misc_feature 1..698: note = Synthetic polypeptide
  source 1..698: mol_type = other DNA

SEQ ID NO: 10330 - DNA, 779 bp, synthetic construct; identical to SEQ ID NO: 9923
  misc_feature 1..779: note = Synthetic polypeptide
  source 1..779: mol_type = other DNA

SEQ ID NO: 10331 - DNA, 1365 bp, synthetic construct; identical to SEQ ID NO: 8252
  misc_feature 1..1365: note = Synthetic polypeptide
  source 1..1365: mol_type = other DNA

SEQ ID NO: 10332 - DNA, 773 bp, synthetic construct; identical to SEQ ID NO: 10251
  misc_feature 1..773: note = Synthetic polypeptide
  source 1..773: mol_type = other DNA

SEQ ID NO: 10333 - DNA, 340 bp, synthetic construct; identical to SEQ ID NO: 8193
  misc_feature 1..340: note = Synthetic polypeptide
  source 1..340: mol_type = other DNA

SEQ ID NO: 10334 - DNA, 330 bp, synthetic construct; identical to SEQ ID NO: 6490
  misc_feature 1..330: note = Synthetic polypeptide
  source 1..330: mol_type = other DNA

SEQ ID NO: 10335 - DNA, 1537 bp, synthetic construct; identical to SEQ ID NO: 9702
  misc_feature 1..1537: note = Synthetic polypeptide
  source 1..1537: mol_type = other DNA

SEQ ID NO: 10336 - DNA, 374 bp, synthetic construct
  misc_feature 1..374: note = Synthetic polypeptide
  source 1..374: mol_type = other DNA
agcactgtccaatagaactttctgctgcgatggaaatgttccatctctgctctgtccagtacgttagccaccagccacatgtggcttttgagctcatgaaacatggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactga

SEQ ID NO: 10337 - DNA, 2471 bp, synthetic construct; identical to SEQ ID NO: 576
  misc_feature 1..2471: note = Synthetic polypeptide
  source 1..2471: mol_type = other DNA

SEQ ID NO: 10338 - DNA, 494 bp, synthetic construct; identical to SEQ ID NO: 10040
  misc_feature 1..494: note = Synthetic polypeptide
  source 1..494: mol_type = other DNA

SEQ ID NO: 10339 - DNA, 804 bp, synthetic construct; identical to SEQ ID NO: 10041
  misc_feature 1..804: note = Synthetic polypeptide
  source 1..804: mol_type = other DNA

SEQ ID NO: 10340 - DNA, 1911 bp, synthetic construct; identical to SEQ ID NO: 10042
  misc_feature 1..1911: note = Synthetic polypeptide
  source 1..1911: mol_type = other DNA

SEQ ID NO: 10341 - DNA, 531 bp, synthetic construct; identical to SEQ ID NO: 10043
  misc_feature 1..531: note = Synthetic polypeptide
  source 1..531: mol_type = other DNA

SEQ ID NO: 10342 - DNA, 776 bp, synthetic construct; identical to SEQ ID NO: 7522
  misc_feature 1..776: note = Synthetic polypeptide
  source 1..776: mol_type = other DNA

SEQ ID NO: 10343 - DNA, 548 bp, synthetic construct; identical to SEQ ID NO: 7523
  misc_feature 1..548: note = Synthetic polypeptide
  source 1..548: mol_type = other DNA

SEQ ID NO: 10344 - DNA, 399 bp, synthetic construct
  misc_feature 1..399: note = Synthetic polypeptide
  source 1..399: mol_type = other DNA
ggctgggctgaatggctcacgcctataatcccagcactttgggaagccaaggtacttaaacttcacccttgtttagcccctattaaggttgctttggatgtaggaagaggccccacattggaactaagacaggtttgtcaagggctatttaatgagttactagaaaatgggatttctgtgtggcctggttatttggaaactatgcagtcctcattggaacaactttattcgaagtatgatgaaatgagtattctcttcacagttttggttactgaaactactttggagaatggattaatacatctgagaagcagagacaccacaatgaaggaaatgatgcatatatccaaattaaaagactttttgattaagtatatatcatcagctaagaatgtatag

SEQ ID NO: 10345 - DNA, 138 bp, synthetic construct
  misc_feature 1..138: note = Synthetic polypeptide
  source 1..138: mol_type = other DNA
ggctgggctgaatggctcacgcctataatcccagcactttgggaagccaaggtacttaaacttcacccttgtttagcccctattaaggttgctttggatgtaggaagaggccccacattggaactaagacaggtatga

SEQ ID NO: 10346 - DNA, 467 bp, synthetic construct
  misc_feature 1..467: note = Synthetic polypeptide
  source 1..467: mol_type = other DNA
tgacatagtttggatatttgttttctctaaatctcatgttgaaatgtaatccacagagttggaggtagggcctggtggaagacatttggatcatacgggcaggtcccacacgaatgacttagcaccatccccttcgttatgagtgagttcatgagagatcttgttgttttaacatacatggcacttccccacgctctctctcttgttcctgcttttgccatgtgatgcacctgctcccccttcaccttcttccatggctgtaatcttcctgaggccctcaccagaagcagatgccagcaccatgcttcctgtacaccctgcataactgctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtgg

SEQ ID NO: 10347 - DNA, 504 bp, synthetic construct
  misc_feature 1..504: note = Synthetic polypeptide
  source 1..504: mol_type = other DNA
tgacatagtttggatatttgttttctctaaatctcatgttgaaatgtaatccacagagttggaggtagggcctggtggaagacatttggatcatacgggcaggtcccacacgaatgacttagcaccatccccttcgttatgagtgagttcatgagagatcttgttgttttaacatacatggcacttccccacgctctctctcttgttcctgcttttgccatgtgatgcacctgctcccccttcaccttcttccatggctgtaatcttcctgaggccctcaccagaagcagatgccagcaccatgcttcctgtacaccctgcataactgctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtggggatcgtgtggcagtggtgctgccccgagtgcctgag

SEQ ID NO: 10348 - DNA, 777 bp, synthetic construct
  misc_feature 1..777: note = Synthetic polypeptide
  source 1..777: mol_type = other DNA
tgacatagtttggatatttgttttctctaaatctcatgttgaaatgtaatccacagagttggaggtagggcctggtggaagacatttggatcatacgggcaggtcccacacgaatgacttagcaccatccccttcgttatgagtgagttcatgagagatcttgttgttttaacatacatggcacttccccacgctctctctcttgttcctgcttttgccatgtgatgcacctgctcccccttcaccttcttccatggctgtaatcttcctgaggccctcaccagaagcagatgccagcaccatgcttcctgtacaccctgcataactgctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtggggatcgtgtggcagtggtgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgtgatgggtggctgaacttcaagaaactactaaaatataaagtcagacacagagacgttaaataa

SEQ ID NO: 10349 - DNA, 1884 bp, synthetic construct
  misc_feature 1..1884: note = Synthetic polypeptide
  source 1..1884: mol_type = other DNA
tgacatagtttggatatttgttttctctaaatctcatgttgaaatgtaatccacagagttggaggtagggcctggtggaagacatttggatcatacgggcaggtcccacacgaatgacttagcaccatccccttcgttatgagtgagttcatgagagatcttgttgttttaacatacatggcacttccccacgctctctctcttgttcctgcttttgccatgtgatgcacctgctcccccttcaccttcttccatggctgtaatcttcctgaggccctcaccagaagcagatgccagcaccatgcttcctgtacaccctgcataactgctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtggggatcgtgtggcagtggtgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgtgatgggtggctgaacttcaagaaactactaaatgaggcatccaccactcatcactgtgtggagactggaagccaggaagcatctgccatctacttcactagtgggaccagtggtcttcccaagatggcagaacattcctactcgagcctgggcctcaaggccaagatggatgctggttggacaggcctgcaagcctctgatataatgtggaccatatcagacacaggttggatactgaacatcttgtgctcacttatggaaccttgggcattaggagcatgcacatttgttcatctcttgccaaagtttgacccactggttattctaaagacactctccagttatccaatcaagagtatgatgggtgcccccattgtttaccggatgttgctacagcaggatctttccagttacaagttcccccatctacagaactgcgtcactgtaggggagtcccttcttccagaaactctggagaactggagggcccagacaggactggacatccgagaatcctatggccagacagaaacgggattaacttgcatggtttccaagacaatgaaaatcaaaccaggatacatgggaacggctgcttcctgttatgatgtacagatcatagatgataagggcaacgtcctgccccccggcacagaaggagacattggcatcagggtcaaacccatcaggcctataggcatcttctctggctatgtggacaatcccgacaagacagcagccaacattcgaggagacttttggctccttggagaccggggaatcaaagatgaagatgggtatttccagtttatgggacgggcaaatgatatcattaactccagcgggtaccggattggaccctcggaggtagagaatgcactgatggagcaccctgctgtggttgagacggctgtgatcagcagcccagaccccgtccgaggagaggtggtgaaggcatttgtggtcctggcctcgcagttcctgtcccatgacccagaacagctcaccaaggagctgcagcagcatgtgaagtcagtgacagccccatacaagtacccaagaaagatagagtttgtcttgaacctgcccaagactgtcacagggaaaattcaacgagccaagcttcgagacaaggagtggaagatgtccggaaaagcccgtgcgcagtga

SEQ ID NO: 10350 - DNA, 1349 bp, synthetic construct; identical to SEQ ID NO: 7130
  misc_feature 1..1349: note = Synthetic polypeptide
  source 1..1349: mol_type = other DNA

SEQ ID NO: 10351 - DNA, 721 bp, synthetic construct; identical to SEQ ID NO: 10080
  misc_feature 1..721: note = Synthetic polypeptide
  source 1..721: mol_type = other DNA

SEQ ID NO: 10352 - DNA, 706 bp, synthetic construct; identical to SEQ ID NO: 10081
  misc_feature 1..706: note = Synthetic polypeptide
  source 1..706: mol_type = other DNA

SEQ ID NO: 10353 - DNA, 526 bp, synthetic construct; identical to SEQ ID NO: 10082
  misc_feature 1..526: note = Synthetic polypeptide
  source 1..526: mol_type = other DNA

SEQ ID NO: 10354 - DNA, 487 bp, synthetic construct; identical to SEQ ID NO: 10083
  misc_feature 1..487: note = Synthetic polypeptide
  source 1..487: mol_type = other DNA

SEQ ID NO: 10355 - DNA, 667 bp, synthetic construct; identical to SEQ ID NO: 10084
  misc_feature 1..667: note = Synthetic polypeptide
  source 1..667: mol_type = other DNA

SEQ ID NO: 10356 - DNA, 592 bp, synthetic construct; identical to SEQ ID NO: 10085
  misc_feature 1..592: note = Synthetic polypeptide
  source 1..592: mol_type = other DNA

SEQ ID NO: 10357 - DNA, 188 bp, synthetic construct
  misc_feature 1..188: note = Synthetic polypeptide
  source 1..188: mol_type = other DNA
cagggctggcaaatagatttttaacttgtctgtcaactccaattcattggcagcagctgcctggagcactggattgaggagtcccaggtgggatgggtgctcggtgggagagagctctagaactgctaagctacactgcacgggtgcgggagtggagagcggcaatgggattaccgagaggatgggat

SEQ ID NO: 10358 - DNA, 1569 bp, synthetic construct
  misc_feature 1..1569: note = Synthetic polypeptide
  source 1..1569: mol_type = other DNA
cagggctggcaaatagatttttaacttgtctgtcaactccaattcattggcagcagctgcctggagcactggattgaggagtcccaggtgggatgggtgctcggtgggagagagctctagaactgctaagctacactgcacgggtgcgggagtggagagcggcaatgggattaccgagaggatgggatggatctaggcagtgacgccggcagcagcagcagcagcagccgcgccagttcacagtccaactccaccaaagtgaccccttgctccgagtgcaaatcttcatcgtcgccggggggcagcctggacttggtgtctgccctggaggactatgaggagcccttcccggtctaccagaagaaggtgattgatgagtgggcgccggaggaggacggggaggaggaggaagaggaggacgagcgcgaccagcgagggtaccgggatgaccgctctccggcccgggaaccgggggacgtaagcgccaggacccgcagcggcggcggcgggggcaggagcgccaccaccgccatgccgcccccggtgcccaacggcaacctccaccagcacgacccccaggacctcaggcacaatggcaacgtggtggtggctggccggccgagctgttcccggggcccccgccgggcgatccaaaagccccagccggctgggggccggcgcagtggccgcggcccggcggctggggggctctgccttcagcccccagacggcgggacgtgcgtccccgaagagcccccggtgccacctatggattgggaggcgctggagaagcatctggccgggctgcagttccgggagcaggaggtacggaaccagggccaggcgaggaccaactccacctccgcacagaaaaatgagagagagtctatcagacagaagttggcacttggaagcttctttgatgatggcccaggaatttataccagctgtagcaaaagtgggaagccaagcctttcctcccgactgcagagtgggatgaacttgcagatatgctttgtcaacgacagtggcagtgataaggacagtgatgctgatgacagtaagactgaaaccagcttggacacccccttgtctcccatgagcaaacagagttcttcctattctgatagagacactactgaagaggagtctgaatccttggatgacatggacttccttacaaggcaaaagaaattgcaagctgaagccaaaatggcccttgccatggccaaaccaatggccaaaatgcaagtagaagtggagaaacagaacaggaaaaagtctcccgtcgctgatcttctgccacacatgcctcatataagtgaatgcttgatgaaaagaagtttaaaacccaccgacctgagagacatgactattgggcagctacaagtgatagtcaatgatctccattcccagatagaaagcttgaatgaagagttggtccagctgcttctcatccgagatgagctgcacacagagcaggatgccatgctggtggacattgaagacttgaccagacatgctgaaagtcagcagaagcacatggcagagaaaatgcctgcaaagtga

SEQ ID NO: 10359 - DNA, 338 bp, synthetic construct
  misc_feature 1..338: note = Synthetic polypeptide
  source 1..338: mol_type = other DNA
cagggctggcaaatagatttttaacttgtctgtcaactccaattcattggcagcagctgcctggagcactggattgaggagtcccaggtgggatgggtgctcggtgggagagagctctagaactgctaagctacactgcacgggtgcgggagtggagagcggcaatgggattaccgagaggatgggatggatctaggcagtgacgccggcagcagcagcagcagcagccgcgccagttcacagtccaactccaccaaagtgaccccttgctccgagtgcaaatcttcatcgtcgccggggggcagcctggacttggtgtctgccctggaggactatga

SEQ ID NO: 10360 - DNA, 432 bp, synthetic construct
  misc_feature 1..432: note = Synthetic polypeptide
  source 1..432: mol_type = other DNA
cagggctggcaaatagatttttaacttgtctgtcaactccaattcattggcagcagctgcctggagcactggattgaggagtcccaggtgggatgggtgctcggtgggagagagctctagaactgctaagctacactgcacgggtgcgggagtggagagcggcaatgggattaccgagaggatgggatggatctaggcagtgacgccggcagcagcagcagcagcagccgcgccagttcacagtccaactccaccaaagtgaccccttgctccgagtgcaaatcttcatcgtcgccggggggcagcctggacttggtgtctgccctggaggactatgaggagcccttcccggtctaccagaagaaggtgattgatgagtgggcgccggaggaggacggggaggaggaggaagaggaggacgagcgcgaccag

SEQ ID NO: 10361 - DNA, 237 bp, synthetic construct
  misc_feature 1..237: note = Synthetic polypeptide
  source 1..237: mol_type = other DNA
cagggctggcaaatagatttttaacttgtctgtcaactccaattcattggcagcagctgcctggagcactggattgaggagtcccaggtgggatgggtgctcggtgggagagagctctagaactgctaagctacactgcacgggtgcgggagtggagagcggcaatgggattaccgagaggatgggatggatctaggcagtgacgccggcagcagcagcagcagcagccgcgccagt

SEQ ID NO: 10362 - DNA, 1530 bp, synthetic construct
  misc_feature 1..1530: note = Synthetic polypeptide
  source 1..1530: mol_type = other DNA
cagggctggcaaatagatttttaacttgtctgtcaactccaattcattggcagcagctgcctggagcactggattgaggagtcccaggtgggatgggtgctcggtgggagagagctctagaactgctaagctacactgcacgggtgcgggagtggagagcggcaatgggattaccgagaggatgggatggatctaggcagtgacgccggcagcagcagcagcagcagccgcgccagttcacagtccaactccaccaaagtgaccccttgctccgagtgcaaatcttcatcgtcgccggggggcagcctggacttggtgtctgccctggaggactatgaggagcccttcccggtctaccagaagaaggtgattgatgagtgggcgccggaggaggacggggaggaggaggaagaggaggacgagcgcgaccagcgagggtaccgggatgaccgctctccggcccgggaaccgggggacgtaagcgccaggacccgcagcggcggcggcgggggcaggagcgccaccaccgccatgccgcccccggtgcccaacggcaacctccaccagcacgacccccaggacctcaggcacaatggcaacgtggtggtggctggccggccgagctgttcccggggcccccgccgggcgatccaaaagccccagccggctgggggccggcgcagtggccgcggcccggcggctggggggctctgccttcagcccccagacggcgggacgtgcgtccccgaagagcccccggtgccacctatggattgggaggcgctggagaagcatctggccgggctgcagttccgggagcaggaggcacagaaaaatgagagagagtctatcagacagaagttggcacttggaagcttctttgatgatggcccaggaatttataccagctgtagcaaaagtgggaagccaagcctttcctcccgactgcagagtgggatgaacttgcagatatgctttgtcaacgacagtggcagtgataaggacagtgatgctgatgacagtaagactgaaaccagcttggacacccccttgtctcccatgagcaaacagagttcttcctattctgatagagacactactgaagaggagtctgaatccttggatgacatggacttccttacaaggcaaaagaaattgcaagctgaagccaaaatggcccttgccatggccaaaccaatggccaaaatgcaagtagaagtggagaaacagaacaggaaaaagtctcccgtcgctgatcttctgccacacatgcctcatataagtgaatgcttgatgaaaagaagtttaaaacccaccgacctgagagacatgactattgggcagctacaagtgatagtcaatgatctccattcccagatagaaagcttgaatgaagagttggtccagctgcttctcatccgagatgagctgcacacagagcaggatgccatgctggtggacattgaagacttgaccagacatgctgaaagtcagcagaagcacatggcagagaaaatgcctgcaaagtga

SEQ ID NO: 10363 - DNA, 1615 bp, synthetic construct; identical to SEQ ID NO: 10001
  misc_feature 1..1615: note = Synthetic polypeptide
  source 1..1615: mol_type = other DNA

SEQ ID NO: 10364 - DNA, 694 bp, synthetic construct; identical to SEQ ID NO: 10002
  misc_feature 1..694: note = Synthetic polypeptide
  source 1..694: mol_type = other DNA

SEQ ID NO: 10365 - DNA, 333 bp, synthetic construct; identical to SEQ ID NO: 6583
  misc_feature 1..333: note = Synthetic polypeptide
  source 1..333: mol_type = other DNA

SEQ ID NO: 10366 - DNA, 694 bp, synthetic construct; identical to SEQ ID NO: 10173
  misc_feature 1..694: note = Synthetic polypeptide
  source 1..694: mol_type = other DNA

SEQ ID NO: 10367 - DNA, 760 bp, synthetic construct; identical to SEQ ID NO: 10174
  misc_feature 1..760: note = Synthetic polypeptide
  source 1..760: mol_type = other DNA

SEQ ID NO: 10368 - DNA, 664 bp, synthetic construct; identical to SEQ ID NO: 10175
  misc_feature 1..664: note = Synthetic polypeptide
  source 1..664: mol_type = other DNA

SEQ ID NO: 10369 - DNA, 1067 bp, synthetic construct; identical to SEQ ID NO: 9936
  misc_feature 1..1067: note = Synthetic polypeptide
  source 1..1067: mol_type = other DNA

SEQ ID NO: 10370 - DNA, 968 bp, synthetic construct; identical to SEQ ID NO: 9937
  misc_feature 1..968: note = Synthetic polypeptide
  source 1..968: mol_type = other DNA

SEQ ID NO: 10371 - DNA, 914 bp, synthetic construct
  misc_feature 1..914: note = Synthetic polypeptide
  source 1..914: mol_type = other DNA
aagttaagcataaactagccatttgacctagcaattctagccctaggaatttatctagaagaaatgaaagcatgtgttccaaaaagacgtgtacataaatgttctcagcagcctcattcactataggcagcaactggaaacaacccaagtgtccgtcagctagagaatggatagacccatgtggtctgtgcatacagtggagtactgctcagttacacaaggaaaagaaactatggatacaggtcacaggagggatgatcttcaaaacattacaggggaaggacgcaccctgttatgaatctgatactgatatttatgagactgtggctgctgcaacatcagaatccactactgtagagcctggcaagctggatgtgggagccacggagggccaagacctgcagcacatcagcaaccaaaagatgcccacaggtccccctgaggaccgcctgagtttaaaatttctgccatcaagtgaggaagacaatgatgatgccaagattttaccatcacctgtccagggttcttctgaggacaacctgagtttagtatgcctaccacgaagtgaagatgatgactgtgatgatgatgatgatgatgatgcccagattttaccgtcacgtgtccagggtggctgttaccggtttgatagcagttcttgttcttctgaggacaacctgagtttagtatgcctaccacgaagtgaagatgatgactgtgatgatgatgatgatgatgcccagattttaccgtcacctgtccaggcttgttctgaagatagcctgtttttaagatgctcactgagacacaaagatgaagaagaagaagatgatgatgacatccacataacagctcggatagaaagtgacttgacgctggagagtctaagtgatgaagagattcatccagggtga

SEQ ID NO: 10372 - DNA, 6407 bp, synthetic construct
  misc_feature 1..6407: note = Synthetic polypeptide
  source 1..6407: mol_type = other DNA
ctaggctgtaagctgaagaaaggaggggccagctctgtttttgctcacctttgtgttgccagcaccattttatctccaggcacgaaacagggggcaagctgattttcatggccccaggacccatcgagctcagggcacacgccatccttgtttctgatggtggagagctccggattggatccgaagacaagcccttccaaggcagagctcagatcacactctacgggagttcctactcaactcccttctttccctatggagtcaagttcctggctgtgaggaatggaactctttctctgcacggttcactaccagaagtaattgtcacctgtcttagagcaactgcccatgccctagacacagtgctggctttagaagatgctgtggactggaaccctggggatgaagttgtcatcatcagtggaacaggtgttaaaggtgccaaaccgatggaagagattgtcactgtggaaactgtgcaggatacagacctctatcttaagtcacctttgagatattctcacaactttacagagaattgggtggctggagagcaccatattttaaaggccactgtggctctgctcagcaggagtattaccatacaaggaaatctcactaatgagagggagaagctgcttgtttcatgccaggaggccaatgctccagaaggtaatctgcagcactgtttgtattccatgagtgagaagatgctaggatccagggatatgggagccagagtgatcgttcagtccttcccagaagagcccagccaggtccagttgaagggagtgcagtttcaagtcttggggcaagccttccataagcatctgagctcactcactctggtgggagctatgagagagtctttcatacagggctgcacagtgaggaactccttcagtagaggcctcagcatgtgcgggaccttgggcctgaaggtggacagtaatgtattctacaatattttaggtcatgcgctgctagttgggacatgcacggagatgagatatatctcctgggaggcaattcatggaaggaaagatgactggtcaggacatggaaatataataagaaacaacgtgatcatccaggtttctggtgccgagggactctccaatcctgaaatgttgacaccatctggcatctatatctgcagtcccaccaatgttatagaggggaacagagtgtgtggtgctggctatggctactttttccatctcatgaccaaccaaacatcacaagctccgcttctttccttcactcagaacattgcacattcttgtaccaggtatggtctctttgtataccctaaatttcagccaccttgggataatgtcactggcaccactctgttccagagcttcacagtttgggaaagtgcaggtggtgcccagatttttagaagtagcaatcttcgcctgaaaaacttcaaagtttattcatgcagagattttggaattgacgtcttggaaagtgatgcaaatacttcagttactgacagcttattacttggtcattttgcccacaagggaagtctgtgtatgtcatctgggattaaaactcctaaaagatgggaactgatggtgtctaacacaacctttgttaattttgatctcatcaactgtgtggccattagaacctgttcagactgttcccaaggacaaggtggatttactgtgaagaccagccagttgaagtttacaaactcttcaaacttagtggcatttccatttcctcatgcagcaattttggaagacttggatgggtctctgtctgggaaaaacagaagtcacattcttgcttctatggaaaccctttcagcttcttgtttggtcaattcaagctttggtcgggttgtccatggcagtgcctgtggaggaggtgttctttttcatcgtatgtctattggtttagcgaatactcctgaagtttcttatgatttaaccatgactgacagcagaaataaaacaaccactgtcaattatgtacgtgatacattgtctaaccctcgtggctggatggctctgctcttggaccaagagacctactcattgcaatctgagaacctttggatcaacagatctctgcagtactcagcaacctttgacaactttgctcctggtaattacctactgctggtgcacacagatttgccgccttaccctgacatcctcctaagatgtgggagtcgagtgggtctgtcttttccatttcttccatcaccaggtcagaaccaaggctgtgactggttcttcaatagccagctgaggcaactcacctatctggtttcaggtgaaggccaagttcaagtcattctccgggtgaaggaaggtatgcccccaactatttcagcttctacctctgcccctgaatcagctttaaaatggtccctccctgaaacatggcaaggtgttgaagaaggctggggaggatacaacaataccattccaggccctggggatgacgttctcattttacccaacagaactgtccttgtggatacagatcttccattcttcaaagggctgtatgtgatggggaccttagacttccctgtggacagaagcaatgttctgagtgtggcatgcatggtcattgcaggcggggagctgaaagttggtactttagaaaatcccttagaaaaggaacaaaagcttctgattctccttagagcctcagagggagtcttttgtgaccgtatgaatggaattcatattgacccaggaacaattggggtttatgggaaagttcatctttacagtgcttatcctaagaactcctggacacatcttggagctgatattgcctcaggaaatgagagaattatagtagaagatgcagtggattggcgcccccatgacaaaatagtccttagctcctcttcttatgagcctcatgaagcagaggtcctcactgtgaaagaagtcaagggccaccatgtgaggatctatgaacggctcaaacaccggcatattggaagtgtacatgtcacggaggatggccgacacattcgtttggctgctgaggttggactgttgacccgaaatatacaaattcagcctgacgtatcatgtagggggagactgtttgtggggtccttcaggaagtccagccgagaagaattttcaggtgtccttcaacttcttaatgtggaaattcagaacttcgggtcaccattgtactcatctgttgaattcagtaatgtgtcagcaggatcctggatcatatcatctactctgcaccagagctgtggcgggggcattcatgcagctgccagtcatggagtacttttaaatgacaatattgtgtttggcacagctggccatggcatagatttagagggtcaggcctatactgtcactaataaccttgtggttctgatgacacagccagcgtggtccaccatttgggtggcgggaatcaaagtgaaccaggtaaaggacatcaacctccatggcaacgttgtggcaggatcagagagacttggctttcacatccgaggccacaagtgctcctcttgtgaactgctttggtctgacaatgtggcgcattcaagtcttcatggccttcatctctataaggaaagtggacttgacaactgtaccagaatctctggcttcttggctttcaagaactttgactatggtgccatgttacatgtagagaacagcgtggagatagagaacattactctggtagacaatactattggtcttttggcagtagtgtatgtattttctgctccacaaaattccgtcaaaaaagtgcagattgtgcttaggaattcagtcattgtggccaccagctcttcttttgactgcattcaggacaaagtgaagccgcactcagccaacttgacatcaacagatagagctccctccaatccaagaggaggtcgaattggtattctgtggcctgtattcacctcagaaccaaatcagtggcctcaggagccatggcacaaagtgaggaatgatcattcaatttcaggaatcatgaaacttcaagatgttaccttttctagttttgtgaagagttgctatagcgatgacctggatgtctgcattctaccaaatgcagagaacagtggaattatgcacccaataacagcagagaggaccaggatgctaaagataaaagataaaaacaagttctactttccttcattacaacccaggaaagatttaggaaaagtagtctgtcctgaattagactgtgcaagtccaagaaaatatctcttcaaggatctggatgggagagccctgggtctgcctccaccagtttctgtatttcctaaaacagaggcagaatggactgcatccttcttcaacgcaggtacatttagagaagaacagaaatgtacataccaatttctgatgcaaggattcatctgcaaacagactgaccaagtggtcctaattcttgatagcgctgatgccatttgggcaattcagaagttatatccagttgtatctgtgactagtggttttgttgatgtctttagcagtgtaaatgccaatattccctgctctacttctgggtcagtgtctactttctattctatcttacccatcaggcaaatcaccaaagtctgcttcatggatcaaactcctcaagttttgcgcttttttctattggggaacaaaagtacctccaagcttctcttggctgtattctaccatgagctccagagcccccacgtcttcttaggggaaagttttattccacccactctggttcagtcagcttccttattgctgaatgaatctattggtgccaactatttcaacatcatggataacctcttgtatgttgtcctacaaggagaggagcccattgaaatacgctcaggtgtttccattcacttggccctcactgtgatggtttcagtcttagaaaaaggctgggaaatagtaatactcgaaagactaactaacttcttacagattggccaaaaccaaatcaggtttattcacgagatgcctggccatgaagagaccttaaaggccattgctgacagtagagcaaaaagaaagcgcaattgccctactgtgacttgcactagtcattatagaagagttggtcaacgtaggcctctcatgatggaaatgaactcacatagggcttcacccccaatgactgtggaaactatctcaaaagtgattgtcattgaaattggtgattcgccaacagtaaggagcactggaatgatttcatccttatcaagtaacaaattacagaatttggctcatcgagtcatcactgctcaacagactggggtactagagaatgttctgaatatgactatcggggccttactagttactcagtcaaagggagtcattggctatggaaatacaagcagttttaaaactgggaacttgatatatattcggccctatgcactttccatcctagtccagccttcagatggagaagtgggaaatgagcttccagtgcagccacaattggtatttttggatgagcagaatcgaagagtagagtccctgggacctccttcagagccatggacaatttcagcttccctggaaggagcatcagactcagtgctaaaagggtgcacccaggcagaaactcaagatggttatgttagcttctacaacttggcagtcttgatctctgggtcaaactggcactttatttttactgtcacttctcctccaggagtcaattttacagctcgatccaagccatttgctgtcttgcctgtgactaggaaggagaagtcgaccatcatcctggctgcttccctgtcctctgtggcctcatggctggctctgagctgtctggtgtgctgttggcttaaaagaagcaaaagcagaaaaacaaaacctgaagagattcctgaatcccagactaataatcaaaatattcatatccacatctcatccaaacgccgagaatcacaagggcccaaaaaagaagacactgtggtgggagaagatatgagaatgaaggtcatgctgggcaaggtgaaccagtgcccccaccagttgatgaatggagtgtccagaaggaaagttagccgccacattgtccgagaggaagaggctgctgtgcctgctcctggtactactggcatcacatcccatgggcacatctgtgctccaggtgctcctgctcagcaggtgtacctgcaagagactgggaactggaaggagggccaagagcagttgctcagataccagctggcaggccaaaatcagctgctgctgctatgcccagacttcagacaagagaggcagcagttgccagggcaaagtcggctgagtaagcaaagtggcagcttggggctttcccaagagaagaaagcctcctgcggggccactgaggcattctgccttcattcagtacacccggaaactattcaggagcaactgtga

SEQ ID NO: 10373 - DNA, 4373 bp, synthetic construct
  misc_feature 1..4373: note = Synthetic polypeptide
  source 1..4373: mol_type = other DNA
ctaggctgtaagctgaagaaaggaggggccagctctgtttttgctcacctttgtgttgccagcaccattttatctccaggcacgaaacagggggcaagctgattttcatggccccaggacccatcgagctcagggcacacgccatccttgtttctgatggtggagagctccggattggatccgaagacaagcccttccaaggcagagctcagatcacactctacgggagttcctactcaactcccttctttccctatggagtcaagttcctggctgtgaggaatggaactctttctctgcacggttcactaccagaagtaattgtcacctgtcttagagcaactgcccatgccctagacacagtgctggctttagaagatgctgtggactggaaccctggggatgaagttgtcatcatcagtggaacaggtgttaaaggtgccaaaccgatggaagagattgtcactgtggaaactgtgcaggatacagacctctatcttaagtcacctttgagatattctcacaactttacagagaattgggtggctggagagcaccatattttaaaggccactgtggctctgctcagcaggagtattaccatacaaggaaatctcactaatgagagggagaagctgcttgtttcatgccaggaggccaatgctccagaaggtaatctgcagcactgtttgtattccatgagtgagaagatgctaggatccagggatatgggagccagagtgatcgttcagtccttcccagaagagcccagccaggtccagttgaagggagtgcagtttcaagtcttggggcaagccttccataagcatctgagctcactcactctggtgggagctatgagagagtctttcatacagggctgcacagtgaggaactccttcagtagaggcctcagcatgtgcgggaccttgggcctgaaggtggacagtaatgtattctacaatattttaggtcatgcgctgctagttgggacatgcacggagatgagatatatctcctgggaggcaattcatggaaggaaagatgactggtcaggacatggaaatataataagaaacaacgtgatcatccaggtttctggtgccgagggactctccaatcctgaaatgttgacaccatctggcatctatatctgcagtcccaccaatgttatagaggggaacagagtgtgtggtgctggctatggctactttttccatctcatgaccaaccaaacatcacaagctccgcttctttccttcactcagaacattgcacattcttgtaccaggtatggtctctttgtataccctaaatttcagccaccttgggataatgtcactggcaccactctgttccagagcttcacagtttgggaaagtgcaggtggtgcccagatttttagaagtagcaatcttcgcctgaaaaacttcaaagtttattcatgcagagattttggaattgacgtcttggaaagtgatgcaaatacttcagttactgacagcttattacttggtcattttgcccacaagggaagtctgtgtatgtcatctgggattaaaactcctaaaagatgggaactgatggtgtctaacacaacctttgttaattttgatctcatcaactgtgtggccattagaacctgttcagactgttcccaaggacaaggtggatttactgtgaagaccagccagttgaagtttacaaactcttcaaacttagtggcatttccatttcctcatgcagcaattttggaagacttggatgggtctctgtctgggaaaaacagaagtcacattcttgcttctatggaaaccctttcagcttcttgtttggtcaattcaagctttggtcgggttgtccatggcagtgcctgtggaggaggtgttctttttcatcgtatgtctattggtttagcgaatactcctgaagtttcttatgatttaaccatgactgacagcagaaataaaacaaccactgtcaattatgtacgtgatacattgtctaaccctcgtggctggatggctctgctcttggaccaagagacctactcattgcaatctgagaacctttggatcaacagatctctgcagtactcagcaacctttgacaactttgctcctggtaattacctactgctggtgcacacagatttgccgccttaccctgacatcctcctaagatgtgggagtcgagtgggtctgtcttttccatttcttccatcaccaggtcagaaccaaggctgtgactggttcttcaatagccagctgaggcaactcacctatctggtttcaggtgaaggccaagttcaagtcattctccgggtgaaggaaggtatgcccccaactatttcagcttctacctctgcccctgaatcagctttaaaatggtccctccctgaaacatggcaaggtgttgaagaaggctggggaggatacaacaataccattccaggccctggggatgacgttctcattttacccaacagaactgtccttgtggatacagatcttccattcttcaaagggctgtatgtgatggggaccttagacttccctgtggacagaagcaatgttctgagtgtggcatgcatggtcattgcaggcggggagctgaaagttggtactttagaaaatcccttagaaaaggaacaaaagcttctgattctccttagagcctcagagggagtcttttgtgaccgtatgaatggaattcatattgacccaggaacaattggggtttatgggaaagttcatctttacagtgcttatcctaagaactcctggacacatcttggagctgatattgcctcaggaaatgagagaattatagtagaagatgcagtggattggcgcccccatgacaaaatagtccttagctcctcttcttatgagcctcatgaagcagaggtcctcactgtgaaagaagtcaagggccaccatgtgaggatctatgaacggctcaaacaccggcatattggaagtgtacatgtcacggaggatggccgacacattcgtttggctgctgaggttggactgttgacccgaaatatacaaattcagcctgacgtatcatgtagggggagactgtttgtggggtccttcaggaagtccagccgagaagaattttcaggtgtccttcaacttcttaatgtggaaattcagaacttcgggtcaccattgtactcatctgttgaattcagtaatgtgtcagcaggatcctggatcatatcatctactctgcaccagagctgtggcgggggcattcatgcagctgccagtcatggagtacttttaaatgacaatattgtgtttggcacagctggccatggcatagatttagagggtcaggcctatactgtcactaataaccttgtggttctgatgacacagccagcgtggtccaccatttgggtggcgggaatcaaagtgaaccaggtaaaggacatcaacctccatggcaacgttgtggcaggatcagagagacttggctttcacatccgaggccacaagtgctcctcttgtgaactgctttggtctgacaatgtggcgcattcaagtcttcatggccttcatctctataaggaaagtggacttgacaactgtaccagaatctctggcttcttggctttcaagaactttgactatggtgccatgttacatgtagagaacagcgtggagatagagaacattactctggtagacaatactattggtcttttggcagtagtgtatgtattttctgctccacaaaattccgtcaaaaaagtgcagattgtgcttaggaattcagtcattgtggccaccagctcttcttttgactgcattcaggacaaagtgaagccgcactcagccaacttgacatcaacagatagagctccctccaatccaagaggaggtcgaattggtattctgtggcctgtattcacctcagaaccaaatcagtggcctcaggagccatggcacaaagtgaggaatgatcattcaatttcaggaatcatgaaacttcaagatgttaccttttctagttttgtgaagagttgctatagcgatgacctggatgtctgcattctaccaaatgcagagaacagtggaattatgcacccaataacagcagagaggaccaggatgctaaagataaaagataaaaacaagttctactttccttcattacaacccaggaaagatttaggaaaagtagtctgtcctgaattagactgtgcaagtccaagaaaatatctcttcaaggatctggatgggagagccctgggtctgcctccaccagtttctgtatttcctaaaacagaggcagaatggactgcatccttcttcaacgcagtaaccactgagcaggctttgaagatttcagaatag

SEQ ID NO: 10374 - DNA, 1447 bp, synthetic construct; identical to SEQ ID NO: 9968
  misc_feature 1..1447: note = Synthetic polypeptide
  source 1..1447: mol_type = other DNA

SEQ ID NO: 10375 - DNA, 1828 bp, synthetic construct; identical to SEQ ID NO: 9969
  misc_feature 1..1828: note = Synthetic polypeptide
  source 1..1828: mol_type = other DNA

SEQ ID NO: 10376 - DNA, 2436 bp, synthetic construct; identical to SEQ ID NO: 10006
  misc_feature 1..2436: note = Synthetic polypeptide
  source 1..2436: mol_type = other DNA

SEQ ID NO: 10377 - DNA, 1956 bp, synthetic construct; identical to SEQ ID NO: 10007
  misc_feature 1..1956: note = Synthetic polypeptide
  source 1..1956: mol_type = other DNA

SEQ ID NO: 10378 - DNA, 1307 bp, synthetic construct
  misc_feature 1..1307: note = Synthetic polypeptide
  source 1..1307: mol_type = other DNA
ctcttcctctccctctccccacggtgtccctctctttccacggtctccctctctttccacggtctccctctcatgcggagccgaagctggactgtactgccgccatctcggctcactgcaacctccctgcctgattctcctgcctcagcctgccgagtgcctgcgattgcaggcacgcgccgccacgcctgactggttttggtggagacggggtttcgctgtgttggccgggcaggtctccagcccctaaccgcgagtgatccgccagcctcggcctcccgaggtgccgggattgcagacggagtctggttcactcagtgctcaatggtgcccaggctggagtgcagtggcgtgatctcggctcgctgcaacctccacctcccagccgtctgccttggcctcccaaagtgccgagattgcagcctctgcccggccgccaccccatctgggaagtgaggagtgtctctgcctggccgcgcatcgtctgggatgtgaggagcccctctgcctggctgcctagtctggaaagtgaggagcgtctccgcctggccgccatcccatctaggaagtgaggagcggcgcctcttcccggctgccatcacatctaggaagtgaggagcgtctctgcccggccgcccatcgtctgagatgtggggagcgcctctgccccgcctccccatctgggatgtgaggagcgcctctgcccggccgcaaccccgtctgggaggaagccagcagacctgcagaacttggctcccgggacccacccaccatttataactttcaacagtgaagtcaaaacggatgtaaataagattgaggaatttcttgaagaagtcttatgccctcccaagtacttaaagctttcaccaaaacacccagaatcaaatactgctggaatggacatctttgccaaattctctgcatatatcaagaattcaaggccagaggctaatgaagcactggagaggggtctcctgaaaaccctgcagaaactggatgaatatctgaattctcctctccctgatgaaattgatgaaaatagtatggaggacataaagttttctacacgtaaatttctggatggcaatgaaatgacattagctgattgcaacctgctgcccaaactgcatattgtcaaggtggtggccaaaaaatatcgcaactttgatattccaaaagaaatgactggcatctggagatacctaactaatgcatacagtagggacgagttcaccaatacctgtcccagtgataaggaggttgaaatagcatatagtgatgtagccaaaagactcaccaagtaa

SEQ ID NO: 10379 - DNA, 451 bp, synthetic construct
  misc_feature 1..451: note = Synthetic polypeptide
  source 1..451: mol_type = other DNA
ctagaccaagattcgtcagctgcatgcttttggataagtgacttcccaacctggattctcgttttcttctccaagccaaccaccagcaaacattgcctggaagctgacaaactctaaattatgcttgaactgggagcatgtaaaaaccatggaaaatgagtctgaagttttggggtacaagattctgtaccggcaaaacagacagagtaaaactcatattttggaaacaaacaatacatcagctgagcttctggttccatttgaagaagactacttaattgaaataagaacagtcagtgatggtggagatggaagcagcagtgaggaaattaggattccaaaaatgtcaagtttgagttccagaggaattcaattcttagaacctagcacccattttctttccattgtcattgtgatttttcactgttttgctattcagccacttatctga

SEQ ID NO: 10380 - DNA, 1085 bp, synthetic construct; identical to SEQ ID NO: 10247
  misc_feature 1..1085: note = Synthetic polypeptide
  source 1..1085: mol_type = other DNA

SEQ ID NO: 10381 - DNA, 400 bp, synthetic construct; identical to SEQ ID NO: 749
  misc_feature 1..400: note = Synthetic polypeptide
  source 1..400: mol_type = other DNA

SEQ ID NO: 10382 - DNA, 2301 bp, synthetic construct; identical to SEQ ID NO: 750
  misc_feature 1..2301: note = Synthetic polypeptide
  source 1..2301: mol_type = other DNA

SEQ ID NO: 10383 - DNA, 2381 bp, synthetic construct; identical to SEQ ID NO: 751
  misc_feature 1..2381: note = Synthetic polypeptide
  source 1..2381: mol_type = other DNA

SEQ ID NO: 10384 - DNA, 692 bp, synthetic construct; identical to SEQ ID NO: 752
  misc_feature 1..692: note = Synthetic polypeptide
  source 1..692: mol_type = other DNA

SEQ ID NO: 10385 - DNA, 2737 bp, synthetic construct
  misc_feature 1..2737: note = Synthetic polypeptide
  source 1..2737: mol_type = other DNA
gaattggaaatccttggacctcagttcctggcccaattctgcttctaacttgctttctaaccttgggtgcttggctggttactatggcgaccccatcattgggtcaggagatcactgccgcccttgcccttgcccagatggtcccgacagtggacgccagtttgccaggagctgctaccaagatcctgttactttacagcttgcctgtgtttgtgatcctggatacattggttccagatgtgacgactgtgcctcaggatactttggcaatccatcagaagttggggggtcgtgtcagccttgccagtgtcacaacaacattgacacgacagacccagaagcctgtgacaaggagactgggaggtgtctcaagtgcctgtaccacacggaaggggaacactgtcagttctgccggtttggatactatggtgatgccctccagcaggactgtcgaaagtgtgtctgtaattacctgggcaccgtgcaagagcactgtaacggctctgactgccagtgcgacaaagccactggtcagtgcttgtgtcttcctaatgtgatcgggcagaactgtgaccgctgtgcgcccaatacctggcagctggccagtggcactggctgtgacccatgcaactgcaatgctgctcattccttcgggccatcttgcaatgagttcacggggcagtgccagtgcatgcctgggtttggaggccgcacctgcagcgagtgccaggaactcttctggggagaccccgacgtggagtgccgagcctgtgactgtgaccccaggggcattgagacgccacagtgtgaccagtccacgggccagtgtgtctgcgttgagggtgttgagggtccacgctgtgacaagtgcacgcgagggtactcgggggtcttccctgactgcacaccctgccaccagtgctttgctctctgggatgtgatcattgccgagctgaccaacaggacacacagattcctggagaaagccaaggccttgaagatcagtggtgtgatcgggccttaccgtgagactgtggactcggtggagaggaaagtcagcgagataaaagacatcctggcgcagagccccgcagcagagccactgaaaaacattgggaatctctttgaggaagcagagaaactgattaaagatgttacagaaatgatggctcaagtagaagtgaaattatctgacacaacttcccaaagcaacagcacagccaaagaactggattctctacagacagaagccgaaagcctagacaacactgtgaaagaacttgctgaacaactggaatttatcaaaaactcagatattcggggtgccttggatagcattaccaagtatttccagatgtctcttgaggcagaggagagggtgaatgcctccaccacagaacccaacagcactgtggagcagtcagccctcatgagagacagagtagaagacgtgatgatggagcgagaatcccagttcaaggaaaaacaagaggagcaggctcgcctccttgatgaactggcaggcaagctacaaagcctagacctttcagccgctgccgaaatgacctgtggaacacccccaggggcctcctgttccgagactgaatgtggcgggccaaactgcagaactgacgaaggagagaggaagtgtggggggcctggctgtggtggtctggttactgttgcacacaacgcctggcagaaagccatggacttggaccaagatgtcctgagtgccctggctgaagtggaacagctctccaagatggtctctgaagcaaaactgagggcagatgaggcaaaacaaagtgctgaagacattctgttgaagacaaatgctaccaaagaaaaaatggacaagagcaatgaggagctgagaaatctaatcaagcaaatcagaaactttttgacccaggatagtgctgatttggacagcattgaagcagttgctaatgaagtattgaaaatggagatgcctagcaccccacagcagttacagaacttgacagaagatatacgtgaacgagttgaaagcctttctcaagtagaggttattcttcagcatagtgctgctgacattgccagagctgagatgttgttagaagaagctaaaagagcaagcaaaagtgcaacagatgttaaagtcactgcagatatggtaaaggaagctctggaagaagcagaaaaggcccaggtcgcagcagagaaggcaattaaacaagcagatgaagacattcaaggaacccagaacctgttaacttcgattgagtctgaaacagcagcttctgaggaaaccttgttcaacgcgtcccagcgcatcagcgagttagagaggaatgtggaagaacttaagcggaaagctgcccaaaactccggggaggcagaatatattgaaaaagtagtatatactgtgaagcaaagtgcagaagatgttaagaagactttagatggtgaacttgatgaaaagtataaaaaagtagaaaatttaattgccaaaaaaactgaagagtcagctgatgccagaaggaaagccgaaatgctacaaaatgaagcaaaaactcttttagctcaagcaaatagcaagctgcaactgctcaaagatttagaaagaaaatatgaagacaatcaaagatacttagaagataaagctcaagaattagcaagactggaaggagaagtccgttcactcctaaaggatataagccagaaagttgctgtgtatagcacatgcttgtaa

SEQ ID NO: 10386 - DNA, 1779 bp, synthetic construct
  misc_feature 1..1779: note = Synthetic polypeptide
  source 1..1779: mol_type = other DNA
ctactttgggccatgatggagccacagggactggatttgccctgccagtggttttcagatgttgaatgtaggcagtgtaggacagattcttcggaaaaaactaatgacatacgccctgtgattgctgcagcttactgtctggagagattcaagactgctgtgcagagagggagcacccaaatagagcctggcagtcttcctgagtcacggagacagagttcagaatttgagaaggccaagacctgccagctttttataaatgctgcagttgactctcctgcaattgattaccacatatctttagcccagagtgctttgcaaatctgcctgacacatcctgagctgcagaatgaaatttgctgtcagcttattaaacagacaagacgaagacagccacagaatcaaccaggaccattgcagggctggcagctcttggcactctgcgttgggctcttccttccccatcatcctttcctgtggctcctcaggcttcacctaaagaggaatgcagattccaggacagaatttggaaaatatgccatttactgccagcgttgtgtagaaagaacgcaacaaaatggtgacagagaagcaagaccctcaaggatggaaattctttcaactcttctccgaaacccttatcaccattctttgccctttagtatacctgtgcacttcatgaatgggatataccaggtagttggttttgacgcatctaccacagtggaagaatttttgaatactttgaaccaggacacaggaatgaggaaaccagcgcagtctggatttgcgttgttcactgacgatccttctggcagagatttagagcattgtcttcaaggaaacatcaagatttgtgacattatttccaaatgggaacaggcttccaaagaacagcagcctggaaaatgtgaaggtacaaggactgttcgtctgacatacaaaaacagactatatttctcagtgcaagctcgtggagagactgatagagaaaagttgctgttaatgtatcagacaaatgatcaaatcataaatggactttttcctctgaacaaagatctggcattagaaatggcagctcttttatctcaggtagagattggagattttgaaagacctttctcaactccagcagggcatgttaccaatcagtgcaaagtgaatcaaactctaaagcaagtcatagagaaattttatcctaaaaggtatagagatggctgttctgaagagcagttaaggcagctttgccagcgactttcaaccagatggatggccctccggggacacagtgctgctgactgtgtgcgcatttatttgacagtagccaggaagtggccattctttggtgccaagttgtttcttgcaaaacccataactccatcatcacttggaagtactttcttgtggctggctgtacatgaggatggtttaagcctcttagaatacaactccatgaggttaatagtcagctatgtgtacaagagtctaatgacctttggaggctatcaagatgattttatggtagtcattaacaatacacattcaaaggacaaaccaacagagaaattactttttgccatggcaaaacccaagattcttgaaatcactcttttgatcgccagttacataaacaacttccatcagcaaaaggcagcatttcaccacctctctgctccagcactgctctcagcccagacccggggaccccaagccagaatgatgggaagccagcctcttctgtcaagcagcagaccgaccaaaggccccaccttactctga

SEQ ID NO: 10387 - DNA, 577 bp, synthetic construct; identical to SEQ ID NO: 10248
  misc_feature 1..577: note = Synthetic polypeptide
  source 1..577: mol_type = other DNA

SEQ ID NO: 10388 - DNA, 916 bp, synthetic construct; identical to SEQ ID NO: 7516
  misc_feature 1..916: note = Synthetic polypeptide
  source 1..916: mol_type = other DNA

SEQ ID NO: 10389 - DNA, 157 bp, synthetic construct; identical to SEQ ID NO: 7517
  misc_feature 1..157: note = Synthetic polypeptide
  source 1..157: mol_type = other DNA

SEQ ID NO: 10390 - DNA, 424 bp, synthetic construct; identical to SEQ ID NO: 7518
  misc_feature 1..424: note = Synthetic polypeptide
  source 1..424: mol_type = other DNA

SEQ ID NO: 10391 - DNA, 675 bp, synthetic construct; identical to SEQ ID NO: 7519
  misc_feature 1..675: note = Synthetic polypeptide
  source 1..675: mol_type = other DNA

SEQ ID NO: 10392 - DNA, 282 bp, synthetic construct
  misc_feature 1..282: note = Synthetic polypeptide
  source 1..282: mol_type = other DNA
tgacatagtttggatatttgttttctctaaatctcatgttgaaatgtaatccacagagttggaggtagggcctggtggaagacatttggatcatacgggcaggtcccacacgaatgacttagcaccatccccttcgttatgagctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtgg

SEQ ID NO: 10393 - DNA, 592 bp, synthetic construct
  misc_feature 1..592: note = Synthetic polypeptide
  source 1..592: mol_type = other DNA
tgacatagtttggatatttgttttctctaaatctcatgttgaaatgtaatccacagagttggaggtagggcctggtggaagacatttggatcatacgggcaggtcccacacgaatgacttagcaccatccccttcgttatgagctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtggggatcgtgtggcagtggtgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgtgatgggtggctgaacttcaagaaactactaaaatataaagtcagacacagagacgttaaataa

SEQ ID NO: 10394 - DNA, 1699 bp, synthetic construct
  misc_feature 1..1699: note = Synthetic polypeptide
  source 1..1699: mol_type = other DNA
tgacatagtttggatatttgttttctctaaatctcatgttgaaatgtaatccacagagttggaggtagggcctggtggaagacatttggatcatacgggcaggtcccacacgaatgacttagcaccatccccttcgttatgagctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtggggatcgtgtggcagtggtgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgtgatgggtggctgaacttcaagaaactactaaatgaggcatccaccactcatcactgtgtggagactggaagccaggaagcatctgccatctacttcactagtgggaccagtggtcttcccaagatggcagaacattcctactcgagcctgggcctcaaggccaagatggatgctggttggacaggcctgcaagcctctgatataatgtggaccatatcagacacaggttggatactgaacatcttgtgctcacttatggaaccttgggcattaggagcatgcacatttgttcatctcttgccaaagtttgacccactggttattctaaagacactctccagttatccaatcaagagtatgatgggtgcccccattgtttaccggatgttgctacagcaggatctttccagttacaagttcccccatctacagaactgcgtcactgtaggggagtcccttcttccagaaactctggagaactggagggcccagacaggactggacatccgagaatcctatggccagacagaaacgggattaacttgcatggtttccaagacaatgaaaatcaaaccaggatacatgggaacggctgcttcctgttatgatgtacagatcatagatgataagggcaacgtcctgccccccggcacagaaggagacattggcatcagggtcaaacccatcaggcctataggcatcttctctggctatgtggacaatcccgacaagacagcagccaacattcgaggagacttttggctccttggagaccggggaatcaaagatgaagatgggtatttccagtttatgggacgggcaaatgatatcattaactccagcgggtaccggattggaccctcggaggtagagaatgcactgatggagcaccctgctgtggttgagacggctgtgatcagcagcccagaccccgtccgaggagaggtggtgaaggcatttgtggtcctggcctcgcagttcctgtcccatgacccagaacagctcaccaaggagctgcagcagcatgtgaagtcagtgacagccccatacaagtacccaagaaagatagagtttgtcttgaacctgcccaagactgtcacagggaaaattcaacgagccaagcttcgagacaaggagtggaagatgtccggaaaagcccgtgcgcagtga

SEQ ID NO: 10395 - DNA, 319 bp, synthetic construct
  misc_feature 1..319: note = Synthetic polypeptide
  source 1..319: mol_type = other DNA
tgacatagtttggatatttgttttctctaaatctcatgttgaaatgtaatccacagagttggaggtagggcctggtggaagacatttggatcatacgggcaggtcccacacgaatgacttagcaccatccccttcgttatgagctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtggggatcgtgtggcagtggtgctgccccgagtgcctgag

SEQ ID NO: 10396 - DNA, 942 bp, synthetic construct
  misc_feature 1..942: note = Synthetic polypeptide
  source 1..942: mol_type = other DNA
ccaaagcattgcctggtctatagtgggaaatcggtaaatggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaa

SEQ ID NO: 10397 - DNA, 390 bp, synthetic construct
  misc_feature 1..390: note = Synthetic polypeptide
  source 1..390: mol_type = other DNA
ccaaagcattgcctggtctatagtgggaaatcggtaaatggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctga

SEQ ID NO: 10398 - DNA, 206 bp, synthetic construct
  misc_feature 1..206: note = Synthetic polypeptide
  source 1..206: mol_type = other DNA
ccaaagcattgcctggtctatagtgggaaatcggtaaatggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaa

SEQ ID NO: 10399 - DNA, 483 bp, synthetic construct
  misc_feature 1..483: note = Synthetic polypeptide
  source 1..483: mol_type = other DNA
ccaaagcattgcctggtctatagtgggaaatcggtaaatggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaagatctttgataccatactttaatctgtatcttcagtttctgaacataagtatgcaaaatctttttaaggtgcatactctgctgcgtccctgctattttctaggacaaaaataa

SEQ ID NO: 10400 - DNA, 978 bp, synthetic construct
  misc_feature 1..978: note = Synthetic polypeptide
  source 1..978: mol_type = other DNA
ccaaagcattgcctggtctatagtgggaaatcggtaaatggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggctggtagcaagttctggatcttatacccaacacacagcaacatccagaaataa

SEQ ID NO: 10401 - DNA, 897 bp, synthetic construct
  misc_feature 1..897: note = Synthetic polypeptide
  source 1..897: mol_type = other DNA
ccaaagcattgcctggtctatagtgggaaatcggtaaatggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatgaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaa

SEQ ID NO: 10402 - DNA, 660 bp, synthetic construct
  misc_feature 1..660: note = Synthetic polypeptide
  source 1..660: mol_type = other DNA
ccaaagcattgcctggtctatagtgggaaatcggtaaatggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggtctgggagaactgatcttgctgaaaatacaacaggaagcagtatcgtgccaggcaaggcaaaccctcgtcagtgtgaagcaatggccatcgttgcagcccaagtcatggggttttgtgtggcagtaa

SEQ ID NO: 10403 - DNA, 576 bp, synthetic construct
  misc_feature 1..576: note = Synthetic polypeptide
  source 1..576: mol_type = other DNA
ccaaagcattgcctggtctatagtgggaaatcggtaaatggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggctgctgggggatgcttcagtttccttcacagaaaactaaatag

SEQ ID NO: 10404 - DNA, 639 bp, synthetic construct
  misc_feature 1..639: note = Synthetic polypeptide
  source 1..639: mol_type = other DNA
ccaaagcattgcctggtctatagtgggaaatcggtaaatggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggtctgggagaactgatcttgctgaaaatacaacaggaagcagtatcgtgccaggcaaggcaaaccctcgtcagtgtgaagcaatggccatcgttgcagcccaagtcatggggttttgtgtggcagtaaccgttggaggcggcaatggccattttgagttggatgttttcaagccaatgatgattaaaaatttatgttacactcaggctgctgggggatgcttcagtttccttcacagaaaactaaatagtgggaatccggaccaataa

SEQ ID NO: 10405 - DNA, 706 bp, synthetic construct; identical to SEQ ID NO: 10181
  misc_feature 1..706: note = Synthetic polypeptide
  source 1..706: mol_type = other DNA

SEQ ID NO: 10406 - DNA, 386 bp, synthetic construct; identical to SEQ ID NO: 10182
  misc_feature 1..386: note = Synthetic polypeptide
  source 1..386: mol_type = other DNA

SEQ ID NO: 10407 - DNA, 75 bp, synthetic construct; identical to SEQ ID NO: 10183
  misc_feature 1..75: note = Synthetic polypeptide
  source 1..75: mol_type = other DNA

SEQ ID NO: 10408 - DNA, 1911 bp, synthetic construct; identical to SEQ ID NO: 10254
  misc_feature 1..1911: note = Synthetic polypeptide
  source 1..1911: mol_type = other DNA

SEQ ID NO: 10409 - DNA, 804 bp, synthetic construct; identical to SEQ ID NO: 10255
  misc_feature 1..804: note = Synthetic polypeptide
  source 1..804: mol_type = other DNA

SEQ ID NO: 10410 - DNA, 531 bp, synthetic construct; identical to SEQ ID NO: 10256
  misc_feature 1..531: note = Synthetic polypeptide
  source 1..531: mol_type = other DNA

SEQ ID NO: 10411 - DNA, 494 bp, synthetic construct; identical to SEQ ID NO: 10257
  misc_feature 1..494: note = Synthetic polypeptide
  source 1..494: mol_type = other DNA

SEQ ID NO: 10412 - DNA, 1691 bp, synthetic construct; identical to SEQ ID NO: 7480
  misc_feature 1..1691: note = Synthetic polypeptide
  source 1..1691: mol_type = other DNA

SEQ ID NO: 10413 - DNA, 1727 bp, synthetic construct; identical to SEQ ID NO: 7481
  misc_feature 1..1727: note = Synthetic polypeptide
  source 1..1727: mol_type = other DNA

SEQ ID NO: 10414 - DNA, 629 bp, synthetic construct; identical to SEQ ID NO: 7482
  misc_feature 1..629: note = Synthetic polypeptide
  source 1..629: mol_type = other DNA

SEQ ID NO: 10415 - DNA, 1553 bp, synthetic construct; identical to SEQ ID NO: 7483
  misc_feature 1..1553: note = Synthetic polypeptide
  source 1..1553: mol_type = other DNA

SEQ ID NO: 10416 - DNA, 164 bp, synthetic construct; identical to SEQ ID NO: 831
  misc_feature 1..164: note = Synthetic polypeptide
  source 1..164: mol_type = other DNA

SEQ ID NO: 10417 - DNA, 193 bp, synthetic construct; identical to SEQ ID NO: 834
  misc_feature 1..193: note = Synthetic polypeptide
  source 1..193: mol_type = other DNA

SEQ ID NO: 10418 - DNA, 2287 bp, synthetic construct; identical to SEQ ID NO: 6799
  misc_feature 1..2287: note = Synthetic polypeptide
  source 1..2287: mol_type = other DNA

SEQ ID NO: 10419 - DNA, 2234 bp, synthetic construct; identical to SEQ ID NO: 6800
  misc_feature 1..2234: note = Synthetic polypeptide
  source 1..2234: mol_type = other DNA

SEQ ID NO: 10420 - DNA, 1195 bp, synthetic construct; identical to SEQ ID NO: 10074
  misc_feature 1..1195: note = Synthetic polypeptide
  source 1..1195: mol_type = other DNA

SEQ ID NO: 10421 - DNA, 553 bp, synthetic construct; identical to SEQ ID NO: 10075
  misc_feature 1..553: note = Synthetic polypeptide
  source 1..553: mol_type = other DNA

SEQ ID NO: 10422 - DNA, 1052 bp, synthetic construct; identical to SEQ ID NO: 447
  misc_feature 1..1052: note = Synthetic polypeptide
  source 1..1052: mol_type = other DNA

SEQ ID NO: 10423 - DNA, 1118 bp, synthetic construct; identical to SEQ ID NO: 448
  misc_feature 1..1118: note = Synthetic polypeptide
  source 1..1118: mol_type = other DNA

SEQ ID NO: 10424 - DNA, 2056 bp, synthetic construct; identical to SEQ ID NO: 522
  misc_feature 1..2056: note = Synthetic polypeptide
  source 1..2056: mol_type = other DNA

SEQ ID NO: 10425 - DNA, 2098 bp, synthetic construct; identical to SEQ ID NO: 523
  misc_feature 1..2098: note = Synthetic polypeptide
  source 1..2098: mol_type = other DNA

SEQ ID NO: 10426 - DNA, 372 bp, synthetic construct; identical to SEQ ID NO: 521
  misc_feature 1..372: note = Synthetic polypeptide
  source 1..372: mol_type = other DNA

SEQ ID NO: 10427 - DNA, 1269 bp, synthetic construct; identical to SEQ ID NO: 616
  misc_feature 1..1269: note = Synthetic polypeptide
  source 1..1269: mol_type = other DNA

SEQ ID NO: 10428 - DNA, 1134 bp, synthetic construct; identical to SEQ ID NO: 617
  misc_feature 1..1134: note = Synthetic polypeptide
  source 1..1134: mol_type = other DNA

SEQ ID NO: 10429 - DNA, 501 bp, synthetic construct; identical to SEQ ID NO: 618
  misc_feature 1..501: note = Synthetic polypeptide
  source 1..501: mol_type = other DNA

SEQ ID NO: 10430 - DNA, 1321 bp, synthetic construct; identical to SEQ ID NO: 619
  misc_feature 1..1321: note = Synthetic polypeptide
  source 1..1321: mol_type = other DNA

SEQ ID NO: 10431 - DNA, 1197 bp, synthetic construct; identical to SEQ ID NO: 620
  misc_feature 1..1197: note = Synthetic polypeptide
  source 1..1197: mol_type = other DNA

SEQ ID NO: 10432 - DNA, 1203 bp, synthetic construct; identical to SEQ ID NO: 621
  misc_feature 1..1203: note = Synthetic polypeptide
  source 1..1203: mol_type = other DNA

SEQ ID NO: 10433 - DNA, 1131 bp, synthetic construct; identical to SEQ ID NO: 622
  misc_feature 1..1131: note = Synthetic polypeptide
  source 1..1131: mol_type = other DNA

SEQ ID NO: 10434 - DNA, 642 bp, synthetic construct; identical to SEQ ID NO: 623
  misc_feature 1..642: note = Synthetic polypeptide
  source 1..642: mol_type = other DNA

SEQ ID NO: 10435 - DNA, 977 bp, synthetic construct
  misc_feature 1..977: note = Synthetic polypeptide
  source 1..977: mol_type = other DNA
tacaggacagtggttaactaggaggatacattccaggcctggcccaaatgcctgatccatccctctccagctttgtcacctttggcaaggtgctgtttgccctgaaccaaaccctgctgcagcaggagagtgtgcgggccgggagcctgcaggcctcctacaccacggaggacctcatcaagcactacaactgcggagacctcagcgcagtcatcttcaaccacgacacatcccagctgcccaactttatcaacaccaccctcccgccacacgagcaggtgacggcccaggagattgacagctacttccgccaggagctcatctacaagaggaatgagcgcatggggaagagggtcatggcgcttctacgggagaacgaggacaagatctgcttctttgccttcggagcaggtcactttctggggaacaacacagtcatcgacatcctgcggcaggcagggctggaggtggaccacacacccgccgggcaggccatacacagccctgccccccagagcccagcgccctctcctgaggggacctcgacgagcccggccccagtgaccccagctgccgctgtccccgaagcaccctctgtgacccccaccgccccaccagaggatgaggatccagccctgtccccacacctcctgctccccgacagcctcagccagctggaggagtttggccggcagaggaagtggcacaagaggcagagcacacaccagcggccgcggcagttcaatgacctctgggtccgcatcgaggacagcaccaccgcctcaccacccccgctgcccctgcagcccacccacagctcggggaccgccaagccccccttccagctttcagaccagctacaacagcaggacccgccagggcccgccagcagctcggcacccaccctgggccttctccccgccatcgccaccaccatcgctgtctgcttcctgctgcatagccttgggccctcctga

SEQ ID NO: 10436 - DNA, 1211 bp, synthetic construct; identical to SEQ ID NO: 10032
  misc_feature 1..1211: note = Synthetic polypeptide
  source 1..1211: mol_type = other DNA

SEQ ID NO: 10437 - DNA, 1100 bp, synthetic construct; identical to SEQ ID NO: 10033
  misc_feature 1..1100: note = Synthetic polypeptide
  source 1..1100: mol_type = other DNA

SEQ ID NO: 10438 - DNA, 674 bp, synthetic construct; identical to SEQ ID NO: 10034
  misc_feature 1..674: note = Synthetic polypeptide
  source 1..674: mol_type = other DNA

SEQ ID NO: 10439 - DNA, 2046 bp, synthetic construct; identical to SEQ ID NO: 9948
  misc_feature 1..2046: note = Synthetic polypeptide
  source 1..2046: mol_type = other DNA

SEQ ID NO: 10440 - DNA, 1372 bp, synthetic construct
  misc_feature 1..1372: note = Synthetic polypeptide
  source 1..1372: mol_type = other DNA
gtaatgggcagtaacatggaagatgggaatatgctacaacccatcgtttcttgtaaagaagcatctgctgcagctttgcaccaagagactcaggctcgacaacctggtgtttcatccagaagagccagaggtgcttgctgtccttgactgggaactttctaccttgggcgacccccttgctgatgtggcctacagctgcctggctcattacctgccatccagttttcccgtgctgagaggtattaatgactgtgacttgacacagctgggaatccctgctgcagaggagtatttcaggatgtactgtctccaaatggggctccctcccactgagaactggaacttctatatggctttttcctttttccgtgtggctgcaatcctacagggagtctacaagcgatcactcacagggcaagcaagctccacatatgcggaacaaactggaaagctgaccgaatttgtgtctaacctggcgtgggatttcgcagtcaaagaagggttccgggttttcaaagagatgcccttcacaaatccgttaacaaggtcctaccacacgtgggccaggccccagtcccagtggtgccccacaggcagcaggagttatagctccgttccagaagcttccccagctcatacctcaaggggaggtctggttatctctccagagagcctctctccacctgtcagagagctgtatcaccggctgaagcacttcatggagcaacgtgtgtaccctgcagagccagagctgcagagtcaccaggcctcagcagccaggtggagcccctccccactgatcgaagacctcaaggagaaagccaaagctgaaggactttggaaccttttcctacccttagaggctgatcccgagaaaaaatacggagcaggactgaccaatgtggaatatgcacatctgtgtgagctcatgggcacgtccctgtatgcccccgaggtatgtaactgctctgcgcctgacacgggcaacatggagctgctggtgaggtatggcaccgaagcgcagaaggctcgctggctgattcctctgctggaggggaaagcccgctcctgttttgctatgaccgagccccaggttgcctcttcagatgccaccaacattgaggcttccatcagagaggaggacagcttctatgtcataaacggtcacaaatggtggatcacaggcatcctggatcctcgttgccaactctgtgtgtttatgggaaaaacagacccacatgcaccaagacaccggcagcagtctgtgctcttggttcccatggataccccagggataaaaatcatccggcctctgacggtgtatggactggaagatgcaccaggctgtttcctgccgtccttttccctttaa

SEQ ID NO: 10441 - DNA, 832 bp, synthetic construct
  misc_feature 1..832: note = Synthetic polypeptide
  source 1..832: mol_type = other DNA
gtaatgggcagtaacatggaagatgggaatatgctacaacccatcgtttcttgtaaagaagcatctgctgcagctttgcaccaagagactcaggctcgacaacctggtgtttcatccagaagagccagaggtgcttgctgtccttgactgggaactttctaccttgggcgacccccttgctgatgtggcctacagctgcctggctcattacctgccatccagttttcccgtgctgagaggtattaatgactgtgacttgacacagctgggaatccctgctgcagaggagtatttcaggatgtactgtctccaaatggggctccctcccactgagaactggaacttctatatggctttttcctttttccgtgtggctgcaatcctacagggagtctacaagcgatcactcacagggcaagcaagctccacatatgcggaacaaactggaaagctgaccgaatttgtgtctaacctggcgtgggatttcgcagtcaaagaagggttccgggttttcaaagagatgcccttcacaaatccgttaacaaggtcctaccacacgtgggccaggccccagtcccagtggtgccccacaggcagcaggagttatagctccgttccagaagcttccccagctcatacctcaaggggaggtctggttatctctccagagagcctctctccacctgtcagagagctgtatcaccggctgaagcacttcatggagcaacgtgtgtaccctgcagagccagagctgcagagtcaccaggcctcagcagccaggtggagcccctccccactgatcgaagacctcaaggtaaagcagccatggtga

SEQ ID NO: 10442 - DNA, 1879 bp, synthetic construct
  misc_feature 1..1879: note = Synthetic polypeptide
  source 1..1879: mol_type = other DNA
gtaatgggcagtaacatggaagatgggaatatgctacaacccatcgtttcttgtaaagaagcatctgctgcagctttgcaccaagagactcaggctcgacaacctggtgtttcatccagaagagccagaggtgcttgctgtccttgactgggaactttctaccttgggcgacccccttgctgatgtggcctacagctgcctggctcattacctgccatccagttttcccgtgctgagaggtattaatgactgtgacttgacacagctgggaatccctgctgcagaggagtatttcaggatgtactgtctccaaatggggctccctcccactgagaactggaacttctatatggctttttcctttttccgtgtggctgcaatcctacagggagtctacaagcgatcactcacagggcaagcaagctccacatatgcggaacaaactggaaagctgaccgaatttgtgtctaacctggcgtgggatttcgcagtcaaagaagggttccgggttttcaaagagatgcccttcacaaatccgttaacaaggtcctaccacacgtgggccaggccccagtcccagtggtgccccacaggcagcaggagttatagctccgttccagaagcttccccagctcatacctcaaggggaggtctggttatctctccagagagcctctctccacctgtcagagagctgtatcaccggctgaagcacttcatggagcaacgtgtgtaccctgcagagccagagctgcagagtcaccaggcctcagcagccaggtggagcccctccccactgatcgaagacctcaaggagaaagccaaagctgaaggactttggaaccttttcctacccttagaggctgatcccgagaaaaaatacggagcaggactgaccaatgtggaatatgcacatctgtgtgagctcatgggcacgtccctgtatgcccccgaggtatgtaactgctctgcgcctgacacgggcaacatggagctgctggtgaggtatggcaccgaagcgcagaaggctcgctggctgattcctctgctggaggggaaagcccgctcctgttttgctatgaccgagccccaggttgcctcttcagatgccaccaacattgaggcttccatcagagaggaggacagcttctatgtcataaacggtcacaaatggtggatcacaggcatcctggatcctcgttgccaactctgtgtgtttatgggaaaaacagacccacatgcaccaagacaccggcagcagtctgtgctcttggttcccatggataccccagggataaaaatcatccggcctctgacggtgtatggactggaagatgcaccaggtggccatggtgaagtccgatttgagcacgtgcgtgtgcccaaagagaacatggtcctgggccctggccgaggctttgagatcgcccagggcagactgggccccggcaggatccatcactgcatgaggctgatcgggttctcagagagggccctggcactcatgaaggcccgcgtgaagtcccgcttggcttttgggaagcccctggtggagcagggcacagtgctggcggacatcgcgcagtcgcgcgtggagattgagcaggcacggctgctggtgctgagagctgcccacctcatggacctggcaggaaacaaggctgcagccttggatatagccatgattaaaatggtcgccccgtccatggcctcccgagtgattgatcgtgcgattcaggcctttggagcagcaggcctgagcagcgactacccactggctcagttcttcacctgggcccgagccctgcgctttgccgacggccctgacgaggtgcaccgggccacggtggccaagctagagctgaagcaccgcatttag

SEQ ID NO: 10443 - DNA, 218 bp, synthetic construct
  misc_feature 1..218: note = Synthetic polypeptide
  source 1..218: mol_type = other DNA
gtaatgggcagtaacatggaagatgggaatatgctacaacccatcgtttcttgtaaagaagcatctgctgcagctttgcaccaagagactcaggctcgacaacctggtgtttcatccagaagagccagaggtgcttgctgtccttgactgggaactttctaccttgggcgacccccttgctgatgtggcctacagctgcctggctcattacctgccat

SEQ ID NO: 10444 - DNA, 451 bp, synthetic construct
  misc_feature 1..451: note = Synthetic polypeptide
  source 1..451: mol_type = other DNA
actggaaggcagaagccacgcagacttctagtcctggttccactgcttactcggccacggccacccagaggccaactccaatgagaagcatccatcccagcaggacacgcggcctgctgaacagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaat

SEQ ID NO: 10445 - DNA, 513 bp, synthetic construct
  misc_feature 1..513: note = Synthetic polypeptide
  source 1..513: mol_type = other DNA
actggaaggcagaagccacgcagacttctagtcctggttccactgcttactcggccacggccacccagaggccaactccaatgagaagcatccatcccagcaggacacgcggcctgctgaacagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaag

SEQ ID NO: 10446 - DNA, 289 bp, synthetic construct
  misc_feature 1..289: note = Synthetic polypeptide
  source 1..289: mol_type = other DNA
actggaaggcagaagccacgcagacttctagtcctggttccactgcttactcggccacggccacccagaggccaactccaatgagaagcatccatcccagcaggacacgcggcctgctgaacagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggag

SEQ ID NO: 10447 - DNA, 124 bp, synthetic construct
  misc_feature 1..124: note = Synthetic polypeptide
  source 1..124: mol_type = other DNA
actggaaggcagaagccacgcagacttctagtcctggttccactgcttactcggccacggccacccagaggccaactccaatgagaagcatccatcccagcaggacacgcggcctgctgaacag

SEQ ID NO: 10448 - DNA, 2593 bp, synthetic construct
  misc_feature 1..2593: note = Synthetic polypeptide
  source 1..2593: mol_type = other DNA
actggaaggcagaagccacgcagacttctagtcctggttccactgcttactcggccacggccacccagaggccaactccaatgagaagcatccatcccagcaggacacgcggcctgctgaacagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagccggagcaggaaaccacgccgagacacaagcaggagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccagcaggttgatgggagtgcctcagtggggagggagttcatagcaaccactccctccatcaccacggagaccatatcgaccaccatggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctga

SEQ ID NO: 10449 - DNA, 2590 bp, synthetic construct
  misc_feature 1..2590: note = Synthetic polypeptide
  source 1..2590: mol_type = other DNA
actggaaggcagaagccacgcagacttctagtcctggttccactgcttactcggccacggccacccagaggccaactccaatgagaagcatccatcccagcaggacacgcggcctgctgaacagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagccggagcaggaaaccacgccgagacacaagcaggagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccaggttgatgggagtgcctcagtggggagggagttcatagcaaccactccctccatcaccacggagaccatatcgaccaccatggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctga

SEQ ID NO: 10450 - DNA, 524 bp, synthetic construct
  misc_feature 1..524: note = Synthetic polypeptide
  source 1..524: mol_type = other DNA
gccaggtgcagcagtgtgtgcctgtagtcccagccacttgggaggtggagattgagtctgaaacagcagcttctgaggaaaccttgttcaacgcgtcccagcgcatcagcgagttagagaggaatgtggaagaacttaagcggaaagctgcccaaaactccggggaggcagaatatattgaaaaagtagtatatactgtgaagcaaagtgcagaagatgttaagaagactttagatggtgaacttgatgaaaagtataaaaaagtagaaaatttaattgccaaaaaaactgaagagtcagctgatgccagaaggaaagccgaaatgctacaaaatgaagcaaaaactcttttagctcaagcaaatagcaagctgcaactgctcaaagatttagaaagaaaatatgaagacaatcaaagatacttagaagataaagctcaagaattagcaagactggaaggagaagtccgttcactcctaaaggatataagccagaaagttgctgtgtatagcacatgcttgtaa

SEQ ID NO: 10451 - DNA, 1319 bp, synthetic construct; identical to SEQ ID NO: 10058
  misc_feature 1..1319: note = Synthetic polypeptide
  source 1..1319: mol_type = other DNA

SEQ ID NO: 10452 - DNA, 1193 bp, synthetic construct; identical to SEQ ID NO: 10059
  misc_feature 1..1193: note = Synthetic polypeptide
  source 1..1193: mol_type = other DNA

SEQ ID NO: 10453 - DNA, 473 bp, synthetic construct; identical to SEQ ID NO: 10060
  misc_feature 1..473: note = Synthetic polypeptide
  source 1..473: mol_type = other DNA

SEQ ID NO: 10454 - DNA, 302 bp, synthetic construct; identical to SEQ ID NO: 10061
  misc_feature 1..302: note = Synthetic polypeptide
  source 1..302: mol_type = other DNA

SEQ ID NO: 10455 - DNA, 588 bp, synthetic construct; identical to SEQ ID NO: 8704
  misc_feature 1..588: note = Synthetic polypeptide
  source 1..588: mol_type = other DNA

SEQ ID NO: 10456 - DNA, 585 bp, synthetic construct; identical to SEQ ID NO: 8705
  misc_feature 1..585: note = Synthetic polypeptide
  source 1..585: mol_type = other DNA

SEQ ID NO: 10457 - DNA, 606 bp, synthetic construct; identical to SEQ ID NO: 8706
  misc_feature 1..606: note = Synthetic polypeptide
  source 1..606: mol_type = other DNA

SEQ ID NO: 10458 - DNA, 384 bp, synthetic construct; identical to SEQ ID NO: 8707
  misc_feature 1..384: note = Synthetic polypeptide
  source 1..384: mol_type = other DNA

SEQ ID NO: 10459 - DNA, 193 bp, synthetic construct; identical to SEQ ID NO: 8708
  misc_feature 1..193: note = Synthetic polypeptide
  source 1..193: mol_type = other DNA

SEQ ID NO: 10460 - DNA, 170 bp, synthetic construct; identical to SEQ ID NO: 8709
  misc_feature 1..170: note = Synthetic polypeptide
  source 1..170: mol_type = other DNA

SEQ ID NO: 10461 - DNA, 193 bp, synthetic construct; identical to SEQ ID NO: 7535
  misc_feature 1..193: note = Synthetic polypeptide
  source 1..193: mol_type = other DNA

SEQ ID NO: 10462 - DNA, 1066 bp, synthetic construct; identical to SEQ ID NO: 7536
  misc_feature 1..1066: note = Synthetic polypeptide
  source 1..1066: mol_type = other DNA

SEQ ID NO: 10463 - DNA, 1063 bp, synthetic construct; identical to SEQ ID NO: 7537
  misc_feature 1..1063: note = Synthetic polypeptide
  source 1..1063: mol_type = other DNA

SEQ ID NO: 10464 - DNA, 404 bp, synthetic construct; identical to SEQ ID NO: 7538
  misc_feature 1..404: note = Synthetic polypeptide
  source 1..404: mol_type = other DNA

SEQ ID NO: 10465 - DNA, 925 bp, synthetic construct; identical to SEQ ID NO: 7539
  misc_feature 1..925: note = Synthetic polypeptide
  source 1..925: mol_type = other DNA

SEQ ID NO: 10466 - DNA, 1093 bp, synthetic construct; identical to SEQ ID NO: 7540
  misc_feature 1..1093: note = Synthetic polypeptide
  source 1..1093: mol_type = other DNA

SEQ ID NO: 10467 - DNA, 261 bp, synthetic construct; identical to SEQ ID NO: 8717
  misc_feature 1..261: note = Synthetic polypeptide
  source 1..261: mol_type = other DNA

SEQ ID NO: 10468 - DNA, 233 bp, synthetic construct; identical to SEQ ID NO: 8718
  misc_feature 1..233: note = Synthetic polypeptide
  source 1..233: mol_type = other DNA

SEQ ID NO: 10469 - DNA, 168 bp, synthetic construct; identical to SEQ ID NO: 8710
  misc_feature 1..168: note = Synthetic polypeptide
  source 1..168: mol_type = other DNA

SEQ ID NO: 10470 - DNA, 1290 bp, synthetic construct; identical to SEQ ID NO: 6392
  misc_feature 1..1290: note = Synthetic polypeptide
  source 1..1290: mol_type = other DNA

SEQ ID NO: 10471 - DNA, 1130 bp, synthetic construct; identical to SEQ ID NO: 8820
  misc_feature 1..1130: note = Synthetic polypeptide
  source 1..1130: mol_type = other DNA

SEQ ID NO: 10472 - DNA, 1280 bp, synthetic construct; identical to SEQ ID NO: 8821
  misc_feature 1..1280: note = Synthetic polypeptide
  source 1..1280: mol_type = other DNA

SEQ ID NO: 10473 - DNA, 1277 bp, synthetic construct; identical to SEQ ID NO: 8822
  misc_feature 1..1277: note = Synthetic polypeptide
  source 1..1277: mol_type = other DNA

SEQ ID NO: 10474 - DNA, 900 bp, synthetic construct; identical to SEQ ID NO: 8926
  misc_feature 1..900: note = Synthetic polypeptide
  source 1..900: mol_type = other DNA

SEQ ID NO: 10475 - DNA, 831 bp, synthetic construct; identical to SEQ ID NO: 8927
  misc_feature 1..831: note = Synthetic polypeptide
  source 1..831: mol_type = other DNA

SEQ ID NO: 10476 - DNA, 354 bp, synthetic construct; identical to SEQ ID NO: 8928
  misc_feature 1..354: note = Synthetic polypeptide
  source 1..354: mol_type = other DNA

SEQ ID NO: 10477 - DNA, 175 bp, synthetic construct; identical to SEQ ID NO: 8766
  misc_feature 1..175: note = Synthetic polypeptide
  source 1..175: mol_type = other DNA

SEQ ID NO: 10478 - DNA, 214 bp, synthetic construct; identical to SEQ ID NO: 8767
  misc_feature 1..214: note = Synthetic polypeptide
  source 1..214: mol_type = other DNA

SEQ ID NO: 10479 - DNA, 1227 bp, synthetic construct
  misc_feature 1..1227: note = Synthetic polypeptide
  source 1..1227: mol_type = other DNA
tggttctcatccagaatgttcgtggcatcagagagaaagatgagagctcaccaggtgctcaccttcctcctgctcttcgtgatcacctcggtggcctctgaaaacgccagcacatcccgaggctgtgggctggacctcctccctcagtacgtgtccctgtgcgacctggacgccatctggggcattgtggtggaggcggtggccggggcgggcgccctgatcacactgctcctgatgctcatcctcctggtgcggctgcccttcatcaaggagaaggagaagaagagccctgtgggcctccactttctgttcctcctggggaccctgggcctctttgggctgacgtttgccttcatcatccaggaggacgagaccatctgctctgtccgccgcttcctctggggcgtcctctttgcgctctgcttctcctgcctgctgagccaggcatggcgcgtgcggaggctggtgcggcatggcacgggccccgcgggctggcagctggtgggcctggcgctgtgcctgatgctggtgcaagtcatcatcgctgtggagtggctggtgctcaccgtgctgcgtgacacaaggccagcctgcgcctacgagcccatggactttgtgatggccctcatctacgacatggtactgcttgtggtcaccctggggctggccctcttcactctgtgcggcaagttcaagaggtggaagctgaacggggccttcctcctcatcacagccttcctctctgtgctcatctgggtggcctggatgaccatgtacctcttcggcaatgtcaagctgcagcagggggatgcctggaacgaccccaccttggccatcacgctggcggccagcggctgggtcttcgtcatcttccacgccatccctgagatccactgcacccttctgccagccctgcaggagaacacgcccaactacttcgacacgtcgcagcccaggatgcgggagacggccttcgaggaggacgtgcagctgccgcgggcctatatggagaacaaggccttctccatggatgaacacaatgcagctctccgaacagcaggatttcccaacggcagcttgggaaaaagacccagtggcagcttggggaaaagacccagcgctccgtttagaagcaacgtgtatcagccaactgagatggccgtcgtgctcaacggtgggaccatcccaactgctccgccaagtcacacaggaagacacctttggtga

SEQ ID NO: 10480 - DNA, 348 bp, synthetic construct; identical to SEQ ID NO: 6363
  misc_feature 1..348: note = Synthetic polypeptide
  source 1..348: mol_type = other DNA

SEQ ID NO: 10481 - DNA, 932 bp, synthetic construct; identical to SEQ ID NO: 8873
  misc_feature 1..932: note = Synthetic polypeptide
  source 1..932: mol_type = other DNA

SEQ ID NO: 10482 - DNA, 863 bp, synthetic construct; identical to SEQ ID NO: 8874
  misc_feature 1..863: note = Synthetic polypeptide
  source 1..863: mol_type = other DNA

SEQ ID NO: 10483 - DNA, 386 bp, synthetic construct; identical to SEQ ID NO: 8875
  misc_feature 1..386: note = Synthetic polypeptide
  source 1..386: mol_type = other DNA

SEQ ID NO: 10484 - DNA, 560 bp, synthetic construct; identical to SEQ ID NO: 6322
  misc_feature 1..560: note = Synthetic polypeptide
  source 1..560: mol_type = other DNA

SEQ ID NO: 10485 - DNA, 181 bp, synthetic construct
  misc_feature 1..181: note = Synthetic polypeptide
  source 1..181: mol_type = other DNA
caatacagtgtccccagcacggtgcctggcacaggcagggaaggaccccacgccctccatgctgggcctctgcggctccctggcctccattcccagctgcaagtccctggcgagcttcaaatccaacgagtgcctggtgagcgacagtcccgagggcagcccagcactgagccccagctga

SEQ ID NO: 10486 - DNA, 3311 bp, synthetic construct; identical to SEQ ID NO: 8841
  misc_feature 1..3311: note = Synthetic polypeptide
  source 1..3311: mol_type = other DNA

SEQ ID NO: 10487 - DNA, 1586 bp, synthetic construct; identical to SEQ ID NO: 8842
  misc_feature 1..1586: note = Synthetic polypeptide
  source 1..1586: mol_type = other DNA

SEQ ID NO: 10488 - DNA, 3044 bp, synthetic construct; identical to SEQ ID NO: 8843
  misc_feature 1..3044: note = Synthetic polypeptide
  source 1..3044: mol_type = other DNA

SEQ ID NO: 10489 - DNA, 1740 bp, synthetic construct; identical to SEQ ID NO: 8844
  misc_feature 1..1740: note = Synthetic polypeptide
  source 1..1740: mol_type = other DNA

SEQ ID NO: 10490 - DNA, 1708 bp, synthetic construct; identical to SEQ ID NO: 8845
  misc_feature 1..1708: note = Synthetic polypeptide
  source 1..1708: mol_type = other DNA

SEQ ID NO: 10491 - DNA, 1597 bp, synthetic construct; identical to SEQ ID NO: 8846
  misc_feature 1..1597: note = Synthetic polypeptide
  source 1..1597: mol_type = other DNA

SEQ ID NO: 10492 - DNA, 1571 bp, synthetic construct; identical to SEQ ID NO: 8847
  misc_feature 1..1571: note = Synthetic polypeptide
  source 1..1571: mol_type = other DNA

SEQ ID NO: 10493 - DNA, 1562 bp, synthetic construct; identical to SEQ ID NO: 8848
  misc_feature 1..1562: note = Synthetic polypeptide
  source 1..1562: mol_type = other DNA

SEQ ID NO: 10494 - DNA, 1518 bp, synthetic construct; identical to SEQ ID NO: 8849
  misc_feature 1..1518: note = Synthetic polypeptide
  source 1..1518: mol_type = other DNA

SEQ ID NO: 10495 - DNA, 1451 bp, synthetic construct; identical to SEQ ID NO: 8850
  misc_feature 1..1451: note = Synthetic polypeptide
  source 1..1451: mol_type = other DNA

SEQ ID NO: 10496 - DNA, 29 bp, synthetic construct
  misc_feature 1..29: note = Synthetic polypeptide
  source 1..29: mol_type = other DNA
agaccctgagcctaggaaccacagaataa

SEQ ID NO: 10497 - DNA, 546 bp, synthetic construct; identical to SEQ ID NO: 8836
  misc_feature 1..546: note = Synthetic polypeptide
  source 1..546: mol_type = other DNA

SEQ ID NO: 10498 - DNA, 1293 bp, synthetic construct; identical to SEQ ID NO: 8745
  misc_feature 1..1293: note = Synthetic polypeptide
  source 1..1293: mol_type = other DNA

SEQ ID NO: 10499 - DNA, 471 bp, synthetic construct
  misc_feature 1..471: note = Synthetic polypeptide
  source 1..471: mol_type = other DNA
ggagccaagatggctgaataggaacagctccggtctacagctcccagcatcagcgatgcagaagatgggtgatttctgcatttccatctgagtttcccagagctatggggacttcccatccggcgttcctggtcttaggctgtcttctcacagggctgagcctaatcctctgccagctttcattaccctctatccttccaaatgaaaatgaaaaggttgtgcagctgaattcatccttttctctgagatgctttggggagagtgaagtgagctggcagtaccccatgtctgaagaagagagctccgatgtggaaatcagaaatgaagaaaacaacagcggcctttttgtgacggtcttggaagtgagcagtgcctcggcggcccacacagggttgtacacttgctattacaaccacactcagacagaagagaatgagcttgaaggcaggcacatttacatctatgtgccag

SEQ ID NO: 10500 - DNA, 395 bp, synthetic construct
  misc_feature 1..395: note = Synthetic polypeptide
  source 1..395: mol_type = other DNA
gggggaccagggggagtttcccagagctatggggacttcccatccggcgttcctggtcttaggctgtcttctcacagggctgagcctaatcctctgccagctttcattaccctctatccttccaaatgaaaatgaaaaggttgtgcagctgaattcatccttttctctgagatgctttggggagagtgaagtgagctggcagtaccccatgtctgaagaagagagctccgatgtggaaatcagaaatgaagaaaacaacagcggcctttttgtgacggtcttggaagtgagcagtgcctcggcggcccacacagggttgtacacttgctattacaaccacactcagacagaagagaatgagcttgaaggcaggcacatttacatctatgtgccag

SEQ ID NO: 10501 - DNA, 839 bp, synthetic construct; identical to SEQ ID NO: 9123
  misc_feature 1..839: note = Synthetic polypeptide
  source 1..839: mol_type = other DNA

SEQ ID NO: 10502 - DNA, 2104 bp, synthetic construct; identical to SEQ ID NO: 9015
  misc_feature 1..2104: note = Synthetic polypeptide
  source 1..2104: mol_type = other DNA

SEQ ID NO: 10503 - DNA, 1292 bp, synthetic construct; identical to SEQ ID NO: 8770
  misc_feature 1..1292: note = Synthetic polypeptide
  source 1..1292: mol_type = other DNA

SEQ ID NO: 10504 - DNA, 1082 bp, synthetic construct; identical to SEQ ID NO: 8771
  misc_feature 1..1082: note = Synthetic polypeptide
  source 1..1082: mol_type = other DNA

SEQ ID NO: 10505 - DNA, 1262 bp, synthetic construct
  misc_feature 1..1262: note = Synthetic polypeptide
  source 1..1262: mol_type = other DNA
tgtcccttgatcaacaatgatttgaactgtgcaagtccacttacattcaaattttcatctgcttctgccatccctgagacagcaagaccaacccctcctcttccttctcctcctcagcctccttaacgtgaagacaatgaggatgaagacttttatgatgagccacttccactaaacgaatagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttga

SEQ ID NO: 10506 - DNA, 216 bp, synthetic construct; identical to SEQ ID NO: 8799
  misc_feature 1..216: note = Synthetic polypeptide
  source 1..216: mol_type = other DNA

SEQ ID NO: 10507 - DNA, 1314 bp, synthetic construct; identical to SEQ ID NO: 8892
  misc_feature 1..1314: note = Synthetic polypeptide
  source 1..1314: mol_type = other DNA

SEQ ID NO: 10508 - DNA, 1374 bp, synthetic construct; identical to SEQ ID NO: 8893
  misc_feature 1..1374: note = Synthetic polypeptide
  source 1..1374: mol_type = other DNA

SEQ ID NO: 10509 - DNA, 157 bp, synthetic construct; identical to SEQ ID NO: 8894
  misc_feature 1..157: note = Synthetic polypeptide
  source 1..157: mol_type = other DNA

SEQ ID NO: 10510 - DNA, 490 bp, synthetic construct; identical to SEQ ID NO: 8895
  misc_feature 1..490: note = Synthetic polypeptide
  source 1..490: mol_type = other DNA

SEQ ID NO: 10511 - DNA, 1497 bp, synthetic construct; identical to SEQ ID NO: 8896
  misc_feature 1..1497: note = Synthetic polypeptide
  source 1..1497: mol_type = other DNA

SEQ ID NO: 10512 - DNA, 1191 bp, synthetic construct; identical to SEQ ID NO: 8897
  misc_feature 1..1191: note = Synthetic polypeptide
  source 1..1191: mol_type = other DNA

SEQ ID NO: 10513 - DNA, 89 bp, synthetic construct; identical to SEQ ID NO: 9056
  misc_feature 1..89: note = Synthetic polypeptide
  source 1..89: mol_type = other DNA

SEQ ID NO: 10514 - DNA, 267 bp, synthetic construct; identical to SEQ ID NO: 9057
  misc_feature 1..267: note = Synthetic polypeptide
  source 1..267: mol_type = other DNA

SEQ ID NO: 10515 - DNA, 739 bp, synthetic construct; identical to SEQ ID NO: 9058
  misc_feature 1..739: note = Synthetic polypeptide
  source 1..739: mol_type = other DNA

SEQ ID NO: 10516 - DNA, 460 bp, synthetic construct; identical to SEQ ID NO: 9059
  misc_feature 1..460: note = Synthetic polypeptide
  source 1..460: mol_type = other DNA

SEQ ID NO: 10517 - DNA, 147 bp, synthetic construct; identical to SEQ ID NO: 9060
  misc_feature 1..147: note = Synthetic polypeptide
  source 1..147: mol_type = other DNA

SEQ ID NO: 10518 - DNA, 147 bp, synthetic construct; identical to SEQ ID NO: 9061
  misc_feature 1..147: note = Synthetic polypeptide
  source 1..147: mol_type = other DNA

SEQ ID NO: 10519 - DNA, 1272 bp, synthetic construct
  misc_feature 1..1272: note = Synthetic polypeptide
  source 1..1272: mol_type = other DNA
agccccagggccaattcctgtccccccagcagcatggcatcgtgtgctgaaccctctgagccctctgccccactgcccgccggggtcccaccgctcgaggacttcgaggtactggatggggttgaggatgcagagggtgaggaggaagaggaggaggaagaggaggaagaggatgacctgagtgagctgccaccgctggaggacatgggacaacccccggcggaggaggctgagcagcctggggccctggcccgagagttccttgctgccatggagcccgagcccgccccagccccggccccagaagagtggctggacattctggggaacgggctgttgaggaagaagacgctggtcccagggccgccaggttcgagccgcccggtcaagggccaggtggtcaccgtacatctgcagacgtcgctggagaatggcacacgggtgcaggaggagccggagctggtgttcactctgggtgactgtgacgtcatccaggccctggatctcagtgtcccactcatggacgtgggggagacggccatggtcactgctgactccaagtactgctacggcccccaaggcaggagcccatacatccccccgcacgcggccctgtgcctggaggtgaccctgaagacggctgtggacgggcctgacctggagatgctcacggggcaggagcgcgtggccctggccaaccggaagcgggagtgcggcaacgcccactaccagcgggcggacttcgtcctggccgccaactcctacgacctcgccatcaaggctatcacctccagcgccaaagtggacatgacgttcgaggaggaggcacagctcctgcagttgaaggtgaagtgtctgaacaacctggcggcctcgcagctgaagctcgaccactaccgcgcagccctgcgctcctgcagccttgtgctggagcaccagccagacaacatcaaggctctcttccgcaagggcaaggtgctggcccagcagggggagtacagtgaggccatccccatcctgagggcagccctgaagctggaaccttccaacaagacgatccacgcagagctctcaaagctggtgaagaagcatgcggcgcagcggagcacggagaccgccttgtaccggaaaatgctgggcaaccccagccggctgcctgctaagtgccctggcaagggtgcctggtccatcccatggaagtggctgtttggggcgactgctgttgccttggggggtgtggcactctctgtggtcatcgctgccaggaactga

SEQ ID NO: 10520 - DNA, 2046 bp, synthetic construct; identical to SEQ ID NO: 8788
  misc_feature 1..2046: note = Synthetic polypeptide
  source 1..2046: mol_type = other DNA

SEQ ID NO: 10521 - DNA, 2100 bp, synthetic construct; identical to SEQ ID NO: 8789
  misc_feature 1..2100: note = Synthetic polypeptide
  source 1..2100: mol_type = other DNA

SEQ ID NO: 10522 - DNA, 2124 bp, synthetic construct; identical to SEQ ID NO: 8790
  misc_feature 1..2124: note = Synthetic polypeptide
  source 1..2124: mol_type = other DNA

SEQ ID NO: 10523 - DNA, 2100 bp, synthetic construct; identical to SEQ ID NO: 8791
  misc_feature 1..2100: note = Synthetic polypeptide
  source 1..2100: mol_type = other DNA

SEQ ID NO: 10524 - DNA, 2016 bp, synthetic construct; identical to SEQ ID NO: 8792
  misc_feature 1..2016: note = Synthetic polypeptide
  source 1..2016: mol_type = other DNA

SEQ ID NO: 10525 - DNA, 2124 bp, synthetic construct; identical to SEQ ID NO: 8793
  misc_feature 1..2124: note = Synthetic polypeptide
  source 1..2124: mol_type = other DNA

SEQ ID NO: 10526 - DNA, 2007 bp, synthetic construct; identical to SEQ ID NO: 8794
  misc_feature 1..2007: note = Synthetic polypeptide
  source 1..2007: mol_type = other DNA

SEQ ID NO: 10527 - DNA, 663 bp, synthetic construct; identical to SEQ ID NO: 8795
  misc_feature 1..663: note = Synthetic polypeptide
  source 1..663: mol_type = other DNA

SEQ ID NO: 10528 - DNA, 1219 bp, synthetic construct; identical to SEQ ID NO: 8865
  misc_feature 1..1219: note = Synthetic polypeptide
  source 1..1219: mol_type = other DNA

SEQ ID NO: 10529 - DNA, 1585 bp, synthetic construct; identical to SEQ ID NO: 8866
  misc_feature 1..1585: note = Synthetic polypeptide
  source 1..1585: mol_type = other DNA

SEQ ID NO: 10530 - DNA, 1324 bp, synthetic construct; identical to SEQ ID NO: 8867
  misc_feature 1..1324: note = Synthetic polypeptide
  source 1..1324: mol_type = other DNA

SEQ ID NO: 10531 - DNA, 1006 bp, synthetic construct; identical to SEQ ID NO: 8868
  misc_feature 1..1006: note = Synthetic polypeptide
  source 1..1006: mol_type = other DNA

SEQ ID NO: 10532 - DNA, 1585 bp, synthetic construct; identical to SEQ ID NO: 8869
  misc_feature 1..1585: note = Synthetic polypeptide
  source 1..1585: mol_type = other DNA

SEQ ID NO: 10533 - DNA, 3034 bp, synthetic construct; identical to SEQ ID NO: 8891
  misc_feature 1..3034: note = Synthetic polypeptide
  source 1..3034: mol_type = other DNA

SEQ ID NO: 10534 - DNA, 921 bp, synthetic construct; identical to SEQ ID NO: 8805
  misc_feature 1..921: note = Synthetic polypeptide
  source 1..921: mol_type = other DNA

SEQ ID NO: 10535 - DNA, 1583 bp, synthetic construct; identical to SEQ ID NO: 828
  misc_feature 1..1583: note = Synthetic polypeptide
  source 1..1583: mol_type = other DNA

SEQ ID NO: 10536 - DNA, 1421 bp, synthetic construct; identical to SEQ ID NO: 829
  misc_feature 1..1421: note = Synthetic polypeptide
  source 1..1421: mol_type = other DNA

SEQ ID NO: 10537 - DNA, 1365 bp, synthetic construct; identical to SEQ ID NO: 8252
  misc_feature 1..1365: note = Synthetic polypeptide
  source 1..1365: mol_type = other DNA

SEQ ID NO: 10538 - DNA, 89 bp, synthetic construct; identical to SEQ ID NO: 9056
  misc_feature 1..89: note = Synthetic polypeptide
  source 1..89: mol_type = other DNA

SEQ ID NO: 10539 - DNA, 267 bp, synthetic construct; identical to SEQ ID NO: 9057
  misc_feature 1..267: note = Synthetic polypeptide
  source 1..267: mol_type = other DNA

SEQ ID NO: 10540 - DNA, 1595 bp, synthetic construct; identical to SEQ ID NO: 851
  misc_feature 1..1595: note = Synthetic polypeptide
  source 1..1595: mol_type = other DNA

SEQ ID NO: 10541 - DNA, 1433 bp, synthetic construct; identical to SEQ ID NO: 852
  misc_feature 1..1433: note = Synthetic polypeptide
  source 1..1433: mol_type = other DNA

SEQ ID NO: 10542 - DNA, 373 bp, synthetic construct; identical to SEQ ID NO: 8882
  misc_feature 1..373: note = Synthetic polypeptide
  source 1..373: mol_type = other DNA

SEQ ID NO: 10543 - DNA, 383 bp, synthetic construct; identical to SEQ ID NO: 8883
  misc_feature 1..383: note = Synthetic polypeptide
  source 1..383: mol_type = other DNA

SEQ ID NO: 10544 - DNA, 387 bp, synthetic construct; identical to SEQ ID NO: 8884
  misc_feature 1..387: note = Synthetic polypeptide
  source 1..387: mol_type = other DNA

SEQ ID NO: 10545 - DNA, 412 bp, synthetic construct; identical to SEQ ID NO: 8885
  misc_feature 1..412: note = Synthetic polypeptide
  source 1..412: mol_type = other DNA

SEQ ID NO: 10546 - DNA, 606 bp, synthetic construct; identical to SEQ ID NO: 8886
  misc_feature 1..606: note = Synthetic polypeptide
  source 1..606: mol_type = other DNA

SEQ ID NO: 10547 - DNA, 500 bp, synthetic construct; identical to SEQ ID NO: 8887
  misc_feature 1..500: note = Synthetic polypeptide
  source 1..500: mol_type = other DNA

SEQ ID NO: 10548 - DNA, 526 bp, synthetic construct; identical to SEQ ID NO: 8888
  misc_feature 1..526: note = Synthetic polypeptide
  source 1..526: mol_type = other DNA

SEQ ID NO: 10549 - DNA, 555 bp, synthetic construct; identical to SEQ ID NO: 8889
  misc_feature 1..555: note = Synthetic polypeptide
  source 1..555: mol_type = other DNA

SEQ ID NO: 10550 - DNA, 490 bp, synthetic construct; identical to SEQ ID NO: 8890
  misc_feature 1..490: note = Synthetic polypeptide
  source 1..490: mol_type = other DNA

SEQ ID NO: 10551 - DNA, 1047 bp, synthetic construct; identical to SEQ ID NO: 8738
  misc_feature 1..1047: note = Synthetic polypeptide
  source 1..1047: mol_type = other DNA

SEQ ID NO: 10552 - DNA, 807 bp, synthetic construct; identical to SEQ ID NO: 8837
  misc_feature 1..807: note = Synthetic polypeptide
  source 1..807: mol_type = other DNA

SEQ ID NO: 10553 - DNA, 450 bp, synthetic construct; identical to SEQ ID NO: 8838
  misc_feature 1..450: note = Synthetic polypeptide
  source 1..450: mol_type = other DNA

SEQ ID NO: 10554 - DNA, 495 bp, synthetic construct; identical to SEQ ID NO: 7842
  misc_feature 1..495: note = Synthetic polypeptide
  source 1..495: mol_type = other DNA

SEQ ID NO: 10555 - DNA, 373 bp, synthetic construct; identical to SEQ ID NO: 7843
  misc_feature 1..373: note = Synthetic polypeptide
  source 1..373: mol_type = other DNA

SEQ ID NO: 10556 - DNA, 1593 bp, synthetic construct; identical to SEQ ID NO: 870
  misc_feature 1..1593: note = Synthetic polypeptide
  source 1..1593: mol_type = other DNA

SEQ ID NO: 10557 - DNA, 1431 bp, synthetic construct; identical to SEQ ID NO: 871
  misc_feature 1..1431: note = Synthetic polypeptide
  source 1..1431: mol_type = other DNA

SEQ ID NO: 10558 - DNA, 1133 bp, synthetic construct; identical to SEQ ID NO: 7332
  misc_feature 1..1133: note = Synthetic polypeptide
  source 1..1133: mol_type = other DNA

SEQ ID NO: 10559 - DNA, 1172 bp, synthetic construct; identical to SEQ ID NO: 7333
  misc_feature 1..1172: note = Synthetic polypeptide
  source 1..1172: mol_type = other DNA

SEQ ID NO: 10560 - DNA, 173 bp, synthetic construct; identical to SEQ ID NO: 8912
  misc_feature 1..173: note = Synthetic polypeptide
  source 1..173: mol_type = other DNA

SEQ ID NO: 10561 - DNA, 198 bp, synthetic construct; identical to SEQ ID NO: 8913
  misc_feature 1..198: note = Synthetic polypeptide
  source 1..198: mol_type = other DNA

SEQ ID NO: 10562 - DNA, 851 bp, synthetic construct; identical to SEQ ID NO: 8914
  misc_feature 1..851: note = Synthetic polypeptide
  source 1..851: mol_type = other DNA

SEQ ID NO: 10563 - DNA, 227 bp, synthetic construct; identical to SEQ ID NO: 8915
  misc_feature 1..227: note = Synthetic polypeptide
  source 1..227: mol_type = other DNA

SEQ ID NO: 10564 - DNA, 550 bp, synthetic construct; identical to SEQ ID NO: 8852
  misc_feature 1..550: note = Synthetic polypeptide
  source 1..550: mol_type = other DNA

SEQ ID NO: 10565 - DNA, 301 bp, synthetic construct; identical to SEQ ID NO: 8853
  misc_feature 1..301: note = Synthetic polypeptide
  source 1..301: mol_type = other DNA

SEQ ID NO: 10566 - DNA, 295 bp, synthetic construct; identical to SEQ ID NO: 8854
  misc_feature 1..295: note = Synthetic polypeptide
  source 1..295: mol_type = other DNA

SEQ ID NO: 10567 - DNA, 619 bp, synthetic construct; identical to SEQ ID NO: 8855
  misc_feature 1..619: note = Synthetic polypeptide
  source 1..619: mol_type = other DNA

SEQ ID NO: 10568 - DNA, 833 bp, synthetic construct
  misc_feature 1..833: note = Synthetic polypeptide
  source 1..833: mol_type = other DNA
cctcatctgccctcctctactactgattcttcccataatctctgaccccagctagatcgctggcctccttaccccgtccagttccttgtgactcgactggccggctgcctaccctccagactgtccgctatggctccaaggctgttacccgccaccgtcgtgtgatgcactttcagcggcagaagctgatggctgtgactgaatatatccccccgaaaccagccatccacccatcatgcctgccatctcctcccagccccccacaggaggagataggcctcatcaggcttctccgccgggagatagcagcagttttccaggacaaccgaatgatagccgtctgccagaatgtggctctgagtgcagaggacaagcttcttatgcgacaccagctgcggaaacacaagatcctgatgaaggtcttccccaaccaggtcctgaagcccttcctggaggattccaagtaccaaaatctgctgcccctttttgtggggcacaacatgctgctggtcagtgaagagcccaaggtcaaggagatggtacggatcttaaggactgtgccattcctgccgctgctaggtggctgcattgatgacaccatcctcagcaggcagggctttatcaactactccaagctccccagcctgcccctggtgcagggggagcttgtaggaggcctcacctgcctcacagcccagacccactccctgctccagcaccagcccctccagctgaccaccctgttggaccagtacatcagagagcaacgcgagaaggattctgtcatgtcggccaatgggaagccagatcctgacactgttccggactcgtag

SEQ ID NO: 10569 - DNA, 336 bp, synthetic construct; identical to SEQ ID NO: 7520
  misc_feature 1..336: note = Synthetic polypeptide
  source 1..336: mol_type = other DNA

SEQ ID NO: 10570 - DNA, 346 bp, synthetic construct; identical to SEQ ID NO: 7521
  misc_feature 1..346: note = Synthetic polypeptide
  source 1..346: mol_type = other DNA

SEQ ID NO: 10571 - DNA, 1320 bp, synthetic construct; identical to SEQ ID NO: 8817
  misc_feature 1..1320: note = Synthetic polypeptide
  source 1..1320: mol_type = other DNA

SEQ ID NO: 10572 - DNA, 420 bp, synthetic construct; identical to SEQ ID NO: 8818
  misc_feature 1..420: note = Synthetic polypeptide
  source 1..420: mol_type = other DNA

SEQ ID NO: 10573 - DNA, 271 bp, synthetic construct; identical to SEQ ID NO: 8953
  misc_feature 1..271: note = Synthetic polypeptide
  source 1..271: mol_type = other DNA

SEQ ID NO: 10574 - DNA, 60 bp, synthetic construct; identical to SEQ ID NO: 8954
  misc_feature 1..60: note = Synthetic polypeptide
  source 1..60: mol_type = other DNA

SEQ ID NO: 10575 - DNA, 317 bp, synthetic construct
  misc_feature 1..317: note = Synthetic polypeptide
  source 1..317: mol_type = other DNA
aactcagtaacactgagcatccctaccacccagattgtggtcttcaaataccattttccactcaaaagagtcaggtgtctttgggaaaatgactgagtccaggtttggagcagggttatgataattcagagagcagtgttcggaaagcttgtgtcttctgcctggtggctgttcatgcggtaattggtgatgaactaaaaccacatctcagtcaacttactggcagtaaaatgaagctactgaatctttacatcaaacgtgcacaaacaggttctggaggagctgatcccactactgatgtttctggacaaagttag

SEQ ID NO: 10576 - DNA, 226 bp, synthetic construct
  misc_feature 1..226: note = Synthetic polypeptide
  source 1..226: mol_type = other DNA
gggaagctagaccagtggaatcaggcttggagtcaagagacatggttcaggtggctcctgcacctgcgcggactcctgcaagtgcgagggatgcaaatgcacctcctgcaagaagagctgctgctcctgctgccctgcggagtgtgagaagtgtgccaaggactgtgtgtgcaaaggcggagaggcagctgaggcagaagcagagaagtgcagctgctgccagtga

SEQ ID NO: 10577 - DNA, 298 bp, synthetic construct
  misc_feature 1..298: note = Synthetic polypeptide
  source 1..298: mol_type = other DNA
gggaagctagaccagtggaatcaggcttggagtcaagagacatggttcaggtggctcctgcacctgcgcggactcctgcaagtgcgagggatgcaaatgcacctcctgcaagaagagtgagtgcggggacccttcccctctgccgccgccccctctgctctgcggagtcggtgtctcaccacgcaggatgtggagagacagccaggccccgatcccgtggtttctgactcttgctggaatagaaccacccgggcagacattaaaatacagatgcccctgccccacacccaggaattga

SEQ ID NO: 10578 - DNA, 3977 bp, synthetic construct
  misc_feature 1..3977: note = Synthetic polypeptide
  source 1..3977: mol_type = other DNA
ctagattatcatgctaaaccagccaatactaaaattgtttaaatatacaatttaaatgaactccatggtcttaagtcaaattacctgtgataactcagtagttatcactgctgtgcacctaaattggagaagcaactggcattcgagaggacataagttcagtgttaagcatggactcatgaagaaccaggacagccaccttatccttcccaagtccttaaagcttttgttattaaaggttctgcattccatgactcgccatggaaaagataaaataatccaaactgaatatattgatgtggtgacttatacattgtggaaatagtttaaaaccaatgtttggttccatatacctgggaagacagtcaaaactttaggtacatttgagtacctgatggtccatttaaacatttataaagggatttcattcaattgtcattttcagtgcatgttttctggttgtataaaagctttcccatgcaagagggctgttgttataacagtagattattatgctatagtgtattttcaccaggtaaataaagctttttatggttcactgataacaatccctttacaatctagaacccaaagattggatcttctgagaacatcagagaaagactgtccttaccatccacaccacagcaaaactttggagccttgaacattgggttcataatctcacagctgagaaaggtccctccacactcctggaactgtacacctattggaacccttaagagatccgcacgcagctggtggagcagttcaaatgtctggagcagcaatcagagtcgcgactgcagctgcttcaagacctccaggagtttttccgccggaaagctgagattgagctcgagtactcccgcagcctggagaagctggctgagcgcttctcctccaaaatccgcagctcccgggagcaccagttcaagaaggaccagtacctcctctcgcctgtgaactgttggtatctggttctgcatcagacccggcgggagagccgagaccatgccaccctcaatgacatcttcatgaacaatgtcatcgtccgcctctcccagatcagtgaggatgtcatcagactcttcaaaaagagcaaggagattggcctgcagatgcacgaggagctcctgaaggtgaccaatgagctctacacagtcatgaaaacctaccacatgtaccatgcagagagcatcagtgcggaaagcaagctgaaggaggctgagaagcaggaggagaagcagttcaataagtcaggagacctcagcatgaacctgctccggcacgaggaccggccccagcgccgcagctctgtgaagaagattgagaagatgaaggagaagaggcaggccaagtactctgagaacaagctgaaatgcacaaaggcccggaatgactacttgctcaatctggcagccaccaacgcagctataagcaaatactacatccatgatgtctctgatctgatcgattgctgtgatttgggcttccatgccagcctggcccgcaccttccggacctatctctcagctgaatacaacctggagacctctcgccacgaagggctggatgtcattgagaatgcagtggacaacctggattcccgaagtgacaagcacacagtcatggacatgtgcaatcaagtcttctgccctccactcaagttcgagttccagccccacatgggggatgaggtctgccaggtcagcgctcagcagcccgtccagacagaactgctcatgcgttatcaccagctgcagtccagactggccaccctcaagatagagaatgaggaggttaggaaaaccctggatgccaccatgcagacattacaggacatgctgactgtggaggactttgatgtctccgatgccttccaacacagtcgatcgacagagtccgtcaagtcggctgcctctgagacctacatgagcaagatcaacattgccaagaggagagccaaccagcaggaaacagaaatgttttattttacaaaatttaaagagtatgtgaatggcagtaacctcatcaccaagctgcaggccaagcacgatttactcaagcagaccctgggcgaaggggaaagagcagaatgcggcaccaccaggcccccctgtcttccccctaaaccacagaaaatgaggagacctaggcctctctcagtgtatagccataaactctttaacggcagtatggaagcattcattaaggattcaggacaagctataccgcttgtagtcgagagctgcatccgttacatcaatttatatggactccagcagcaggggatcttcagagtgccaggatctcaggtggaagtcaatgacatcaaaaattcctttgagagaggtgaagacccccttgtggacgatcaaaatgaacgagatatcaattcagtcgctggtgttttaaaactgtatttccgaggactggaaaacccactctttcctaaggaaaggtttcaagatttgatatctactattaaactggagaacccagccgagagggtgcaccagatccaacaaatcctcgtcacccttccccgcgtggtcattgtggtcatgagatacctcttcgctttcctcaaccacctctcccagtatagcgacgagaacatgatggatccctacaacctggccatctgcttcgggcctaccctcatgcacatccctgatgggcaggaccctgtgtcctgccaggcacacatcaatgaagtcatcaaaaccatcatcatccatcatgaagccatcttccccagcccccgggagctagagggacctgtgtatgaaaaatgcatggctggaggggaagaatattgtgacagcccacacagcgagccaggggccatcgatgaagttgaccatgacaatggcactgagcctcataccagcgatgaagaagtggagcagatcgaggctattgccaagtttgactacatggggcggtccccgcgtgagctatccttcaagaagggggcctcgctgctcctgtaccaccgcgcctcggaggactggtgggagggccggcacaacggcgtggatggactcatcccccatcagtacatagttgtacaggacatggatgatgccttctccgacagcctgagccagaaggctgacagcgaggccagcagtgggccattgctggatgacaaggcctcttccaaaaacgacctccagtcccccacggagcacatctcggattacggctttgggggggtgatgggccgagtgcggttacgatctgatggagcagccatccccagacgccgaagcgggggcgacacacacagcccgccccggggcctgggccccagcatagacacaccaccccgggctgctgcctgccccagcagcccccacaaaatccccctcacccgggggaggatcgagagccctgagaagcggaggatggcgacgttcgggagcgctggcagcatcaactaccctgacaagaaggcgctctccgaagggcactcgatgaggtcgacctgcggttccaccaggcacagcagcctaggggaccacaagtccctggaggccgaggccctggcagaagacatcgagaagaccatgagcacggctctgcacgagttgcgggaactcgagaggcagaacacggtcaagcaggcgccagatgtggtgctggacaccctggagcccctgaagaacccgccaggccccgtcagctcggagcccgccagtccccttcacaccatcgtcatccgcgaccccgatgccgccatgcgccgcagcagcagctcctccaccgagatgatgaccaccttcaagccagccctgtccgcccgcctggctggcgcccagctccgcccgccccccatgcggcccgtgcggccggtggtccagcaccggtccagcagcagcagcagctcgggcgtgggcagcccggccgtgacgcccaccgagaagatgttccccaacagctcagcggacaagtcgggcaccatgtga

SEQ ID NO: 10579 - DNA, 3905 bp, synthetic construct
  misc_feature 1..3905: note = Synthetic polypeptide
  source 1..3905: mol_type = other DNA
ctagattatcatgctaaaccagccaatactaaaattgtttaaatatacaatttaaatgaactccatggtcttaagtcaaattacctgtgataactcagtagttatcactgctgtgcacctaaattggagaagcaactggcattcgagaggacataagttcagtgttaagcatggactcatgaagaaccaggacagccaccttatccttcccaagtccttaaagcttttgttattaaaggttctgcattccatgactcgccatggaaaagataaaataatccaaactgaatatattgatgtggtgacttatacattgtggaaatagtttaaaaccaatgtttggttccatatacctgggaagacagtcaaaactttaggtacatttgagtacctgatggtccatttaaacatttataaagggatttcattcaattgtcattttcagtgcatgttttctggttgtataaaagctttcccatgcaagagggctgttgttataacagtagattattatgctatagtgtattttcaccaggtaaataaagctttttatggttcactgataacaatccctttacaatctagaacccaaagattggatcttctgagaacatcagagaaagactgtccttaccatccacaccacagcaaaactttggagccttgaacattgggttcataatctcacagctgagaaaggtccctccacactcctggaactgtacacctattggaacccttaagagatccgcacgcagctggtggagcagttcaaatgtctggagcagcaatcagagtcgcgactgcagctgcttcaagacctccaggagtttttccgccggaaagctgagattgagctcgagtactcccgcagcctggagaagctggctgagcgcttctcctccaaaatccgcagctcccgggagcaccagttcaagaaggaccagtacctcctctcgcctgtgaactgttggtatctggttctgcatcagacccggcgggagagccgagaccatgccaccctcaatgacatcttcatgaacaatgtcatcgtccgcctctcccagatcagtgaggatgtcatcagactcttcaaaaagagcaaggagattggcctgcagatgcacgaggagctcctgaaggtgaccaatgagctctacacagtcatgaaaacctaccacatgtaccatgcagagagcatcagtgcggaaagcaagctgaaggaggctgagaagcaggaggagaagcagttcaataagtcaggagacctcagcatgaacctgctccggcacgaggaccggccccagcgccgcagctctgtgaagaagattgagaagatgaaggagaagaggcaggccaagtactctgagaacaagctgaaatgcacaaaggcccggaatgactacttgctcaatctggcagccaccaacgcagctataagcaaatactacatccatgatgtctctgatctgatcgattgctgtgatttgggcttccatgccagcctggcccgcaccttccggacctatctctcagctgaatacaacctggagacctctcgccacgaagggctggatgtcattgagaatgcagtggacaacctggattcccgaagtgacaagcacacagtcatggacatgtgcaatcaagtcttctgccctccactcaagttcgagttccagccccacatgggggatgaggtctgccaggtcagcgctcagcagcccgtccagacagaactgctcatgcgttatcaccagctgcagtccagactggccaccctcaagatagagaatgaggaggttaggaaaaccctggatgccaccatgcagacattacaggacatgctgactgtggaggactttgatgtctccgatgccttccaacacagtcgatcgacagagtccgtcaagtcggctgcctctgagacctacatgagcaagatcaacattgccaagaggagagccaaccagcaggaaacagaaatgttttattttacaaaatttaaagagtatgtgaatggcagtaacctcatcaccaagctgcaggccaagcacgatttactcaagcagaccctgggcgaaggggaaagagcagaatgcggcaccaccagaggaagaagaaatgctcgaaccaggaaccaggattcaggacaagctataccgcttgtagtcgagagctgcatccgttacatcaatttatatggactccagcagcaggggatcttcagagtgccaggatctcaggtggaagtcaatgacatcaaaaattcctttgagagaggtgaagacccccttgtggacgatcaaaatgaacgagatatcaattcagtcgctggtgttttaaaactgtatttccgaggactggaaaacccactctttcctaaggaaaggtttcaagatttgatatctactattaaactggagaacccagccgagagggtgcaccagatccaacaaatcctcgtcacccttccccgcgtggtcattgtggtcatgagatacctcttcgctttcctcaaccacctctcccagtatagcgacgagaacatgatggatccctacaacctggccatctgcttcgggcctaccctcatgcacatccctgatgggcaggaccctgtgtcctgccaggcacacatcaatgaagtcatcaaaaccatcatcatccatcatgaagccatcttccccagcccccgggagctagagggacctgtgtatgaaaaatgcatggctggaggggaagaatattgtgacagcccacacagcgagccaggggccatcgatgaagttgaccatgacaatggcactgagcctcataccagcgatgaagaagtggagcagatcgaggctattgccaagtttgactacatggggcggtccccgcgtgagctatccttcaagaagggggcctcgctgctcctgtaccaccgcgcctcggaggactggtgggagggccggcacaacggcgtggatggactcatcccccatcagtacatagttgtacaggacatggatgatgccttctccgacagcctgagccagaaggctgacagcgaggccagcagtgggccattgctggatgacaaggcctcttccaaaaacgacctccagtcccccacggagcacatctcggattacggctttgggggggtgatgggccgagtgcggttacgatctgatggagcagccatccccagacgccgaagcgggggcgacacacacagcccgccccggggcctgggccccagcatagacacaccaccccgggctgctgcctgccccagcagcccccacaaaatccccctcacccgggggaggatcgagagccctgagaagcggaggatggcgacgttcgggagcgctggcagcatcaactaccctgacaagaaggcgctctccgaagggcactcgatgaggtcgacctgcggttccaccaggcacagcagcctaggggaccacaagtccctggaggccgaggccctggcagaagacatcgagaagaccatgagcacggctctgcacgagttgcgggaactcgagaggcagaacacggtcaagcaggcgccagatgtggtgctggacaccctggagcccctgaagaacccgccaggccccgtcagctcggagcccgccagtccccttcacaccatcgtcatccgcgaccccgatgccgccatgcgccgcagcagcagctcctccaccgagatgatgaccaccttcaagccagccctgtccgcccgcctggctggcgcccagctccgcccgccccccatgcggcccgtgcggccggtggtccagcaccggtccagcagcagcagcagctcgggcgtgggcagcccggccgtgacgcccaccgagaagatgttccccaacagctcagcggacaagtcgggcaccatgtga

SEQ ID NO: 10580 - DNA, 514 bp, synthetic construct
  misc_feature 1..514: note = Synthetic polypeptide
  source 1..514: mol_type = other DNA
gcagttaaacacttgggctccagaattggactgcacgactttactctccagcttaccacttgccagccgtgtgacacggaagtgcatcagcagaggggagctccaggtgtctctgtcatatcagcctgtggcacagagaatgacagtggtggtcctcaaagccagacacttgccgaagatggatatcaccggtctctcaggtaatccttatgtcaaggtgaacgtctactacggcagaaagcgcattgccaagaagaaaacccatgtgaagaagtgcactttgaaccccatcttcaatgaatctttcatctacgacatccccactgacctcctgcctgatatcagcatcgagttcctcgttatcgacttcgatcgcaccaccaagaatgaggtggtggggaggctgatcctgggggcacacagtgtcacagccagtggtgctgaacactggagagaggtctgcgagagcccccgcaagcctgtggccaagtggcacagtctgagcgagtactaa

SEQ ID NO: 10581 - DNA, 860 bp, synthetic construct
  misc_feature 1..860: note = Synthetic polypeptide
  source 1..860: mol_type = other DNA
catggctccgtgtgtaggggcgcggctgggtgctgtgcagacccagttccatcccgggctcactcactgtccagcagtcactgaacctctcagcgcctcatcgtcctcatctgtgaaagatggctatcgtgttcaaccaggagggcctgaacgccatccagccaccctgcgtggtccagaatttcatcaaccacaacgccgtcctgtacaaggtgttcgtggttggcgagtcctacaccgtggtccagaggccctcactcaagaacttctccgcaggcacatcagaccgtgagtccatcttcttcaacagccacaacgtgtcaaagccggagtcgtcatcggtcctgacggagctggacaagatcgagggcgtgttcgagcggccgagcgacgaggtcatccgggagctctcccgggccctgcggcaggcactgggcgtgtcactcttcggcatcgacatcatcatcaacaaccagacagggcagcacgccgtcattgacatcaatgccttcccaggctacgagggcgtgagcgagttcttcacagacctcctgaaccacatcgccactgtcctgcagggccagagcacagccatggcagccacaggggacgtggccctgctgaggcacagcaagcttctggccgagccggcgggcggcctggtgggcgagcggacatgcagcgccagccccggctgctgcggcagcatgatgggccaggacgcgccctggaaggctgaggccgacgcgggcggcaccgccaagctgccgcaccagagactcggctgcaacgccggcgtgtcgcccagcttccagcagcattgtgtggcctccctggccaccaaggcctcctcccagtag

SEQ ID NO: 10582 - DNA, 560 bp, synthetic construct
  misc_feature 1..560: note = Synthetic polypeptide
  source 1..560: mol_type = other DNA
catggctccgtgtgtaggggcgcggctgggtgctgtgcagacccagttccatcccgggctcactcactgtccagcagtcactgaacctctcagcgcctcatcgtcctcatctgtgaaagatggctatcgtgttcaaccaggagggcctgaacgccatccagccaccctgcgtggtccagaatttcatcaaccacaacgccgtcctgtacaaggtgttcgtggttggcgagtcctacaccgtggtccagaggccctcactcaagaacttctccgcaggcacatcagaccgtgagtccatcttcttcaacagccacaacgtgtcaaagccggagtcgtcatcggtcctgacggagctggacaagatcgagggcgtgttcgagcggccgagcgacgaggtcatccgggagctctcccgggccctgcggcaggcactgggcgtgtcactcttcggcatcgacatcatcatcaacaaccagacagggcagcacgccgtcattgacatcaatgccttcccaggggactgccaagtgtgctttatagaaggctggaagaccgactga

SEQ ID NO: 10583 - DNA, 285 bp, synthetic construct
  misc_feature 1..285: note = Synthetic polypeptide
  source 1..285: mol_type = other DNA
catggctccgtgtgtaggggcgcggctgggtgctgtgcagacccagttccatcccgggctcactcactgtccagcagtcactgaacctctcagcgcctcatcgtcctcatctgtgaaagatggctatcgtgttcaaccaggagggcctgaacgccatccagccaccctgcgtggtccagaatttcatcaaccacaacgccgtcctgtacaaggtgttcgtggttggcgagtcctacaccgtggtccagaggccctcactcaagaacttctccgcaggcacatcag

SEQ ID NO: 10584 - DNA, 252 bp, synthetic construct
  misc_feature 1..252: note = Synthetic polypeptide
  source 1..252: mol_type = other DNA
catggctccgtgtgtaggggcgcggctgggtgctgtgcagacccagttccatcccgggctcactcactgtccagcagtcactgaacctctcagcgcctcatcgtcctcatctgtgaaagatggctatcgtgttcaaccaggagggcctgaacgccatccagccaccctgcgtggtccagaatttcatcaaccacaacgccgtcctgtacaaggtgttcgtggttggcgagtcctacaccgtggtccagaggc

SEQ ID NO: 10585 - DNA, 215 bp, synthetic construct
  misc_feature 1..215: note = Synthetic polypeptide
  source 1..215: mol_type = other DNA
catggctccgtgtgtaggggcgcggctgggtgctgtgcagacccagttccatcccgggctcactcactgtccagcagtcactgaacctctcagcgcctcatcgtcctcatctgtgaaagatggctatcgtgttcaaccaggagggcctgaacgccatccagccaccctgcgtggtccagaatttcatcaaccacaacgccgtcctgtacaaggtg

SEQ ID NO: 10586 - DNA, 1861 bp, synthetic construct; identical to SEQ ID NO: 6680
  misc_feature 1..1861: note = Synthetic polypeptide
  source 1..1861: mol_type = other DNA

SEQ ID NO: 10587 - DNA, 1123 bp, synthetic construct; identical to SEQ ID NO: 6681
  misc_feature 1..1123: note = Synthetic polypeptide
  source 1..1123: mol_type = other DNA

SEQ ID NO: 10588 - DNA, 148 bp, synthetic construct; identical to SEQ ID NO: 6388
  misc_feature 1..148: note = Synthetic polypeptide
  source 1..148: mol_type = other DNA

SEQ ID NO: 10589 - DNA, 1100 bp, synthetic construct; identical to SEQ ID NO: 6389
  misc_feature 1..1100: note = Synthetic polypeptide
  source 1..1100: mol_type = other DNA

SEQ ID NO: 10590 - DNA, 464 bp, synthetic construct; identical to SEQ ID NO: 6390
  misc_feature 1..464: note = Synthetic polypeptide
  source 1..464: mol_type = other DNA

SEQ ID NO: 10591 - DNA, 280 bp, synthetic construct; identical to SEQ ID NO: 6391
  misc_feature 1..280: note = Synthetic polypeptide
  source 1..280: mol_type = other DNA

SEQ ID NO: 10592 - DNA, 251 bp, synthetic construct
  misc_feature 1..251: note = Synthetic polypeptide
  source 1..251: mol_type = other DNA
taattagttttgcagaagtgcagccatgttacatcactgctcaggaggtcatgcagttgcacattctgtactctacttttatgagagaaaagcacatggcaggaaggcaagctgatatcagggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 10593 - DNA, 1555 bp, synthetic construct
  misc_feature 1..1555: note = Synthetic polypeptide
  source 1..1555: mol_type = other DNA
ttatgttaaagaggcgatttttggaaagtcccagatagccactggatggggggctggttgccaggggaacaaacctggtgctctgagggttggaatttacaggcccacccctcacctctggggaagggagaggggatgaagattgagtagagcaccaattgccaatgatttaatcggtcatgcctgtgtaatgaagcctccataaaaatccaaaaggactgagtttgggggcttccaggaaggtgaacaagaacacatccacaggccaggagggtgcaaacccaacgccacagggcagcaactcctatgcgccggacccttctagagcttcccctcggtatctcttcatctggctgtttatttgtatcctttaaaatatcctttataacaaatggatgaacgtaagtaagtgtctccttgagttctgtgagctactctaacaaattaattgaacccaaggagcagtcctgagaacctcgatttatagctggttggtcagaggcacagataaaacaacctgaagcttgtgttggcattggaagtgggagagtcttgtgggactgagccttcactctgtgggatctgatgctatcttcagggcttcgtgctgtgtcactccatcgctgggggtacgggttctggcctgggctcctacctcctggagcgactgaatgacaggtaccccaagaagctagtgcagacttattcagtgtttccctaccaggacgagatgagcgacgtagtggttcagccctacaattcactcctgacactcaagaggctgacgcagaacgcagattgtgtggtggtgctggacaacacagccctgaaccggattgccacagaccgcctgcacatccagaacccgtccttctcccagatcaaccagctggtgtccaccatcatgtcggccagcaccaccaccctgcgctaccccggctacatgaacaatgacctcatcggcctcatcgcctcgctcattcccaccccacggctccacttcctcatgaccggctacaccccgctcactacagaccagtcagtggccagcgtgaggaagaccacggtcctggatgtcatgaggcggctgctgcagcccaagaacgtgatggtgtccacaggccgagaccgccagaccaaccactgctacatcgccatcctcaacatcatccagggagaggtggaccccacccaggtccacaagagcctgcagaggatccgggaacggaagttggccaacttcatcccgtggggccccgccagcatccaggtggccctgtcgaggaagtctccctacctgccctcggcccaccgggtcagcgggctcatgatggccaaccacaccagcatctcctcgctctttgaaagttcctgccagcagtttgacaagctgcggaagcgggatgccttcctcgagcagttccgtaaggaggacatgttcaaggacaactttgatgagatggacaggtctagggaggttgttcaggagctcattgatgagtaccatgcggccacccagccagactacatttcctggggcacccaggagcagtga

SEQ ID NO: 10594 - DNA, 678 bp, synthetic construct; identical to SEQ ID NO: 8918
  misc_feature 1..678: note = Synthetic polypeptide
  source 1..678: mol_type = other DNA

SEQ ID NO: 10595 - DNA, 726 bp, synthetic construct; identical to SEQ ID NO: 8919
  misc_feature 1..726: note = Synthetic polypeptide
  source 1..726: mol_type = other DNA

SEQ ID NO: 10596 - DNA, 949 bp, synthetic construct; identical to SEQ ID NO: 8902
  misc_feature 1..949: note = Synthetic polypeptide
  source 1..949: mol_type = other DNA

SEQ ID NO: 10597 - DNA, 946 bp, synthetic construct; identical to SEQ ID NO: 8903
  misc_feature 1..946: note = Synthetic polypeptide
  source 1..946: mol_type = other DNA

SEQ ID NO: 10598 - DNA, 967 bp, synthetic construct; identical to SEQ ID NO: 8904
  misc_feature 1..967: note = Synthetic polypeptide
  source 1..967: mol_type = other DNA

SEQ ID NO: 10599 - DNA, 394 bp, synthetic construct; identical to SEQ ID NO: 8905
  misc_feature 1..394: note = Synthetic polypeptide
  source 1..394: mol_type = other DNA

SEQ ID NO: 10600 - DNA, 435 bp, synthetic construct; identical to SEQ ID NO: 8906
  misc_feature 1..435: note = Synthetic polypeptide
  source 1..435: mol_type = other DNA

SEQ ID NO: 10601 - DNA, 197 bp, synthetic construct; identical to SEQ ID NO: 8907
  misc_feature 1..197: note = Synthetic polypeptide
  source 1..197: mol_type = other DNA

SEQ ID NO: 10602 - DNA, 1524 bp, synthetic construct
  misc_feature 1..1524: note = Synthetic polypeptide
  source 1..1524: mol_type = other DNA
aggagcatactactgggacggaaggacctgaactttgagataagtctgggtgcacctattccattcttccatcgctgtgctcctgtgaacatttcctgctatgccaagtttgcagaggccctgatcacctttgtcagtgacaatagtgtcttacacaggctgattagtggagtaatgaccagcaaagaaattatattgggactttgcttgttatcactagttctatccatgattttgatggtgataatcaggtatatatcaagagtacttgtgtggatcttaacgattctggtcatactcggttcacttggaggcacaggtgtactatggtggctgtatgcaaagcaaagaaggtctcccaaagaaactgttactcctgagcagcttcagatagctgaagacaatcttcgggccctcctcatttatgccatttcagctacagtgttcacagtgatcttattcctgataatgttggttatgcgcaaacgtgttgctcttaccatcgccttgttccacgtagctggcaaggtcttcattcacttgccactgctagtcttccaacccttctggactttctttgctcttgtcttgttttgggtgtactggatcatgacacttctttttcttggcactaccggcagtcctgttcagaatgagcaaggctttgtggagttcaaaatttctgggcctctgcagtacatgtggtggtaccatgtggtgggcctgatttggatcagtgaatttattctagcatgtcagcagatgacagtggcaggagctgtggtaacatactattttactagggataaaaggaatttgccatttacacctattttggcatcagtaaatcgccttattcgttaccacctaggtacggtggcaaaaggatctttcattatcacattagtcaaaattccgcgaatgatccttatgtatattcacagtcagctcaaaggaaaggaaaatgcttgtgcacgatgtgtgctgaaatcttgcatttgttgcctttggtgtcttgaaaagtgcctaaattatttaaatcagaatgcatacacagccacagctatcaacagcaccaacttctgcacctcagcaaaggatgcctttgtcattctggtggagaatgctttgcgagtggctaccatcaacacagtaggagattttatgttattccttggcaaggtgctgatagtctgcagcacaggtttagctgggattatgctgctcaactaccagcaggactacacagtatgggtgctgcctctgatcatcgtctgcctctttgctttcctagtcgctcattgcttcctgtctatttatgaaatggtagtggatgtattattcttgtgttttgccattgatacaaaatacaatgatgggagccctggcagagaattctatatggataaagtgctgatggagtttgtggaaaacagtaggaaagcaatgaaagaagctggtaagggaggcgtcgctgattccagagagctaaagccgatggcttcgggagcaagttctgcttga

SEQ ID NO: 10603 - DNA, 1509 bp, synthetic construct
  misc_feature 1..1509: note = Synthetic polypeptide
  source 1..1509: mol_type = other DNA
aggagcatactactgggacggaaggacctgaactttgagataagtctgggtgcacctattccattcttccatcgctgtgctcctgtgaacatttcctgctatgccaagtttgcagaggccctgatcacctttgtcagtgacaatagtgtcttacacaggctgattagtggagtaatgaccagcaaagaaattatattgggactttgcttgttatcactagttctatccatgattttgatggtgataatcaggtatatatcaagagtacttgtgtggatcttaacgattctggtcatactcggttcacttggaggcacaggtgtactatggtggctgtatgcaaagcaaagaaggtctcccaaagaaactgttactcctgagcagcttcagatagctgaagacaatcttcgggccctcctcatttatgccatttcagctacagtgttcacagtgatcttattcctgataatgttggttatgcgcaaacgtgttgctcttaccatcgccttgttccacgtagctggcaaggtcttcattcacttgccactgctagtcttccaacccttctggactttctttgctcttgtcttgttttgggtgtactggatcatgacacttctttttcttggcactaccggcagtcctgttcagaatgagcaaggctttgtggagttcaaaatttctgggcctctgcagtacatgtggtggtaccatgtggtgggcctgatttggatcagtgaatttattctagcatgtcagcagatgacagtggcaggagctgtggtaacatactattttactagggataaaaggaatttgccatttacacctattttggcatcagtaaatcgccttattcgttaccacctaggtacggtggcaaaaggatctttcattatcacattagtcaaaattccgcgaatgatccttatgtatattcacagtcagctcaaaggaaaggaaaatgcttgtgcacgatgtgtgctgaaatcttgcatttgttgcctttggtgtcttgaaaagtgcctaaattatttaaatcagaatgcatacacagccacagctatcaacagcaccaacttctgcacctcagcaaaggatgcctttgtcattctggtggagaatgctttgcgagtggctaccatcaacacagtaggagattttatgttattccttggcaaggtgctgatagtctgcagcacaggtttagctgggattatgctgctcaactaccagcaggactacacagtatgggtgctgcctctgatcatcgtctgcctctttgctttcctagtcgctcattgcttcctgtctatttatgaaatggtagtggatgtattattcttgtgttttgccattgatacaaaatacaatgatgggagccctggcagagaattctatatggataaagtgctgatggagtttgtggaaaacagtaggaaagcaatgaaagaagctggtaagggaggcgtcgctgattccagagagctaaagccgatgattaagtaa

SEQ ID NO: 10604 - DNA, 1515 bp, synthetic construct
  misc_feature 1..1515: note = Synthetic polypeptide
  source 1..1515: mol_type = other DNA
aggagcatactactgggacggaaggacctgaactttgagataagtctgggtgcacctattccattcttccatcgctgtgctcctgtgaacatttcctgctatgccaagtttgcagaggccctgatcacctttgtcagtgacaatagtgtcttacacaggctgattagtggagtaatgaccagcaaagaaattatattgggactttgcttgttatcactagttctatccatgattttgatggtgataatcaggtatatatcaagagtacttgtgtggatcttaacgattctggtcatactcggttcacttggaggcacaggtgtactatggtggctgtatgcaaagcaaagaaggtctcccaaagaaactgttactcctgagcagcttcagatagctgaagacaatcttcgggccctcctcatttatgccatttcagctacagtgttcacagtgatcttattcctgataatgttggttatgcgcaaacgtgttgctcttaccatcgccttgttccacgtagctggcaaggtcttcattcacttgccactgctagtcttccaacccttctggactttctttgctcttgtcttgttttgggtgtactggatcatgacacttctttttcttggcactaccggcagtcctgttcagaatgagcaaggctttgtggagttcaaaatttctgggcctctgcagtacatgtggtggtaccatgtggtgggcctgatttggatcagtgaatttattctagcatgtcagcagatgacagtggcaggagctgtggtaacatactattttactagggataaaaggaatttgccatttacacctattttggcatcagtaaatcgccttattcgttaccacctaggtacggtggcaaaaggatctttcattatcacattagtcaaaattccgcgaatgatccttatgtatattcacagtcagctcaaaggaaaggaaaatgcttgtgcacgatgtgtgctgaaatcttgcatttgttgcctttggtgtcttgaaaagtgcctaaattatttaaatcagaatgcatacacagccacagctatcaacagcaccaacttctgcacctcagcaaaggatgcctttgtcattctggtggagaatgctttgcgagtggctaccatcaacacagtaggagattttatgttattccttggcaaggtgctgatagtctgcagcacaggtttagctgggattatgctgctcaactaccagcaggactacacagtatgggtgctgcctctgatcatcgtctgcctctttgctttcctagtcgctcattgcttcctgtctatttatgaaatggtagtggatgtattattcttgtgttttgccattgatacaaaatacaatgatgggagccctggcagagaattctatatggataaagtgctgatggagtttgtggaaaacagtaggaaagcaatgaaagaagctggtaagggaggcgtcgctgattccagagagctaaagccgatgctgaagaaaaggtga

SEQ ID NO: 10605 - DNA, 244 bp, synthetic construct
  misc_feature 1..244: note = Synthetic polypeptide
  source 1..244: mol_type = other DNA
gcgggcgggggtcggcgccccgagggctgcggggagccgccgggggtccggggcgcagggcgtgcgggcctggccgggccctgggcgctgcctatggcacagccaagagcggtaccggcattgcggccatgtctgtcatgcggccggagcagatcatgaagtccatcatcccagtggtcatggctggcatcatcgccatctacggcctggtggtggcagtcctcatcgccaactccctgaatga

SEQ ID NO: 10606 - DNA, 467 bp, synthetic construct
  misc_feature 1..467: note = Synthetic polypeptide
  source 1..467: mol_type = other DNA
gcgggcgggggtcggcgccccgagggctgcggggagccgccgggggtccggggcgcagggcgtgcgggcctggccgggccctgggcgctgcctatggcacagccaagagcggtaccggcattgcggccatgtctgtcatgcggccggagcagatcatgaagtccatcatcccagtggtcatggctggcatcatcgccatctacggcctggtggtggcagtcctcatcgccaactccctgaatgacgacatcagcctctacaagagcttcctccagctgggcgccggcctgagcgtgggcctgagcggcctggcagccggctttgccatcggcatcgtgggggacgctggcgtgcggggcaccgcccagcagccccgactattcgtgggcatgatcctgattctcatcttcgccgaggtgctcggcctctacggtctcatcgtcgccctcatcctctccacaaagtag

SEQ ID NO: 10607 - DNA, 1744 bp, synthetic construct
  misc_feature 1..1744: note = Synthetic polypeptide
  source 1..1744: mol_type = other DNA
cccggacgccgcccccgaacgattaaagcagaagctgggatgtggggcccaggtggaggagtctgtgctcaacctgggcaaattccacagcatcgttcgtctggtggccttttgtccctttgcctcatcccaggttgccttggaaaatgccaacgccgtgtctgaaggggttgttcatgaggacctccgcctgctcttggagacccacctgccgtccaaaaagaagaaagtactcttgggagttggggatcccaagattggtgccgcaatacaggaggagttagggtacaactgccagactggaggagtcatagctgagatcctgcgaggagttcgtctgcacttccacaatctggtgaagggtctgaccgatctgtcagcttgtaaagcacagctggggctgggacacagctattcccgtgccaaagttaagtttaatgtgaaccgggtggacaatatgatcatccagtccattagcctcctggaccagctggataaggacatcaataccttctctatgcgtgtcagggagtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatgggcatggacatatctgccattgacttgataaacatcgagagcttctccagtcgtgtggtgtctttatctgaataccgccagagcctacacacttacctgcgctccaagatgagccaagtagcccccagcctgtcagccctaattggggaagcggtaggtgcacgtctcatcgcacatgctggcagcctcaccaacctggccaagtatccagcatccacagtgcagatccttggggctgaaaaggccctgttcagagccctgaagacaaggggtaacactccaaaatatggactcattttccactccaccttcattggccgagcagctgccaagaacaaaggccgcatctcccgatacctggcaaacaaatgcagtattgcctcacgaatcgattgcttctctgaggtgcccacgagtgtattcggggagaagcttcgagaacaagttgaagagcgactgtccttctatgagactggagagataccacgaaagaatctggatgtcatgaaggaagcaatggttcaggcagaggaagcggctgctgagattactaggaagctggagaaacaggagaagaaacgcttaaagaaggaaaagaaacggctggctgcacttgccctcgcgtcttcagaaaacagcagtagtactccagaggagtgtgaggagatgagtgaaaaacccaaaaagaagaaaaagcaaaagccccaggaggttcctcaggagaatggaatggaagacccatctatctctttctccaaacccaagaaaaagaaatctttttccaaggaggagttgatgagtagcgatcttgaagagaccgctggcagcaccagtattcccaagaggaagaagtctacacccaaggaggaaacagttaatgaccctgaggaggcaggccacagaagtggctccaagaaaaagaggaaattctccaaagaggagccggtcagcagtgggcctgaagaggcggttggcaagagcagctccaagaagaagaaaaagttccataaagcatcccaggaagattag

SEQ ID NO: 10608 - DNA, 803 bp, synthetic construct
  misc_feature 1..803: note = Synthetic polypeptide
  source 1..803: mol_type = other DNA
cccggacgccgcccccgaacgattaaagcagaagctgggatgtggggcccaggtggaggagtctgtgctcaacctgggcaaattccacagcatcgttcgtctggtggccttttgtccctttgcctcatcccaggttgccttggaaaatgccaacgccgtgtctgaaggggttgttcatgaggacctccgcctgctcttggagacccacctgccgtccaaaaagaagaaagtactcttgggagttggggatcccaagattggtgccgcaatacaggaggagttagggtacaactgccagactggaggagtcatagctgagatcctgcgaggagttcgtctgcacttccacaatctggtgaagggtctgaccgatctgtcagcttgtaaagcacagctggggctgggacacagctattcccgtgccaaagttaagtttaatgtgaaccgggtggacaatatgatcatccagtccattagcctcctggaccagctggataaggacatcaataccttctctatgcgtgtcaggcagagtaggtgtggagaaggcaaggctgtagctctatggtttttgatgaagcagctgggccagggagtgactgtggctctttgcagggagtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatgg

SEQ ID NO: 10609 - DNA, 1595 bp, synthetic construct
  misc_feature 1..1595: note = Synthetic polypeptide
  source 1..1595: mol_type = other DNA
tgcagccgaagttgcttcagggctaccagggcggtggaggtttgggggtggggcgaattttgcagaaacctctttgctcctctgctaggcatttgaaaacgtggcttgggtcaggcacaggcgcccccaccccccgggtcccaggtgttcttagattttccttggcattgatggaaaggtcactcgttccccacttccgccggcacatgcctggacaccaccatttgtttcgccgtcgccccgtatgcctccggtgacacacattcacaccatctgctgtgggatacgccagtgccacgcgtggtcacatggtctgcacctggcattcgccactgttcctgtttgcacgagccctgtaaagcgcggtcggctttccggagccccagggcttttagaagaggggtaggccactgctctttcaaaggaggagggaggcagagggttgaaggatcagtgaatttgcagctgacactaggcctcgagacctatgggatcattctttgctgcagcgaggccctgcctgcctcagcagatgtggcgagcccatcctatctcactcggtgggggccaaaatgggatctgaaggggtgtcctgagaacacagcaggcgtcctgaagctccccctccctccctcggtggaagtcagctcaaggagttcctgaggacaggactcctgggggtttggccctgggacaggacaagacacccgcggtcccctctcccacgctgccccaaactggaggccggatccagccgccgccgcgcctgcagctggagcctcgctgccgccgcgctgcggtggcgttctttaaaggggacccagcctgactgccaggagcagagttcgagtcgggccagccaatgcgcatgcgcgaggcgggagcggcttctcccgtcacagtggttcccacggttgtcttagaaagcagtcctcgaggcatggcaaagtaggagccctccatggcagtgcttgagtgtcggggctctgagtctccggcctgacctctccacgtggtcgacgggaacgtccccagatgccaggattcgcaaagggctgaccaggatggcgaaaccttaggcagagtccggggaaagcagcacggcatcccagcctcaggcctgcccggacggtgttggttgggaaatggtgcgagaactttggatgtggaacgtggaggaggaggaacacgaagtggggatctgcacttggggtggtcagcactgcggatgcccagcaaagtcactgcctggtccacatcccggaggggtctctgcgcctcagtcggcatcgcagctgatggtgaaacttttggtgtggcagaagagtgtccacaaacttcggaaggtatccgctacatcctccatagccgtgtatccctgcccagggcaatcttctgggggagcggaaagtcctgctcccgggccagggctggctggctggagccacttgtgcggcgcagccctggcggaggttcaggcggccccggtgtcgcaagcggctgtgagtgatgcctccctggggccggagtggtcccaggaaggctgcagaccagggctgaccagcgggcagcatggtggccgcgatggaaggtga

SEQ ID NO: 10610 - DNA, 1433 bp, synthetic construct
  misc_feature 1..1433: note = Synthetic polypeptide
  source 1..1433: mol_type = other DNA
tgcagccgaagttgcttcagggctaccagggcggtggaggtttgggggtggggcgaattttgcagaaacctctttgctcctctgctaggcatttgaaaacgtggcttgggtcaggcacaggcgcccccaccccccgggtcccaggtgttcttagattttccttggcattgatggaaaggtcactcgttccccacttccgccggcacatgcctggacaccaccatttgtttcgccgtcgccccgtatgcctccggtgacacacattcacaccatctgctgtgggatacgccagtgccacgcgtggtcacatggtctgcacctggcattcgccactgttcctgtttgcacgagccctgtaaagcgcggtcggctttccggagccccagggcttttagaagaggggtaggccactgctctttcaaaggaggagggaggcagagggttgaaggatcagtgaatttgcagctgacactaggcctcgagacctatgggatcattctttgctgcagcgaggccctgcctgcctcagcagatgtggcgagcccatcctatctcactcggtgggggccaaaatgggatctgaaggggtgtcctgagaacacagcaggcgtcctgaagctccccctccctccctcggtggaagtcagctcaaggagttcctgaggacaggactcctgggggtttggccctgggacaggacaagacacccgcggtcccctctcccacgctgccccaaactggaggccggatccagccgccgccgcgcctgcagctggagcctcgctgccgccgcgctgcggtggcgttctttaaaggggacccagcctgactgccaggagcagagttcgagtcgggccagccaatgcgcatgcgcgaggcgggagcggcttctcccgtcacagtggttcccacggttgtcttagaaagcagtcctcgaggcatggcaaagtaggagccctccatggcagtgcttgagtgtcggggctctgagtctccggcctgacctctccacgtggtcgacgggaacgtccccagatgccaggattcgcaaagggctgaccaggatggcgaaaccttaggcagagtccggggaaagcagcacggcatcccagcctcaggcctgcccggacggtgttggttgggaaatggtgcgagaactttggatgtggaacgtggaggaggaggaacacgaagtggggatctgcacttggggtggtcagcactgcggatgcccagcaaagtcactgcctggtccacatcccggaggggtctctgcgcctcagtcggcatcgcagctgatggtgaaacttttggtgtggcagaagagtgtccacaaacttcggaaggtatccgctacatcctccatagccgtgtatccctgcccagggcaatcttctgggggagcggaaagtcctgctcccgggccagggctg

SEQ ID NO: 10611 - DNA, 1833 bp, synthetic construct; identical to SEQ ID NO: 8747
  misc_feature 1..1833: note = Synthetic polypeptide
  source 1..1833: mol_type = other DNA

SEQ ID NO: 10612 - DNA, 1755 bp, synthetic construct; identical to SEQ ID NO: 8748
  misc_feature 1..1755: note = Synthetic polypeptide
  source 1..1755: mol_type = other DNA

SEQ ID NO: 10613 - DNA, 89 bp, synthetic construct; identical to SEQ ID NO: 9056
  misc_feature 1..89: note = Synthetic polypeptide
  source 1..89: mol_type = other DNA

SEQ ID NO: 10614 - DNA, 267 bp, synthetic construct; identical to SEQ ID NO: 9057
  misc_feature 1..267: note = Synthetic polypeptide
  source 1..267: mol_type = other DNA

SEQ ID NO: 10615 - DNA, 739 bp, synthetic construct; identical to SEQ ID NO: 9058
  misc_feature 1..739: note = Synthetic polypeptide
  source 1..739: mol_type = other DNA

SEQ ID NO: 10616 - DNA, 460 bp, synthetic construct; identical to SEQ ID NO: 9059
  misc_feature 1..460: note = Synthetic polypeptide
  source 1..460: mol_type = other DNA

SEQ ID NO: 10617 - DNA, 147 bp, synthetic construct; identical to SEQ ID NO: 9060
  misc_feature 1..147: note = Synthetic polypeptide
  source 1..147: mol_type = other DNA

SEQ ID NO: 10618 - DNA, 147 bp, synthetic construct; identical to SEQ ID NO: 9061
  misc_feature 1..147: note = Synthetic polypeptide
  source 1..147: mol_type = other DNA

SEQ ID NO: 10619 - DNA, 185 bp, synthetic construct; identical to SEQ ID NO: 8880
  misc_feature 1..185: note = Synthetic polypeptide
  source 1..185: mol_type = other DNA

SEQ ID NO: 10620 - DNA, 142 bp, synthetic construct; identical to SEQ ID NO: 8881
  misc_feature 1..142: note = Synthetic polypeptide
  source 1..142: mol_type = other DNA

SEQ ID NO: 10621 - DNA, 869 bp, synthetic construct
  misc_feature 1..869: note = Synthetic polypeptide
  source 1..869: mol_type = other DNA
gtttttttattttagctgagtgatcatagttcctgctctattagccattcatctggagaaacaaatgagggtgttttgaatgctgtatcaaatgcctggggggcattccctatgcctctctgattgccaccatcctgctctatgcgggtgttgccctgttctgtggctgcggtcatgaagcgctttctggaactgtcaacattctgcaaacctactttgagatggcaagaactgctggagacacactggatgtttttaccatgattgacatctttaagtatgtgatctacggcatcgcagctgcgttctttgtgtatggcattttgctgatggtggaaggtttcttcacaactggggccatcaaagatctctatggggatttcaaaatcaccacttgtggcagatgtgtgagcgcttggttcattatgctgacatatcttttcatgttggcctggctgggagtcacggctttcacctcactgccagtttacatgtacttcaatctgtggaccatctgccggaacaccacattagtggagggagcaaatctctgcttggaccttcgtcagtttggaattgtgacaattggagaggaaaagaaaatttgtactgtctctgagaatttcttgaggatgtgcgaatctactgagctgaacatgaccttccacttgtttattgtggcacttgctggagctggggcagcagtcattgctatggttcactaccttatggttctgtctgccaactgggcctatgtgaaagacgcctgccggatgcagaagtatgaagacatcaagtcgaaggaagagcaagagcttcatgacatccactctactcgctccaaagagcggctcaatgcatacacataa

SEQ ID NO: 10622 - DNA, 711 bp, synthetic construct
  misc_feature 1..711: note = Synthetic polypeptide
  source 1..711: mol_type = other DNA
gtttttttattttagctgagtgatcatagttcctgctctattagccattcatctggagaaacaaatgagggtgttttgaatgctgtatcaaatgcctggggggcattccctatgcctctctgattgccaccatcctgctctatgcgggtgttgccctgttctgtggctgcggtcatgaagcgctttctggaactgtcaacattctgcaaacctactttgagatggcaagaactgctggagacacactggatgtttttaccatgattgacatctttaagtatgtgatctacggcatcgcagctgcgttctttgtgtatggcattttgctgatggtggaaggtttcttcacaactggggccatcaaagatctctatggggatttcaaaatcaccacttgtggcagatgtgtgagcgcttggttcattatgctgacatatcttttcatgttggcctggctgggagtcacggctttcacctcactgccagtttacatgtacttcaatctgtggaccatctgccggaacaccacattagtggagggagcaaatctctgcttggaccttcgtcagtttggaattgtgacaattggagaggaaaagaaaatttgtactgtctctgagaatttcttgaggatgtgcgaatctactgagctgaacatgaccttccacttgtttattgtggcacttgctggagctggggcagcagtcattg

SEQ ID NO: 10623 - DNA, 419 bp, synthetic construct
  misc_feature 1..419: note = Synthetic polypeptide
  source 1..419: mol_type = other DNA
gtttttttattttagctgagtgatcatagttcctgctctattagccattcatctggagaaacaaatgagggtgttttgaatgctgtatcaaatgcctggggggcattccctatgcctctctgattgccaccatcctgctctatgcgggtgttgccctgttctgtggctgcggtcatgaagcgctttctggaactgtcaacattctgcaaacctactttgagatggcaagaactgctggagacacactggatgtttttaccatgattgacatctttaagtatgtgatctacggcatcgcagctgcgttctttgtgtatggcattttgctgatggtggaaggtttcttcacaactggggccatcaaagatctctatggggatttcaaaatcaccacttgtggcagatgtgtgagcgcttgg

SEQ ID NO: 10624 - DNA, 252 bp, synthetic construct
  misc_feature 1..252: note = Synthetic polypeptide
  source 1..252: mol_type = other DNA
gtttttttattttagctgagtgatcatagttcctgctctattagccattcatctggagaaacaaatgagggtgttttgaatgctgtatcaaatgcctggggggcattccctatgcctctctgattgccaccatcctgctctatgcgggtgttgccctgttctgtggctgcggtcatgaagcgctttctggaactgtcaacattctgcaaacctactttgagatggcaagaactgctggagacacactggatg

SEQ ID NO: 10625 - DNA, 68 bp, synthetic construct
  misc_feature 1..68: note = Synthetic polypeptide
  source 1..68: mol_type = other DNA
ttcatctagagatcgtaacagtacggacacagaagaacagttgcagtgatgtgcaggagagagactga

SEQ ID NO: 10626 - DNA, 1039 bp, synthetic construct
  misc_feature 1..1039: note = Synthetic polypeptide
  source 1..1039: mol_type = other DNA
ttcatctagagatcgtaacagtacggacacagaagaacagttgcagtgatgtgcaggagagagactgagaacacacagcattgagtcatcaggaaaactgaagatctcccctgaacaacactgggatttcactgcagaggacttgaaagaccttggagaaattggacgaggagcttatggttctgtcaacaaaatggtccacaaaccaagtgggcaaataatggcagttaaaagaattcggtcaacagtggatgaaaaagaacaaaaacaacttcttatggatttggatgtagtaatgcggagtagtgattgcccatacattgttcagttttatggtgcactcttcagagagggtgactgttggatctgtatggaactcatgtctacctcgtttgataagttttacaaatatgtatatagtgtattagatgatgttattccagaagaaattttaggcaaaatcactttagcaactgtgaaagcactaaaccacttaaaagaaaacttgaaaattattcacagagatatcaaaccttccaatattcttctggacagaagtggaaatattaagctctgtgacttcggcatcagtggacagcttgtggactctattgccaagacaagagatgctggctgtaggccatacatggcacctgaaagaatagacccaagcgcatcacgacaaggatatgatgtccgctctgatgtctggagtttggggatcacattgtatgagttggccacaggccgatttccttatccaaagtggaatagtgtatttgatcaactaacacaagtcgtgaaaggagatcctccgcagctgagtaattctgaggaaagggaattctccccgagtttcatcaactttgtcaacttgtgccttacgaaggatgaatccaaaaggccaaagtataaagagcttctgaaacatccctttattttgatgtatgaagaacgtgccgttgaggtcgcatgctatgtttgtaaaatcctggatcaaatgccagctactcccagctctcccatgtatgtcgattga

SEQ ID NO: 10627 - DNA, 1871 bp, synthetic construct
  misc_feature 1..1871: note = Synthetic polypeptide
  source 1..1871: mol_type = other DNA
agaatggcggagtggaaaagagtcctggatttgaagtaaacagatgagaattctagggatttatcaaagatgttcatgaagactcccttacagttgtttttgaaaataattggcaaccagaacgccaggttccatttaatgaagttagattaccaccaccacctgatataaaaaaagaaattagtgaaggagatgaagtagaggtatattcaagagcaaatgaccaagagccatgtgggtggtggttggctaaagttcggatgatgaaaggagaattttatgtcattgaatatgctgcttgtgacgctacttacaatgaaatagtcacatttgaacgacttcggcctgtcaatcaaaataaaactgtcaaaaaaaataccttctttaaatgcacagtggatgttcctgaggatttgagagaggcgtgtgctaatgaaaatgcacataaagattttaagaaagcagtaggagcatgcagaattttttaccatccagaaacaacacagctaatgatactgtctgccagtgaagcaactgtgaagagagtaaacatcttaagtgacatgcatttgcgaagtattcgtacgaagttgatgcttatgtccagaaatgaagaggccactaagcatttagaatgcacaaaacaacttgcagcagcttttcatgaggaatttgttgtgagagaagatttaatgggcctggcaataggaacacatggtagtaacatccagcaagctaggaaggttcctggagttaccgccattgagctagatgaagatactggaacattcagaatctacggagagagtgctgatgctgtaaaaaaggctagaggtttcttggaatttgtggaggattttattcaggttcctaggaatctcgttggaaaagtaattggaaaaaatggcaaagttattcaagaaatagtggacaaatctggtgtggttcgagtgagaattgaaggggacaatgaaaataaattacccagagaagacggtatggttccatttgtatttgttggcactaaagaaagcattggaaatgtgcaggttcttctagagtatcatattgcctatctaaaggaagtagaacagctaagaatggaacgcctacagattgatgaacagctgcgacagattggttctaggtcttatagcggaagaggcagaggtcgtcggggacctaattacacctccggttatggtacaaattctgagctgtctaacccctctgaaacggaatctgagcgtaaagacgagctgagtgattggtcattggcaggagaagatgatcgagacagccgacatcagcgtgacagcaggagacgcccaggaggaagaggcagaagtgtttcagggggtcgaggtcgtggtggaccacgtggtggcaaatcctccatcagttctgtgctcaaagatccagacagcaatccatacagcttacttgataatacagaatcagatcagactgcagacactgatgccagcgaatctcatcacagtactaaccgtcgtaggcggtctcgtagacgaaggactgatgaagatgctgttctgatggatggaatgactgaatctgatacagcttcagttaatgaaaatgggctagtcacagttgcagattatatttctagagctgagtctcagagcagacaaagaaacctcccaagggaaactttggctaaaaacaagaaagaaatggcaaaagatgtgattgaagagcatggtccttcagaaaaggcaataaacggcccaactagtgcttctggcgatgacatttctaagctacagcgtactccaggagaagaaaagattaataccttaaaagaagaaaacactcaagaagcagcagtcctgaatggtgtttcataa

SEQ ID NO: 10628 - DNA, 1625 bp, synthetic construct
  misc_feature 1..1625: note = Synthetic polypeptide
  source 1..1625: mol_type = other DNA
agaatggcggagtggaaaagagtcctggatttgaagtaaacagatgagaattctagggatttatcaaagatgttcatgaagactcccttacagttgtttttgaaaataattggcaaccagaacgccaggttccatttaatgaagttagattaccaccaccacctgatataaaaaaagaaattagtgaaggagatgaagtagaggtatattcaagagcaaatgaccaagagccatgtgggtggtggttggctaaagttcggatgatgaaaggagaattttatgtcattgaatatgctgcttgtgacgctacttacaatgaaatagtcacatttgaacgacttcggcctgtcaatcaaaataaaactgtcaaaaaaaataccttctttaaatgcacagtggatgttcctgaggatttgagagaggcgtgtgctaatgaaaatgcacataaagattttaagaaagcagtaggagcatgcagaattttttaccatccagaaacaacacagctaatgatactgtctgccagtgaagcaactgtgaagagagtaaacatcttaagtgacatgcatttgcgaagtattcgtacgaagttgatgcttatgtccagaaatgaagaggccactaagcatttagaatgcacaaaacaacttgcagcagcttttcatgaggaatttgttgtgagagaagatttaatgggcctggcaataggaacacatggtagtaacatccagcaagctaggaaggttcctggagttaccgccattgagctagatgaagatactggaacattcagaatctacggagagagtgctgatgctgtaaaaaaggctagaggtttcttggaatttgtggaggattttattcaggttcctaggaatctcgttggaaaagtaattggaaaaaatggcaaagttattcaagaaatagtggacaaatctggtgtggttcgagtgagaattgaaggggacaatgaaaataaattacccagagaagacggtatggttccatttgtatttgttggcactaaagaaagcattggaaatgtgcaggttcttctagagtatcatattgcctatctaaaggaagtagaacagctaagaatggaacgcctacagattgatgaacagctgcgacagattggttctaggtcttatagcggaagaggcagaggtcgtcggggacctaattacacctccggttatggtacaaattctgagctgtctaacccctctgaaacggaatctgagcgtaaagacgagctgagtgattggtcattggcaggagaagatgatcgagacagccgacatcagcgtgacagcaggagacgcccaggaggaagaggcagaagtgtttcagggggtcgaggtcgtggtggaccacgtggtggcaaatcctccatcagttctgtgctcaaagatccagacagcaatccatacagcttacttgataatacagaatcagatcagactgcagacactgatgccagcgaatctcatcacagtactaaccgtcgtaggcggtctcgtagacgaaggactgatgaagatgctgttctgatggatggaatgactgaatctgatacagcttcagttaatgaaaatgggctaggcaaaagatgtgattga

SEQ ID NO: 10629 - DNA, 446 bp, synthetic construct
  misc_feature 1..446: note = Synthetic polypeptide
  source 1..446: mol_type = other DNA
agaatggcggagtggaaaagagtcctggatttgaagtaaacagatgagaattctagggatttatcaaagatgttcatgaagactcccttacagttgtttttgaaaataattggcaaccagaacgccaggttccatttaatgaagttagattaccaccaccacctgatataaaaaaagaaattagtgaaggagatgaagtagaggtatattcaagagcaaatgaccaagagccatgtgggtggtggttggctaaagttcggatgatgaaaggagaattttatgtcattgaatatgctgcttgtgacgctacttacaatgaaatagtcacatttgaacgacttcggcctgtcaatcaaaataaaactgtcaaaaaaaataccttctttaaatgcacagtggatgttcctgaggatttgagagaggcgtgtgctaatgaaaatgcacat

SEQ ID NO: 10630 - DNA, 998 bp, synthetic construct; identical to SEQ ID NO: 8819
  misc_feature 1..998: note = Synthetic polypeptide
  source 1..998: mol_type = other DNA

SEQ ID NO: 10631 - DNA, 1469 bp, synthetic construct
  misc_feature 1..1469: note = Synthetic polypeptide
  source 1..1469: mol_type = other DNA
gccggaggggatggcttagtggtctaagcatcagatttgaaatacctagagtccctggaactgcaggtttgaatgtcagcagagtcaacccagctcatcattcttccaagccttcagtaagaaaaggtgtactaccaagaatgcttgaagaaattttgaagactagatttatggtgaagcagtcaatgaaggcttacaagcaagacagagccctgtcacgaatgcttgatgcgcgtcagttgggacttaagctgatagcaaatgtcacatttggctatacatctgctaatttttctgggagaatgccatgcattgaggttggcgatagtattgttcacaaagccagagagaccttggaacgagctattaaactggtgaatgataccaagaaatggggggctagggttgtatatggcgatactgacagtatgtttgtgctactgaaaggagccactaaggagcagtcttttaagattggtcaggaaattgccgaagctgtaactgctaccaatcctaaaccagtgaaattgaagtttgaaaaggtatatttgccctgtgttttacaaacaaaaaagaggtatgtgggttacatgtatgaaacactggatcagaaggacccagtatttgatgcaaaaggaatagaaacagtcagaagagattcctgccctgctgtttctaagatacttgagcgttctctaaagctgctatttgaaacgagagatataagtctaattaaacagtatgttcagcgacaatgtatgaagcttctggaaggaaaggccagcatacaagactttatctttgccaaggaatacagaggaagtttttcttataaaccaggagcttgtgtgccagcccttgaacttacaaggaaaatgctgacttatgaccggcgctctgagcctcaggttggggagcgagtgccatacgtcatcatttatgggacccccggagtaccacttatccagcttgtaaggcgcccagtggaagtcctgcaggacccaactctgagactgaatgctacttactatattaccaagcaaatccttccacccttggcaagaatcttctcacttattggtattgatgtcttcagctggtatcatgaattaccaaggatccataaagctaccagctcctcgcgaagtgaacctgaagggcggaaaggcactatttcacaatattttactaccttacactgtcctgtgtgtgatgacctaactcagcatggcatctgtagtaaatgtcggagccaacctcagcatgttgcagtcatcctcaaccaagaaatccgggagttggaacgtcaacaggagcaacttgtaaagatatgcaagaactgtacaggttgctttgatcgacacatcccatgtgtttctctgaactgcccagtacttttcaaactctcccgagtaaatagagaattgtccaaggcaccatatctccggcagttattagaccagttttaa

SEQ ID NO: 10632 - DNA, 1768 bp, synthetic construct; identical to SEQ ID NO: 9894
  misc_feature 1..1768: note = Synthetic polypeptide
  source 1..1768: mol_type = other DNA

SEQ ID NO: 10633 - DNA, 955 bp, synthetic construct; identical to SEQ ID NO: 9895
  misc_feature 1..955: note = Synthetic polypeptide
  source 1..955: mol_type = other DNA

SEQ ID NO: 10634 - DNA, 978 bp, synthetic construct; identical to SEQ ID NO: 9896
  misc_feature 1..978: note = Synthetic polypeptide
  source 1..978: mol_type = other DNA

SEQ ID NO: 10635 - DNA, 871 bp, synthetic construct; identical to SEQ ID NO: 9897
  misc_feature 1..871: note = Synthetic polypeptide
  source 1..871: mol_type = other DNA

SEQ ID NO: 10636 - DNA, 1342 bp, synthetic construct
  misc_feature 1..1342: note = Synthetic polypeptide
  source 1..1342: mol_type = other DNA
gaaacaacctttatgtccaagaattggaggactggttggataaaatgatagtcatatgggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagctctcaagctctcgcctttcctatcagcctgctgccctgggcgttggatcagctgacctggcttatccagtagtgtttgctgctggcttaaatgctacacaccctcaccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaa

SEQ ID NO: 10637 - DNA, 1231 bp, synthetic construct
  misc_feature 1..1231: note = Synthetic polypeptide
  source 1..1231: mol_type = other DNA
gaaacaacctttatgtccaagaattggaggactggttggataaaatgatagtcatatgggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaa

SEQ ID NO: 10638 - DNA, 145 bp, synthetic construct
  misc_feature 1..145: note = Synthetic polypeptide
  source 1..145: mol_type = other DNA
gaaacaacctttatgtccaagaattggaggactggttggataaaatgatagtcatatgggagattccatggagctggaaatatggtgtcttgaaatgaatgaaaagtgtgataaagaaatcaaagtttcctacacggtgtacaac

SEQ ID NO: 10639 - DNA, 1441 bp, synthetic construct
  misc_feature 1..1441: note = Synthetic polypeptide
  source 1..1441: mol_type = other DNA
gaaacaacctttatgtccaagaattggaggactggttggataaaatgatagtcatatgggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagtgtgtgtttactgtcacaaaggcacattttcagacccctactcctgtggtgacggacaccctgagggtccccatggcaggactggccttttcccatcaactctcaagctctcgcctttcctatcagcctgctgccctgggcgttggatcagctgacctggcttatccagtagtgtttgctgctggcttaaatgctacacaccctcaccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaa

SEQ ID NO: 10640 - DNA, 384 bp, synthetic construct
  misc_feature 1..384: note = Synthetic polypeptide
  source 1..384: mol_type = other DNA
gaaacaacctttatgtccaagaattggaggactggttggataaaatgatagtcatatgggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccag

SEQ ID NO: 10641 - DNA, 1476 bp, synthetic construct
  misc_feature 1..1476: note = Synthetic polypeptide
  source 1..1476: mol_type = other DNA
tgtaggattccactgatatgacgtacctggagtcagcagagccacagagacagatggtagaatgcccgcagggccccggaccccggcttccaggagcgcttcttccagcagcgtctggaccacttcaacttcgagcgcttcggcaacaagaccttccctcagcgcttcctggtgtcggacaggttctgggtccggggcgaggggcccatcttcttctacactgggaacgagggcgacgtgtgggccttcgccaacaactcggccttcgtcgcggagctggcggccgagcggggggctctactggtcttcgcggagcaccgctactacgggaagtcgctgccgttcggtgcgcagtccacgcagcgcgggcacacggagctgctgacggtggagcaggccctggccgacttcgcagagctgctccgcgcgctacgacgcgacctcggggcccaggatgcccccgccatcgccttcggtggaagttatggggggatgctcagtgcctacctgaggatgaagtatccccacctggtggcgggggcgctggcggccagcgcgcccgttctagctgtggcaggcctcggcgactccaaccagttcttccgggacgtcacggcggactttgagggccagagtcccaaatgcacccagggtgtgcgggaagcgttccgacagatcaaggacttgttcctacagggagcctacgacacggtccgctgggagttcggcacctgccagccgctgtcagacgagaaggacctgacccagctcttcatgttcgcccggaatgccttcaccgtgctggccatgatggactacccctaccccactgacttcctgggtcccctccctgccaaccccgtcaaggtgggctgtgatcggctgctgagtgaggcccagaggatcacggggctgcgagcactggcagggctggtctacaacgcctcgggctccgagcactgctacgacatctaccggctctaccacagctgtgctgaccccactggctgcggcaccggccccgacgccagggcctgggactaccaggcctgcaccgagatcaacctgaccttcgccagcaacaatgtgaccgatatgttcccggacctgcccttcactgacgagctccgccagcggtactgcctggacacctggggcgtgtggccccggcccgactggctgctgaccagcttctgggggggtgatctcagagccgccagcaacatcatcttctccaacgggaacctggacccctgggcagggggcgggattcggaggaacctgagtgcctcagtcatcgccgtcaccatccaggggggagcgcaccacctcgacctcagagcctcccacccagaagatcctgcttccgtggttgaggcgcggaagctggaggccaccatcatcggcgagtgggtaaaggcagccaggcgtgagcagcagccagctctgcgtggggggcccagactcagcctctga

SEQ ID NO: 10642 - DNA, 381 bp, synthetic construct
  misc_feature 1..381: note = Synthetic polypeptide
  source 1..381: mol_type = other DNA
tgtaggattccactgatatgacgtacctggagtcagcagagccacagagacagatggtagaatgcccgcagggccccggaccccggcttccaggagcgcttcttccagcagcgtctggaccacttcaacttcgagcgcttcggcaacaagaccttccctcagcgcttcctggtgtcgggttctgggtccggggcgaggggcccatcttcttctacactgggaacgagggcgacgtgtgggccttcgccaacaactcggccttcgtcgcggagctggcggccgagcggggggctctactggtcttcgcggagcaccgctactacgggaagtcgctgccgttcggtgcgcagtccacgcagcgcgggcacacggagctgctga

SEQ ID NO: 10643 - DNA, 823 bp, synthetic construct
  misc_feature 1..823: note = Synthetic polypeptide
  source 1..823: mol_type = other DNA
tgtaggattccactgatatgacgtacctggagtcagcagagccacagagacagatggtagaatgcccgcagggccccggaccccggcttccaggagcgcttcttccagcagcgtctggaccacttcaacttcgagcgcttcggcaacaagaccttccctcagcgcttcctggtgtcggacaggttctgggtccggggcgaggggcccatcttcttctacactgggaacgagggcgacgtgtgggccttcgccaacaactcggccttcgtcgcggagctggcggccgagcggggggctctactggtcttcgcggagcaccgctactacgggaagtcgctgccgttcggtgcgcagtccacgcagcgcgggcacacggagctgctgacggtggagcaggccctggccgacttcgcagagctgctccgcgcgctacgacgcgacctcggggcccaggatgcccccgccatcgccttcggtggaaggaagccctcccacctgtcctcccagccacctgctcagcttggatgtgcggccacactagcggcctttcccagtgagagctgcacccgcacctggcccagggttggaatttgtgggtctcagaagtgtcgtcctccttgtggcacctgtgggcccctgaggaggaaaagaggaaatggggtgttgggggcagcagccctaaccctgtgtccctcacccagttatggggggatgctcagtgcctacctgaggatgaagtatccccacctggtggcgggggcgctggcggccagcgcgcccgttctagctgtggcaggcctcggcgactccaaccagttcttcc

SEQ ID NO: 10644 - DNA, 818 bp, synthetic construct
  misc_feature 1..818: note = Synthetic polypeptide
  source 1..818: mol_type = other DNA
agagtctgcgtggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgatccacttcctcatgatactgtcttctaactgggcttacttaaaggatgcgagcaaaatgcaggcttaccaggatatcaaagcaaaggaagaacaggaactgcaagatatccagtctcggtcaaaagaacaactcaattcttacacataa

SEQ ID NO: 10645 - DNA, 749 bp, synthetic construct
  misc_feature 1..749: note = Synthetic polypeptide
  source 1..749: mol_type = other DNA
agagtctgcgtggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgctgatctacatgatggctactacatataactatgcggttttgaagtttaagagtcgggaagattgctgcactaaattctaa

SEQ ID NO: 10646 - DNA, 272 bp, synthetic construct
  misc_feature 1..272: note = Synthetic polypeptide
  source 1..272: mol_type = other DNA
agagtctgcgtggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggca

SEQ ID NO: 10647 - DNA, 354 bp, synthetic construct; identical to SEQ ID NO: 8772
  misc_feature 1..354: note = Synthetic polypeptide
  source 1..354: mol_type = other DNA

SEQ ID NO: 10648 - DNA, 354 bp, synthetic construct; identical to SEQ ID NO: 8773
  misc_feature 1..354: note = Synthetic polypeptide
  source 1..354: mol_type = other DNA

SEQ ID NO: 10649 - DNA, 871 bp, synthetic construct; identical to SEQ ID NO: 437
  misc_feature 1..871: note = Synthetic polypeptide
  source 1..871: mol_type = other DNA

SEQ ID NO: 10650 - DNA, 421 bp, synthetic construct; identical to SEQ ID NO: 441
  misc_feature 1..421: note = Synthetic polypeptide
  source 1..421: mol_type = other DNA

SEQ ID NO: 10651 - DNA, 638 bp, synthetic construct; identical to SEQ ID NO: 442
  misc_feature 1..638: note = Synthetic polypeptide
  source 1..638: mol_type = other DNA

SEQ ID NO: 10652 - DNA, 337 bp, synthetic construct; identical to SEQ ID NO: 443
  misc_feature 1..337: note = Synthetic polypeptide
  source 1..337: mol_type = other DNA

SEQ ID NO: 10653 - DNA, 1142 bp, synthetic construct
  misc_feature 1..1142: note = Synthetic polypeptide
  source 1..1142: mol_type = other DNA
gctacctcctgctcatcttttgattctcactcagacttcacctactccaggaagccttccttgacctctgacctccctgggactggattgggctccctcttgtgtgctcccacagcaaccatcactctgaactgtgattgctggttactaatctgtcttgagcaccaccgtatccctccctgtgcctgatgagcaacaagcgttccaacagcttccgccaagccatcctgcagggcaaccgcaggctaagcagcaaggccctgctggaggagaaggggctgagcctctcgcagcgacttatccgccatgtggcctatgagaccctgccccgggaaattgaccgcaagtggtactatgacagctacacctgctgccccccaccctggttcatgatcacagtcacgctgctggaggttgcctttttcctctacaatggggtgtcactaggtcaatttgtactgcaggtaactcatccacgttacttgaagaactccctggtttaccacccacagctgcgagcacaggtttggcgctacctgacatacatcttcatgcatgcagggatagaacacctgggactcaatgtggtgctgcagctgctggtgggggtgcccctggagatggtgcatggagccacccgaattgggcttgtctacgtggccggtgttgtggcagaactggtcaggcatgaagtgccagttcaagctgctgcggatggctgtggcccttatctgtatgagcatggagtttgggcgggccgtgtggctccgcttccacccgtcggcctatcccccgtgccctcacccaagctttgtggcgcacttgggtggcgtggccgtgggcatcaccctgggcgtggtggtcctgaggaactacgagcagaggctccaggaccagtcactgtggtggatttttgtggccatgtacaccgtcttcgtgctgttcgctgtcttctggaacatctttgcctacaccctgctggacttaaagctgccgcctcccccctgagggctggaggcccaaggtcggggaggggagggaaaagcagcacccacagggagcgcctgcgaggtttcttctcatcaccagctcagctaggccgggcagacaaggacagaagactctgggccactgtaatgttt

SEQ ID NO: 10654 - DNA, 1109 bp, synthetic construct
  misc_feature 1..1109: note = Synthetic polypeptide
  source 1..1109: mol_type = other DNA
gctacctcctgctcatcttttgattctcactcagacttcacctactccaggaagccttccttgacctctgacctccctgggactggattgggctccctcttgtgtgctcccacagcaaccatcactctgaactgtgattgctggttactaatctgtcttgagcaccaccgtatccctccctgtgcctgatgagcaacaagcgttccaacagcttccgccaagccatcctgcagggcaaccgcaggctaagcagcaaggccctgctggaggagaaggggctgagcctctcgcagcgacttatccgccatgtggcctatgagaccctgccccgggaaattgaccgcaagtggtactatgacagctacacctgctgccccccaccctggttcatgatcacagtcacgctgctggaggttgcctttttcctctacaatggggtgtcactaggtcaatttgtactgcaggtaactcatccacgttacttgaagaactccctggtttaccacccacagctgcgagcacaggtttggcgctacctgacatacatcttcatgcatgcagggatagaacacctgggactcaatgtggtgctgcagctgctggtgggggtgcccctggagatggtgcatggagccacccgaattgggcttgtctacgtggccggtgttgtggcagggtccttggcagtgtctgtggctgacatgaccgctccagtcgtgggctcttctggaggggtgtatgctctcgtctctgcccatctggccaacattgtcatgaactggtcaggcatgaagtgccagttcaagctgctgcggatggctgtggcccttatctgtatgagcatggagtttgggcgggccgtgtggctccgcttccacccgtcggcctatcccccgtgccctcacccaagctttgtggcgcacttgggtggcgtggccgtgggcatcaccctgggcgtggtggtcctgaggaactacgagcagaggctccaggaccagtcactgtggtggatttttgtggccatgtacaccgtcttcgtgctgttcgctgtcttctggaacatctttgcctacaccctgctggacttaaagctgccgcctcccccctga

SEQ ID NO: 10655 - DNA, 433 bp, synthetic construct
  misc_feature 1..433: note = Synthetic polypeptide
  source 1..433: mol_type = other DNA
caaggctgctgcgtgtgatcgtggagatgtcccctgcaccaggatgctggccacaggggaggagcaggtgcggacccacgaggccaagctgaaggccatggcaagtgagctgcgggagcaccgggccgcccagctgggcaagaagggccggggcaaggaggctgaagagcagcggcagaaggaggcctacctggagtttgagaaatcccgctacagcacctatgcagcgctgcttcgggtcaagctgaaggcaggcagtgaggagctggatgcagtggaggcagcactggcccaggccgggagcacagaggatggactccctccttctcactccagtccctccctgcagcccaaaccctccagccagccccgggctcagcgtcacagctcagagcctcggccaggggcaggcagtgggcggcggaagccctga

SEQ ID NO: 10656 - DNA, 525 bp, synthetic construct; identical to SEQ ID NO: 9033
  misc_feature 1..525: note = Synthetic polypeptide
  source 1..525: mol_type = other DNA

SEQ ID NO: 10657 - DNA, 342 bp, synthetic construct; identical to SEQ ID NO: 9034
  misc_feature 1..342: note = Synthetic polypeptide
  source 1..342: mol_type = other DNA

SEQ ID NO: 10658 - DNA, 1295 bp, synthetic construct; identical to SEQ ID NO: 8778
  misc_feature 1..1295: note = Synthetic polypeptide
  source 1..1295: mol_type = other DNA

SEQ ID NO: 10659 - DNA, 738 bp, synthetic construct
  misc_feature 1..738: note = Synthetic polypeptide
  source 1..738: mol_type = other DNA
acggtttgaagccaggactgctgggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggccccagctggagccaccgtccctcccaggagccgccgggtttgctccaaggtcaggtgtgtgacccgctcgtggagcccctgtaaggttgagaggcggatctgggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctga

SEQ ID NO: 10660 - DNA, 633 bp, synthetic construct
  misc_feature 1..633: note = Synthetic polypeptide
  source 1..633: mol_type = other DNA
acggtttgaagccaggactgctgggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctga

SEQ ID NO: 10661 - DNA, 1009 bp, synthetic construct
  misc_feature 1..1009: note = Synthetic polypeptide
  source 1..1009: mol_type = other DNA
gaggcagtctggtggtctggttagagtgctgctcctggagccggacacctgggcacgaagctcagcccccacccctcaggtgcagtgccatacttacactgggtactgctggtgtgtcaccccggatgggaagcccatcagtggctcttctgtgcagaataaaactcctgtatgttcaggttcagtcaccgacaagcccttgagccagggtaactcaggaaggaaagatgacgggtctaagccgacacccacgatggagacccagccggtgttcgatggagatgaaatcacagccccaactctatggattaaacacttggtgatcaaggactccaaactgaacaacaccaacataagaaattcagagaaagtctattcgtgtgaccaggagaggcagagtgccctggaagaggcccagcagaatccccgtgagggtattgtcatccctgaatgtgcccctgggggactctataagccagtgcaatgccaccagtccactggctactgctggtgtgtgctggtggacacagggcgcccgctgcctgggacctccacacgctacgtgatgcccagttgtgagagcgacgccagggccaagactacagaggcggatgaccccttcaaggacagggagctaccaggctgtccagaagggaagaaaatggagtttatcaccagcctactggatgctctcaccactgacatggttcaggccattaactcagcagcgcccactggaggtgggaggttctcagagccagaccccagccacaccctggaggagcgggtagtgcactggtatttcagccagctggacagcaatagcagcaacgacattaacaagcgggagatgaagcccttcaagcgctacgtgaagaagaaagccaagcccaagaaatgtgcccggcgtttcaccgactactgtgacctgaacaaagacaaggtcatttcactgcctgagctgaagggctgcctgggtgttagcaaagaagtaggacgcctcgtctaa

SEQ ID NO: 10662 - DNA, 1006 bp, synthetic construct
  misc_feature 1..1006: note = Synthetic polypeptide
  source 1..1006: mol_type = other DNA
gaggcagtctggtggtctggttagagtgctgctcctggagccggacacctgggcacgaagctcagcccccacccctcaggtgcagtgccatacttacactgggtactgctggtgtgtcaccccggatgggaagcccatcagtggctcttctgtgcagaataaaactcctgtatgttcaggttcagtcaccgacaagcccttgagccagggtaactcaggaaggaaagatgacgggtctaagccgacacccacgatggagacccagccggtgttcgatggagatgaaatcacagccccaactctatggattaaacacttggtgatcaaggactccaaactgaacaacaccaacataagaaattcagagaaagtctattcgtgtgaccaggagaggcagagtgccctggaagaggcccagcagaatccccgtgagggtattgtcatccctgaatgtgcccctgggggactctataagccagtgcaatgccaccagtccactggctactgctggtgtgtgctggtggacacagggcgcccgctgcctgggacctccacacgctacgtgatgcccagttgtgagagcgacgccagggccaagactacagaggcggatgaccccttcaaggacagggagctaccaggctgtccagaagggaagaaaatggagtttatcaccagcctactggatgctctcaccactgacatggttcaggccattaactcagcagcgcccactggaggtgggaggttctcagagccagaccccagccacaccctggaggagcgggtagtgcactggtatttcagccagctggacagcaatagcagcaacgacattaacaagcgggagatgaagcccttcaagcgctacgtgaagaagaaagccaagcccaagaaatgtgcccggcgtttcaccgactactgtgacctgaacaaagacaaggtcatttcactgcctgagctgaagggctgcctgggtgttagcaaagaaggacgcctcgtctaa

SEQ ID NO: 10663 - DNA, 1639 bp, synthetic construct
  misc_feature 1..1639: note = Synthetic polypeptide
  source 1..1639: mol_type = other DNA
tgctgagaaccaggcagtgggagccctctgttccaggggcaggcacagaaggaggcattgtttgcagatgacagaaaaacaagaagagaacccagtctgcttttcactatcaccgtgtgctgacaattctaaacaatgtgggtgatttattgttctaagttccaaataactactgtggttatctgagcttcagtgggcacattcctatctcttgggctttactaacccttgtacttggaagttcatccagagaactcacaacgatactgggggctgctctcacatactcactttgcaggctctcccacctgtcaccctggcccttctctgcttggatggtgtcttcctctcctcagccgagaatgacttcgtccaccggatccaggaggaactggaccgctttctgctgcagaagcagctgtcaaaggttcttcttttccccccactctccagtcgcctccggtacctgatccatagaacagcagagaattttgatctcttgagcagcttctccgttggggagggctggaagaggaggacggtcatctgtcaccaggacatcagggtacccagttcggatggcctctctggcccctgccgcgctcctgcctcctgccccagcaggtaccacggtcctcggcccatctccaaccaaggagcagctgcggttccccgaggtgcccgggctggccggtggtatcgtggacgcaagcctgaccagcctttgtatgtgccccgggtgctgcgcaggcaggaagaatgggggctgacctctacctcggtgctcaagagagaggccccagctggcagggacccagaagagcctggagatgttggtgctggagaccccaactctgatcagggactccctgtgctgatgactcagggaacagaggacctaaagggcccaggacaaaggtgtgagaatgagccactgctggaccctgttggccctgagcctctggggcctgagagtcagtcagggaagggagacatggtggagatggccacacggtttgggtccaccctgcagctagacctggaaaaggggaaggagagtctgttggagaagaggctggtggcagaggaggaagaggacgaagaggaggtggaagaggatggccccagcagctgctcggaggacgattacagtgagctgctgcaggagatcacagacaacctgacgaagaaggagattcagatagagaagatccatttggacacatcctccttcgtggaggagctgcctggagagaaggaccttgcccacgtggtagagatctatgactttgaaccagcgctcaagacggaggacctgctggcaacgttttctgagttccaagagaaggggttcaggattcagtgggtggatgatactcacgcactcggcatctttccctgcctggcctcagctgcggaagccctgacccgggagttctcggtgctcaagatccggcccctcacacagggaaccaagcagtcaaagctcaaagccttgcagaggccaaaactcctgcgtctggtgaaggagaggccacagacaaatgcgactgtggcccggcggctggtggcccgggccctgggactccaacacaaaaagaaagagcggcctgctgtccggggtccgctgccgccctga

SEQ ID NO: 10664 - DNA, 215 bp, synthetic construct
  misc_feature 1..215: note = Synthetic polypeptide
  source 1..215: mol_type = other DNA
aggcctcagcttgaaggtcccctctcccaggaagccttccctaacttcctgccacactcacatagttcctggcacttgacacccagttgctgatgggtaaccgacgccactcgctgagccctgaggagtatatttttggagccctcaacatttacctagacatcatctatatcttcaccttcttcctgcagctttttggcactaaccgagaatga

SEQ ID NO: 10665 - DNA, 188 bp, synthetic construct
  misc_feature 1..188: note = Synthetic polypeptide
  source 1..188: mol_type = other DNA
aggcctcagcttgaaggtcccctctcccaggaagccttccctaacttcctgccacactcacatagttcctggcacttgacacccagttgctgatgggtaaccgacgccactcgctgagccctgaggagtatatttttggagccctcaacatttacctagacatcatctatatcttcaccttcttcctg

SEQ ID NO: 10666 - DNA, 146 bp, synthetic construct
  misc_feature 1..146: note = Synthetic polypeptide
  source 1..146: mol_type = other DNA
aggcctcagcttgaaggtcccctctcccaggaagccttccctaacttcctgccacactcacatagttcctggcacttgacacccagttgctgatgggtaaccgacgccactcgctgagccctgaggagtatatttttggagccctc

SEQ ID NO: 10667 - DNA, 2333 bp, synthetic construct; identical to SEQ ID NO: 7950
  misc_feature 1..2333: note = Synthetic polypeptide
  source 1..2333: mol_type = other DNA

SEQ ID NO: 10668 - DNA, 3042 bp, synthetic construct; identical to SEQ ID NO: 8824
  misc_feature 1..3042: note = Synthetic polypeptide
  source 1..3042: mol_type = other DNA

SEQ ID NO: 10669 - DNA, 3000 bp, synthetic construct
  misc_feature 1..3000: note = Synthetic polypeptide
  source 1..3000: mol_type = other DNA
gcaaaagtgtacctcaataataatgagttgacagcggtaccatccctgggcgctgcttcatcacatgtcgtctctctctttctgcagcacaacaagattcgcagcgtggaggggagccagctgaaggcctacctttccttagaagtgttagatctgagtttgaacaacatcacggaagtgcggaacacctgctttccacacggaccgcctataaaggagctcaacctggcaggcaatcggattggcaccctggagttgggagcatttgatggtctgtcacggtcgctgctaactcttcgcctgagcaaaaacaggatcacccagcttcctgtaagagcattcaagctacccaggctgacacaactggacctcaatcggaacaggattcggctgatagagggcctcaccttccaggggctcaacagcttggaggtgctgaagcttcagcgaaacaacatcagcaaactgacagatggggccttctggggactgtccaagatgcatgtgctgcacctggagtacaacagcctggtagaagtgaacagcggctcgctctacggcctcacggccctgcatcagctccacctcagcaacaattccatcgctcgcattcaccgcaagggctggagcttctgccagaagctgcatgagttggtcctgtccttcaacaacctgacacggctggacgaggagagcctggccgagctgagcagcctgagtgtcctgcgtctcagccacaattccatcagccacattgcggagggtgccttcaagggactcaggagcctgcgagtcttggatctggaccataacgagatttcgggcacaatagaggacacgagcggcgccttctcagggctcgacagcctcagcaagctgactctgtttggaaacaagatcaagtctgtggctaagagagcattctcggggctggaaggcctggagcacctgaaccttggagggaatgcgatcagatctgtccagtttgatgcctttgtgaagatgaagaatcttaaagagctccatatcagcagcgacagcttcctgtgtgactgccagctgaagtggctgcccccgtggctaattggcaggatgctgcaggcctttgtgacagccacctgtgcccacccagaatcactgaagggtcagagcattttctctgtgccaccagagagtttcgtgtgcgatgacttcctgaagccacagatcatcacccagccagaaaccaccatggctatggtgggcaaggacatccggtttacatgctcagcagccagcagcagcagctcccccatgacctttgcctggaagaaagacaatgaagtcctgaccaatgcagacatggagaactttgtccacgtccacgcgcaggacggggaagtgatggagtacaccaccatcctgcacctccgtcaggtcactttcgggcacgagggccgctaccaatgtgtcatcaccaaccactttggctccacctattcacataaggccaggctcaccgtgaatgtgttgccatcattcaccaaaacgccccacgacataaccatccggaccaccaccatggcccgcctcgaatgtgctgccacaggtcacccaaaccctcagattgcctggcagaaggatggaggcacggatttccccgctgcccgtgagcgacgcatgcatgtcatgccggatgacgacgtgtttttcatcactgatgtgaaaatagatgacgcaggggtttacagctgtactgctcagaactcagccggttctatttcagctaatgccaccctgactgtcctagagaccccatccttggtggtccccttggaagaccgtgtggtatctgtgggagaaacagtggccctccaatgcaaagccacggggaaccctccgccccgcatcacctggttcaagggggaccgcccgctgagcctcactgagcggcaccacttgacccctgacaaccagctcctggtggttcagaacgtggtggcagaggatgcgggccgatatacctgtgagatgtccaacaccctgggcacggagcgagctcacagccagctgagcgtcctgcccgcagcaggctgcaggaaggatgggaccacggtaggcatcttcaccattgctgtcgtgagcagcatcgtcctgacgtcactggtctgggtgtgcatcatctaccagaccaggaagaagagtgaagagtacagtgtcaccaacacagatgaaaccgtcgtgccaccagatgttccaagctacctctcttctcaggggaccctttctgaccgacaagaaaccgtggtcaggaccgagggtggccctcaggccaatgggcacattgagagcaatggtgtgtgtccaagagatgcaagccactttccagagcccgacactcacagcgttgcctgcaggcagccaaagctctgtgctgggtctgcgtatcacaaagagccgtggaaagcgatggagaaagctgaagggacacctgggccacataagatggaacacggtggccgggtcgtatgcagtgactgcaacaccgaagtggactgttactccaggggacaagccttccacccccagcctgtgtccagagacagcgcacagccaagtgcgccaaatggcccggagccgggtgggagtgaccaagagcattctccacatcaccagtgcagcaggactgccgctgggtcctgccccgagtgccaagggtcgctctaccccagtaaccacgatagaatgctgacggctgtgaagaaaaagccaatggcatctctagatgggaaaggggattcttcctggactttagcaaggttgtatcacccggactccacagagctacagcctgcatcttcattaacttcaggcagtccagagcgcgcggaagcccagtacttgcttgtttccaatggccacctccccaaagcatgtgacgccagtcccgagtccacgccactgacaggacagctccccgggaaacagagggtgccactgctgttggcaccaaaaagctag

SEQ ID NO: 10670 - DNA, 2931 bp, synthetic construct
  misc_feature 1..2931: note = Synthetic polypeptide
  source 1..2931: mol_type = other DNA
gcaaaagtgtacctcaataataatgagttgacagcggtaccatccctgggcgctgcttcatcacatgtcgtctctctctttctgcagcacaacaagattcgcagcgtggaggggagccagctgaaggcctacctttccttagaagtgttagatctgagtttgaacaacatcacggaagtgcggaacacctgctttccacacggaccgcctataaaggagctcaacctggcaggcaatcggattggcaccctggagttgggagcatttgatggtctgtcacggtcgctgctaactcttcgcctgagcaaaaacaggatcacccagcttcctgtaagagcattcaagctacccaggctgacacaactggacctcaatcggaacaggattcggctgatagagggcctcaccttccaggggctcaacagcttggaggtgctgaagcttcagcgaaacaacatcagcaaactgacagatggggccttctggggactgtccaagatgcatgtgctgcacctggagtacaacagcctggtagaagtgaacagcggctcgctctacggcctcacggccctgcatcagctccacctcagcaacaattccatcgctcgcattcaccgcaagggctggagcttctgccagaagctgcatgagttggtcctgtccttcaacaacctgacacggctggacgaggagagcctggccgagctgagcagcctgagtgtcctgcgtctcagccacaattccatcagccacattgcggagggtgccttcaagggactcaggagcctgcgagtcttggatctggaccataacgagatttcgggcacaatagaggacacgagcggcgccttctcagggctcgacagcctcagcaagctccttttattagagccatcccagtctgctggctgcagctccccgtcccagccccatatgtctgctgggggaaggactctgtttggaaacaagatcaagtctgtggctaagagagcattctcggggctggaaggcctggagcacctgaaccttggagggaatgcgatcagatctgtccagtttgatgcctttgtgaagatgaagaatcttaaagagctccatatcagcagcgacagcttcctgtgtgactgccagctgaagtggctgcccccgtggctaattggcaggatgctgcaggcctttgtgacagccacctgtgcccacccagaatcactgaagggtcagagcattttctctgtgccaccagagagtttcgtgtgcgatgacttcctgaagccacagatcatcacccagccagaaaccaccatggctatggtgggcaaggacatccggtttacatgctcagcagccagcagcagcagctcccccatgacctttgcctggaagaaagacaatgaagtcctgaccaatgcagacatggagaactttgtccacgtccacgcgcaggacggggaagtgatggagtacaccaccatcctgcacctccgtcaggtcactttcgggcacgagggccgctaccaatgtgtcatcaccaaccactttggctccacctattcacataaggccaggctcaccgtgaatgtgttgccatcattcaccaaaacgccccacgacataaccatccggaccaccaccatggcccgcctcgaatgtgctgccacaggtcacccaaaccctcagattgcctggcagaaggatggaggcacggatttccccgctgcccagaccccatccttggtggtccccttggaagaccgtgtggtatctgtgggagaaacagtggccctccaatgcaaagccacggggaaccctccgccccgcatcacctggttcaagggggaccgcccgctgagcctcactgagcggcaccacttgacccctgacaaccagctcctggtggttcagaacgtggtggcagaggatgcgggccgatatacctgtgagatgtccaacaccctgggcacggagcgagctcacagccagctgagcgtcctgcccgcagcaggctgcaggaaggatgggaccacggtaggcatcttcaccattgctgtcgtgagcagcatcgtcctgacgtcactggtctgggtgtgcatcatctaccagaccaggaagaagagtgaagagtacagtgtcaccaacacagatgaaaccgtcgtgccaccagatgttccaagctacctctcttctcaggggaccctttctgaccgacaagaaaccgtggtcaggaccgagggtggccctcaggccaatgggcacattgagagcaatggtgtgtgtccaagagatgcaagccactttccagagcccgacactcacagcgttgcctgcaggcagccaaagctctgtgctgggtctgcgtatcacaaagagccgtggaaagcgatggagaaagctgaagggacacctgggccacataagatggaacacggtggccgggtcgtatgcagtgactgcaacaccgaagtggactgttactccaggggacaagccttccacccccagcctgtgtccagagacagcgcacagccaagtgcgccaaatggcccggagccgggtgggagtgaccaagagcattctccacatcaccagtgcagcaggactgccgctgggtcctgccccgagtgccaagggtcgctctaccccagtaaccacgatagaatgctgacggctgtgaagaaaaagccaatggcatctctagatgggaaaggggattcttcctggactttagcaaggttgtatcacccggactccacagagctacagcctgcatcttcattaacttcaggcagtccagagcgcgcggaagcccagtacttgcttgtttccaatggccacctccccaaagcatgtgacgccagtcccgagtccacgccactgacaggacagctccccgggaaacagagggtgccactgctgttggcaccaaaaagctag

SEQ ID NO: 10671 - DNA, 857 bp, synthetic construct; identical to SEQ ID NO: 9022
  misc_feature 1..857: note = Synthetic polypeptide
  source 1..857: mol_type = other DNA

SEQ ID NO: 10672 - DNA, 854 bp, synthetic construct; identical to SEQ ID NO: 9023
  misc_feature 1..854: note = Synthetic polypeptide
  source 1..854: mol_type = other DNA

SEQ ID NO: 10673 - DNA, 875 bp, synthetic construct; identical to SEQ ID NO: 9024
  misc_feature 1..875: note = Synthetic polypeptide
  source 1..875: mol_type = other DNA

SEQ ID NO: 10674 - DNA, 302 bp, synthetic construct; identical to SEQ ID NO: 9025
  misc_feature 1..302: note = Synthetic polypeptide
  source 1..302: mol_type = other DNA

SEQ ID NO: 10675 - DNA, 343 bp, synthetic construct; identical to SEQ ID NO: 9026
  misc_feature 1..343: note = Synthetic polypeptide
  source 1..343: mol_type = other DNA

SEQ ID NO: 10676 - DNA, 105 bp, synthetic construct; identical to SEQ ID NO: 9027
  misc_feature 1..105: note = Synthetic polypeptide
  source 1..105: mol_type = other DNA

SEQ ID NO: 10677 - DNA, 1475 bp, synthetic construct; identical to SEQ ID NO: 8798
  misc_feature 1..1475: note = Synthetic polypeptide
  source 1..1475: mol_type = other DNA

SEQ ID NO: 10678 - DNA, 2544 bp, synthetic construct
  misc_feature 1..2544: note = Synthetic polypeptide
  source 1..2544: mol_type = other DNA
gggggaggagccaagatggccgaataggaacagctccggtctacagctcccagcgtgagcgacgcagaagacgggtgatttctgcatttccatctgaggaaccgcttagaaaatgtgcctgagtgggtatgtgaaagccgaaagctagaagttttggatattggccataatcaaatatgtgaacttcctgcccgcttattttgtaatagcagtctccggaaactactggcaggacacaaccagttggcaaggctgcctgaaaggctagaaagaacctcggtggaggtcttggatgtgcaacacaaccagctccttgagctcccacctaaccttctgatgaaggctgacagcctgagattcctgaacgcctctgcgaacaaactggaaagccttcctccagccacgctttccgaagagacaaacagtatcttacaagagttgtatttgacaaataacagcctcacagacaaatgtgtgcccttgttaacgggacacccccatttgaagatccttcacatggcctataaccgacttcagagttttccagcaagtaaaatggcgaaactggaggaacttgaagaaattgatctcagtgggaataagctgaaagccatcccaacaacgatcatgaattgcaggcgcatgcacaccgtgattgctcactccaactgcatcgaggtctttcccgaagttatgcagctcccagagatcaagtgtgtggacctgagctgtaatgagctaagtgaagtcacattaccagaaaacctgcctcccaaactgcaggagctagacctgactggaaacccgcgccttgtccttgatcacaaaaccctggaactactgaataatatccgctgtttcaagattgatcagccttctacaggagacgcttccggagccccagctgtatggagtcatggttacactgaagcttcgggggtaaaaaacaagttgtgtgtcgcagccctgtcggtgaataacttctgtgacaaccgcgaagccctgtatggtgtgtttgacggagaccggaatgtggaggtgccctaccttctccagtgcactatgagtgacattttggctgaagagctgcaaaaaacaaaaaacgaagaagaatacatggtcaatacattcattgtcatgcaaaggaaacttggaactgctgggcagaagcttggtggtgccgctgtcctttgtcatatcaagcatgaccctgtggatccaggaggatccttcaccttgacctctgctaatgtgggcaagtgccaaacagttctctgtcgaaatggaaagccgctgcctctgtccagatcttacatcatgagctgtgaagaagagctgaagaggattaaacagcacaaggccattatcactgaggatggcaaggtgaacggagtgactgagtccacgcgcatcctgggctacaccttcctccatcccagtgtggtgcctcgcccccacgtgcagtccgtgctcctgactccccaggatgagttcttcatcctaggcagtaaggggttgtgggacagcctgtccgtcgaggaggccgtggaagccgtgcgcaacgtgcccgatgccctggctgctgccaagaagctgtgtaccctggcccagagctacggctgccacgacagcatcagcgctgtggtggtgcagctcagtgtcactgaggacagcttctgctgctgcgagctcagcgccggtggggctgtgccaccacccagtcctggcatctttcctccctcagtgaacatggtgatcaaggatcggccctcagatgggctgggcgtgccgtcctccagcagcggcatggcttccgagattagcagtgagctctccacttctgagatgagcagcgaggtggggtcaacagcctccgatgagcccccgcccggagccctaagcgagaacagccctgcctaccccagtgagcagcgctgcatgctccaccccatctgtctgtccaactccttccagcgccagctatccagcgccacgttctctagcgccttctccgacaacggccttgacagtgacgatgaggagcccatcgagggcgtcttcaccaacggcagccgggtggaggtggaggtggacatccactgcagccgggccaaggagaaggagaaacagcagcacctgcttcaggtgccagcagaggccagtgatgagggcattgtcatcagcgccaacgaggatgagccaggtctgcccaggaaggcagacttctctgccgttgggaccattgggcgccggagggccaatggctctgttgcgccccaggaaaggagccacaatgtgatagaggtggctacagacgcacctcttcgaaagcctggaggctattttgctgccccggctcagccggatcctgatgatcagtttatcatacccccggagctggaagaggaggtcaaagaaatcatgaagcatcaccaggagcaacagcagcagcagcagccgccaccaccccctcagctccagccgcagctgccgcggcactaccagctggaccagctgccagattattacgacacgccactatga

SEQ ID NO: 10679 - DNA, 611 bp, synthetic construct
  misc_feature 1..611: note = Synthetic polypeptide
  source 1..611: mol_type = other DNA
gggggaggagccaagatggccgaataggaacagctccggtctacagctcccagcgtgagcgacgcagaagacgggtgatttctgcatttccatctgaggaaccgcttagaaaatgtgcctgagtgggtatgtgaaagccgaaagctagaagttttggatattggccataatcaaatatgtgaacttcctgcccgcttattttgtaatagcagtctccggaaactactggcaggacacaaccagttggcaaggctgcctgaaaggctagaaagaacctcggtggaggtcttggatgtgcaacacaaccagctccttgagctcccacctaaccttctgatgaaggctgacagtaaaatggcgaaactggaggaacttgaagaaattgatctcagtgggaataagctgaaagccatcccaacaacgatcatgaattgcaggcgcatgcacaccgtgattgctcactccaactgcatcgaggtctttcccgaagttatgcagctcccagagatcaagtgtgtggacctgagctgtaatgagctaagtgaagtcacattaccagaaaacctgcctcccaaactgcaggagctagacctgactggaaacccgcgcct

SEQ ID NO: 10680 - DNA, 735 bp, synthetic construct; identical to SEQ ID NO: 8720
  misc_feature 1..735: note = Synthetic polypeptide
  source 1..735: mol_type = other DNA

SEQ ID NO: 10681 - DNA, 1959 bp, synthetic construct
  misc_feature 1..1959: note = Synthetic polypeptide
  source 1..1959: mol_type = other DNA
aaggggcagccagacttggagtgagatgactgcagattggatctgggctgggacctcgctagctgtgcccttgggcaaggcactttgcctctctggcctccatttcctccctcatctgtaaaatatgtgttgaagaggaagggggaagcgataataaatctaccacgtttcaggtctgtgcggctgctaaagaacgacccagtcaacttgcagaaattctcttacactagtgaggatgaggcctggaagacgtacctagaaaacccgttgacagctgccacaaaggccatgatgagagtcaatggagatgatgacagtgttgcggccttgagcttcctctatgattactacatgggtcccaaggagaagcggatattgtcctccagcactgggggcaggaatgaccaaggaaagaggtactaccatggcatggaatatgagacggacctcactccccttgaaagccccacacacctcatgaaattcctgacagagaacgtgtctggaaccccagagtacccagatttgctcaagaagaataacctgatgagcttggagggggccttgcccacccctggcaaggcagctcccctccctgcaggccccagcaagctggaggccggctctgtggacagctacctgttacccaccactgatatgtatgataatggctccctcaactccttgtttgagagcattcatggggtgccgcccacacagcgctggcagccagacagcaccttcaaagatgacccacaggagtcgatgctcttcccagatatcctgaaaacctccccggaacccccatgtccagaggactaccccagcctcaaaagtgactttgaatacaccctgggctcccccaaagccatccacatcaagtcaggcgagtcacccatggcctacctcaacaaaggccagttctaccccgtcaccctgcggaccccagcaggtggcaaaggccttgccttgtcctccaacaaagtcaagagtgtggtgatggttgtcttcgacaatgagaaggtcccagtagagcagctgcgcttctggaagcactggcattcccggcaacccactgccaagcagcgggtcattgacgtggctgactgcaaagaaaacttcaacactgtggagcacattgaggaggtggcctataatgcactgtcctttgtgtggaacgtgaatgaagaggccaaggtgttcatcggcgtaaactgtctgagcacagacttttcctcacaaaagggggtgaagggtgtccccctgaacctgcagattgacacctatgactgtggcttgggcactgagcgcctggtacaccgtgctgtctgccagatcaagatcttctgtgacaagggagctgagaggaagatgcgcgatgacgagcggaagcagttccggaggaaggtcaagtgccctgactccagcaacagtggcgtcaagggctgcctgctgtcgggcttcaggggcaatgagacgacctaccttcggccagagactgacctggagacgccacccgtgctgttcatccccaatgtgcacttctccagcctgcagcgctctggaggggcagccccctcggcaggacccagcagctccaacaggctgcctctgaagcgtacctgctcgcccttcactgaggagtttgagcctctgccctccaagcaggccaaggaaggcgaccttcagagagttctgctgtatgtgcggagggagactgaggaggtgtttgacgcgctcatgttgaagaccccagacctgaaggggctgaggaatgcgatctctgagaagtatgggttccctgaagagaacatttacaaagtctacaagaaatgcaagcgaggaatcttagtcaacatggacaacaacatcattcagcattacagcaaccacgtcgccttcctgctggacatgggggagctggacggcaaaattcagatcatccttaaggagctgtaa

SEQ ID NO: 10682 - DNA, 2031 bp, synthetic construct
  misc_feature 1..2031: note = Synthetic polypeptide
  source 1..2031: mol_type = other DNA
aaggggcagccagacttggagtgagatgactgcagattggatctgggctgggacctcgctagctgtgcccttgggcaaggcactttgcctctctggcctccatttcctccctcatctgtaaaatatgtgttgaagaggaagggggaagcgataataaatctaccacgtttcaggtctgtgcggctgctaaagaacgacccagtcaacttgcagaaattctcttacactagtgaggatgaggcctggaagacgtacctagaaaacccgttgacagctgccacaaaggccatgatgagagtcaatggagatgatgacagtgttgcggccttgagcttcctctatgattactacatgggtcccaaggagaagcggatattgtcctccagcactgggggcaggaatgaccaaggaaagaggtactaccatggcatggaatatgagacggacctcactccccttgaaagccccacacacctcatgaaattcctgacagagaacgtgtctggaaccccagagtacccagatttgctcaagaagaataacctgatgagcttggagggggccttgcccacccctggcaaggcagctcccctccctgcaggccccagcaagctggaggccggctctgtggacagctacctgttacccaccactgatatgtatgataatggctccctcaactccttgtttgagagcattcatggggtgccgcccacacagcgctggcagccagacagcaccttcaaagatgacccacaggagtcgatgctcttcccagatatcctgaaaacctccccggaacccccatgtccagaggactaccccagcctcaaaagtgactttgaatacaccctgggctcccccaaagccatccacatcaagtcaggcgagtcacccatggcctacctcaacaaaggccagttctaccccgtcaccctgcggaccccagcaggtggcaaaggccttgccttgtcctccaacaaagtcaagagtgtggtgatggttgtcttcgacaatgagaaggtcccagtagagcagctgcgcttctggaagcactggcattcccggcaacccactgccaagcagcgggtcattgacgtggctgactgcaaagaaaacttcaacactgtggagcacattgaggaggtggcctataatgcactgtcctttgtgtggaacgtgaatgaagaggccaaggtgttcatcggcgtaaactgtctgagcacagacttttcctcacaaaagggggtgaagggtgtccccctgaacctgcagattgacacctatgactgtggcttgggcactgagcgcctggtacaccgtgctgtctgccagatcaagatcttctgtgacaagggagctgagaggaagatgcgcgatgacgagcggaagcagttccggaggaaggtcaagtgccctgactccagcaacagtggcgtcaagggctgcctgctgtcgggcttcaggggcaatgagacgacctaccttcggccagagactgacctggagacgccacccgtgctgttcatccccaatgtgcacttctccagcctgcagcgctctggaggggcagccccctcggcaggacccagcagctccaacaggctgcctctgaagcgtacctgctcgcccttcactgaggagtttgagcctctgccctccaagcaggccaaggaaggcgaccttcagagagttctgctgtatgtgcggagggagactgaggaggtgtttgacgcgctcatgttgaagaccccagacctgaaggggctgaggaatgcgatctctgagaagtatgggttccctgaagagaacatttacaaagtctacaagaaatgcaagcgaggggaaacttctctcctccacccacgcctgtctcgccaccccccacctgactgtcttgaatgttcccatcctgtgactcaagtgaggaacatgggttttggagatggattttggaggcagagggacctggattcaaatcccagccccaccaccgtcaacagcctgcacttcactgtaaactcggaatga

SEQ ID NO: 10683 - DNA, 113 bp, synthetic construct; identical to SEQ ID NO: 9062
  misc_feature 1..113: note = Synthetic polypeptide
  source 1..113: mol_type = other DNA

SEQ ID NO: 10684 - DNA, 1865 bp, synthetic construct
  misc_feature 1..1865: note = Synthetic polypeptide
  source 1..1865: mol_type = other DNA
gaacacttggcttccacacgtgtctcagacagagaagcttccttagtctccttgtttcacctcatgggtgggtggattgtctagaatgagtgctaggcgatcatgactggccttgtcttctaggacagatggtgtcccattacctctgcacgtcctgtctcacaaatgagggatatcctctcctctgctcgtaggtggactgactccctgaatcttttttctgtaacgaatgtcatgaaaccaaaggaacagggctgggcctggggatggggttgcggctgggtgcaggggaggttgcgtcagggctacctgggcggtggaggcttcggggtggggtgaatgttgcagagaactccttgctcctctggcaggcatttcaaaatgtggcttggactgaggcacaggcctcctccttgttcgcaggtgttctttgattttccttggcattcagggaaaagccacttgatccgcctttccaccaggcacatgcgtggacactaatgttggtttcatcattgcaacatatgcctccggtgacatacattcacaccatctgctgtgggatacgccagtgccacgcgtgatcgcattgtctccacctcggattctcaccgaccctgtttgcacctgtcctggaaagcggtgtctgctggcaggagccccacggcttttagaagtggggcacaccactgctctttcaacggaggagggaggcagagggctcactgatcagtgaacatttagctgacaccacgccttgagggccatgggatcattctgtgcagcagcgaggccctgcctgcctcaccagatgtgctgagcccttcctttctaaccaggaggggtccaaactaagatctgaagaggattcctgagaacccagcaggcgccttgaagctccccctccatcagtggaagtcggctcaaggaggtcctgaagactggactcctgggggtttggccctgggacaggatactcaaggccccttctcccacgccgccacaaactggacccctgaaccagccgccgccgtggcagcagcaggagcctcgccgccaccacggagcagtggcgttattgaaaggggacgcagcctaactgccaggagggaagcgcgagtcggcccagccaatgcgcatgcgcgaggcgcgagcggcttctcccattacagtggttcccacggttgtcttagaaacaagtcctcgaggcttggcaaagcgggagccttccgcggcagagcttgggtgtccgggctctgaggctccggtctgacctctccacggggtcgacgggaatgtctccggatgccaggagttgcaaagggcagacctagatgaggaaaccccaggcagagtcctggggaagcagcacggcatccgagcctcaggcttgcctggacggtgttggttgggaaatggtgcgagaactttggatgtggaacgtggaggaggaggaacacgaagtggggatctgcacttggggtggtcagcactgcggatgcccagcaaagtcactgcctggtccacatcccggaggggtctctgcgcctcagtcggcatcgcagctgatggtgaaacttttggtgtggcagaagagtgtccacaaacttcggaaggtatccgctacatcctccatagccgtgtatccctgcccagggcaatcttctgggggagcggaaagtcctgctcccgggccagggctggctggctggagccacttgtgcggcgcagccctggcggaggttcaggcggccccggtgtcgcaagcggctgtgagtgatgcctccctggggccggagtggtcccaggaaggctgcagaccagggctgaccagcgggcagcatggtggccgcgatggaaggtga

SEQ ID NO: 10685 - DNA, 1703 bp, synthetic construct
  misc_feature 1..1703: note = Synthetic polypeptide
  source 1..1703: mol_type = other DNA
gaacacttggcttccacacgtgtctcagacagagaagcttccttagtctccttgtttcacctcatgggtgggtggattgtctagaatgagtgctaggcgatcatgactggccttgtcttctaggacagatggtgtcccattacctctgcacgtcctgtctcacaaatgagggatatcctctcctctgctcgtaggtggactgactccctgaatcttttttctgtaacgaatgtcatgaaaccaaaggaacagggctgggcctggggatggggttgcggctgggtgcaggggaggttgcgtcagggctacctgggcggtggaggcttcggggtggggtgaatgttgcagagaactccttgctcctctggcaggcatttcaaaatgtggcttggactgaggcacaggcctcctccttgttcgcaggtgttctttgattttccttggcattcagggaaaagccacttgatccgcctttccaccaggcacatgcgtggacactaatgttggtttcatcattgcaacatatgcctccggtgacatacattcacaccatctgctgtgggatacgccagtgccacgcgtgatcgcattgtctccacctcggattctcaccgaccctgtttgcacctgtcctggaaagcggtgtctgctggcaggagccccacggcttttagaagtggggcacaccactgctctttcaacggaggagggaggcagagggctcactgatcagtgaacatttagctgacaccacgccttgagggccatgggatcattctgtgcagcagcgaggccctgcctgcctcaccagatgtgctgagcccttcctttctaaccaggaggggtccaaactaagatctgaagaggattcctgagaacccagcaggcgccttgaagctccccctccatcagtggaagtcggctcaaggaggtcctgaagactggactcctgggggtttggccctgggacaggatactcaaggccccttctcccacgccgccacaaactggacccctgaaccagccgccgccgtggcagcagcaggagcctcgccgccaccacggagcagtggcgttattgaaaggggacgcagcctaactgccaggagggaagcgcgagtcggcccagccaatgcgcatgcgcgaggcgcgagcggcttctcccattacagtggttcccacggttgtcttagaaacaagtcctcgaggcttggcaaagcgggagccttccgcggcagagcttgggtgtccgggctctgaggctccggtctgacctctccacggggtcgacgggaatgtctccggatgccaggagttgcaaagggcagacctagatgaggaaaccccaggcagagtcctggggaagcagcacggcatccgagcctcaggcttgcctggacggtgttggttgggaaatggtgcgagaactttggatgtggaacgtggaggaggaggaacacgaagtggggatctgcacttggggtggtcagcactgcggatgcccagcaaagtcactgcctggtccacatcccggaggggtctctgcgcctcagtcggcatcgcagctgatggtgaaacttttggtgtggcagaagagtgtccacaaacttcggaaggtatccgctacatcctccatagccgtgtatccctgcccagggcaatcttctgggggagcggaaagtcctgctcccgggccagggctg

SEQ ID NO: 10686 - DNA, 989 bp, synthetic construct; identical to SEQ ID NO: 8968
  misc_feature 1..989: note = Synthetic polypeptide
  source 1..989: mol_type = other DNA

SEQ ID NO: 10687 - DNA, 1675 bp, synthetic construct; identical to SEQ ID NO: 8776
  misc_feature 1..1675: note = Synthetic polypeptide
  source 1..1675: mol_type = other DNA

SEQ ID NO: 10688 - DNA, 1675 bp, synthetic construct; identical to SEQ ID NO: 8777
  misc_feature 1..1675: note = Synthetic polypeptide
  source 1..1675: mol_type = other DNA

SEQ ID NO: 10689 - DNA, 1950 bp, synthetic construct
  misc_feature 1..1950: note = Synthetic polypeptide
  source 1..1950: mol_type = other DNA
aactttcaaagtcaaggataatccaaaacagcctgatctatcttggaagatactgagtttctcatccctgcagctgatagtgaaaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaattgtagactgtagagccccaggagagctggaacacgggctgatcaccttctctacaaggaacaacctcaccacatacaagtctgagatcaaatactcctgtcaggagccctattacaagatgctcaacaataacacaggtatatatacctgttctgcccaaggagtctggatgaataaagtattggggagaagcctacccacctgccttccagtgtgtgggctccccaagttctcccggaagctgatggccaggatcttcaatggacgcccagcccagaaaggcaccactccctggattgccatgctgtcacacctgaatgggcagcccttctgcggaggctcccttctaggctccagctggatcgtgaccgccgcacactgcctccaccagtcactcgatccggaagatccgaccctacgtgattcagacttgctcagcccttctgacttcaaaatcatcctgggcaagcattggaggctccggtcagatgaaaatgaacagcatctcggcgtcaaacacaccactctccacccccagtatgatcccaacacattcgagaatgacgtggctctggtggagctgttggagagcccagtgctgaatgccttcgtgatgcccatctgtctgcctgagggaccccagcaggaaggagccatggtcatcgtcagcggctgggggaagcagttcttgcaaaggttcccagagaccctgatggagattgaaatcccgattgttgaccacagcacctgccagaaggcttatgccccgctgaagaagaaagtgaccagggacatgatctgtgctggggagaaggaagggggaaaggacgcctgtgcgggtgactctggaggccccatggtgaccctgaatagagaaagaggccagtggtacctggtgggcactgtgtcctggggtgatgactgtgggaagaaggaccgctacggagtatactcttacatccaccacaacaaggactggatccagagggtcaccggagtgaggaactga

SEQ ID NO: 10690 - DNA, 2037 bp, synthetic construct
  misc_feature 1..2037: note = Synthetic polypeptide
  source 1..2037: mol_type = other DNA
aactttcaaagtcaaggataatccaaaacagcctgatctatcttggaagatactgagtttctcatccctgcagctgatagtgaaaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaattgtagactgtagagccccaggagagctggaacacgggctgatcaccttctctacaaggaacaacctcaccacatacaagtctgagatcaaatactcctgtcaggagccctattacaagatgctcaacaataacacaggtatatatacctgttctgcccaaggagtctggatgaataaagtattggggagaagcctacccacctgccttccagagtgtggtcagccctcccgctccctgccaagcctggtcaagaggatcattgggggccgaaatgctgagcctggcctcttcccgtggcaggccctgatagtggtggaggacacttcgagagtgccaaatgacaagtggtttgggagtggggccctgctctctgcgtcctggatcctcacagcagctcatgtgctgcgctcccagcgtagagacaccacggtgataccagtctccaaggagcatgtcaccgtctacctgggcttgcatgatgtgcgagacaaatcgggggcagtcaacagctcagctgcccgagtggtgctccacccagacttcaacatccaaaactacaaccacgatatagctctggtgcagctgcaggagcctgtgcccctgggaccccacgttatgcctgtctgcctgccaaggcttgagcctgaaggcccggccccccacatgctgggcctggtggccggctggggcatctccaatcccaatgtgacagtggatgagatcatcagcagtggcacacggaccttgtcagatgtcctgcagtatgtcaagttacccgtggtgcctcacgctgagtgcaaaactagctatgagtcccgctcgggcaattacagcgtcacggagaacatgttctgtgctggctactacgagggcggcaaagacacgtgccttggagatagcggtggggcctttgtcatctttgatgacttgagccagcgctgggtggtgcaaggcctggtgtcctgggggggacctgaagaatgcggcagcaagcaggtctatggagtctacacaaaggtctccaattacgtggactgggtgtgggagcagatgggcttaccacaaagtgttgtggagccccaggtggaacggtga

SEQ ID NO: 10691 - DNA, 993 bp, synthetic construct
  misc_feature 1..993: note = Synthetic polypeptide
  source 1..993: mol_type = other DNA
aactttcaaagtcaaggataatccaaaacagcctgatctatcttggaagatactgagtttctcatccctgcagctgatagtgaaaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaaaaaatgaaatcgatctggagagcgaactcaagtcagagcaagtgacagagtga

SEQ ID NO: 10692 - DNA, 443 bp, synthetic construct
  misc_feature 1..443: note = Synthetic polypeptide
  source 1..443: mol_type = other DNA
aactttcaaagtcaaggataatccaaaacagcctgatctatcttggaagatactgagtttctcatccctgcagctgatagtgaaaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcac

SEQ ID NO: 10693 - DNA, 127 bp, synthetic construct
  misc_feature 1..127: note = Synthetic polypeptide
  source 1..127: mol_type = other DNA
aactttcaaagtcaaggataatccaaaacagcctgatctatcttggaagatactgagtttctcatccctgcagctgatagtgaaaaggtagaaactgaggaccaggtgctggcaaccttctgtggca

SEQ ID NO: 10694 - DNA, 94 bp, synthetic construct
  misc_feature 1..94: note = Synthetic polypeptide
  source 1..94: mol_type = other DNA
aactttcaaagtcaaggataatccaaaacagcctgatctatcttggaagatactgagtttctcatccctgcagctgatagtgaaaaggtagaaa

SEQ ID NO: 10695 - DNA, 635 bp, synthetic construct
  misc_feature 1..635: note = Synthetic polypeptide
  source 1..635: mol_type = other DNA
gttctcacgtcttgtcctcgccgcactctgagcctctgcagggccgggctgtgcatttctcatcgctttacctcaccaacagcatgcccaccctggagcgcttccccatcagcttcaagacctacttctcagggaactacttccgccacatcgtgctgggggtgaacttcgcgggccgctacggtgcgctgggcatgagtcggcgcgaggacctgatgtacaagccgcccgccttccgcacgctcagcgagctcgtgctggacttcgaggccgcctacggccgctgctggcacgtgctcaagaaggtgaagctgggccagagcgtgtcacacgacccgcacagcgtggagcagatcgagtggaagcactcggtgctggacgtggagcgcctgggccgcgatgacttccgcaaggagctggagcgccacgcccgcgacatgcggctcaagattggcaaagggacgggccctccctctcccaccaaggaccggaagaaggatgtttcttccccgcagcgggcccagtccagcccccaccgcaggaacagccgcagtgaaagacggccctcgggtgacaagaagacttccgagcccaaagccatgccagaccttaacgggtaccagatccgggtctga

SEQ ID NO: 10696 - DNA, 664 bp, synthetic construct; identical to SEQ ID NO: 9017
  misc_feature 1..664: note = Synthetic polypeptide
  source 1..664: mol_type = other DNA

SEQ ID NO: 10697 - DNA, 574 bp, synthetic construct; identical to SEQ ID NO: 9018
  misc_feature 1..574: note = Synthetic polypeptide
  source 1..574: mol_type = other DNA

SEQ ID NO: 10698 - DNA, 652 bp, synthetic construct; identical to SEQ ID NO: 9019
  misc_feature 1..652: note = Synthetic polypeptide
  source 1..652: mol_type = other DNA

SEQ ID NO: 10699 - DNA, 529 bp, synthetic construct; identical to SEQ ID NO: 9020
  misc_feature 1..529: note = Synthetic polypeptide
  source 1..529: mol_type = other DNA

SEQ ID NO: 10700 - DNA, 445 bp, synthetic construct; identical to SEQ ID NO: 9021
  misc_feature 1..445: note = Synthetic polypeptide
  source 1..445: mol_type = other DNA

SEQ ID NO: 10701 - DNA, 1310 bp, synthetic construct
  misc_feature 1..1310: note = Synthetic polypeptide
  source 1..1310: mol_type = other DNA
tggtatggtttggctctgtgtccctacccaaatctccccttgaattgtaataatccccatgtgtcaagggtgggatgaggtggagataattaactcatgggggcagtttcccccatgttgtccttgtgatagtaattcattacaagatttgatggttttataatggttttgctcagttctcattcttctctttcctgccagcatgtaaagaaggacatgtttgcttactcttcctccatgattgttatactggagagctttgccagtccaagattgattactgcatcctagacccatgcagaaatggagcaacatgcatttccagtctcagtggattcacctgccagtgtccagaaggatacttcggatctgcttgtgaagaaaaggtggacccctgcgcctcgtctccgtgccagaacaacggcacctgctatgtggacggggtacactttacctgcaactgcagcccgggcttcacagggccgacctgtgcccagcttattgacttctgtgccctcagcccctgtgctcatggcacgtgccgcagcgtgggcaccagctacaaatgcctctgtgatccaggttaccatggcctctactgtgaggaggaatataatgagtgcctctccgctccatgcctgaatgcagccacctgcagggacctcgttaatggctatgagtgtgtgtgcctggcagaatacaaaggaacacactgtgaattgtacaaggatccctgcgctaacgtcagctgtctgaacggagccacctgtgacagcgacggcctgaatggcacgtgcatctgtgcacccgggtttacaggtgaagagtgcgacattgacataaatgaatgtgacagtaacccctgccaccatggtgggagctgcctggaccagcccaatggttataactgccactgcccgcatggttgggtgggagcaaactgtgagatccacctccaatggaagtccgggcacatggcggagagcctcaccaacatgccacggcactccctctacatcatcattggagccctctgcgtggccttcatccttatgctgatcatcctgatcgtggggatttgccgcatcagccgcattgaataccagggttcttccaggccagcctatgaggagttctacaactgccgcagcatcgacagcgagttcagcaatgccattgcatccatccggcatgccaggtttggaaagaaatcccggcctgcaatgtatgatgtgagccccatcgcctatgaagattacagtcctgatgacaaacccttggtcacactgattaaaactaaagatttgtaa

SEQ ID NO: 10702 - DNA, 1946 bp, synthetic construct; identical to SEQ ID NO: 10199
  misc_feature 1..1946: note = Synthetic polypeptide
  source 1..1946: mol_type = other DNA

SEQ ID NO: 10703 - DNA, 2084 bp, synthetic construct; identical to SEQ ID NO: 10200
  misc_feature 1..2084: note = Synthetic polypeptide
  source 1..2084: mol_type = other DNA

SEQ ID NO: 10704 - DNA, 786 bp, synthetic construct; identical to SEQ ID NO: 9118
  misc_feature 1..786: note = Synthetic polypeptide
  source 1..786: mol_type = other DNA

SEQ ID NO: 10705 - DNA, 969 bp, synthetic construct; identical to SEQ ID NO: 9119
  misc_feature 1..969: note = Synthetic polypeptide
  source 1..969: mol_type = other DNA

SEQ ID NO: 10706 - DNA, 91 bp, synthetic construct; identical to SEQ ID NO: 9120
  misc_feature 1..91: note = Synthetic polypeptide
  source 1..91: mol_type = other DNA

SEQ ID NO: 10707 - DNA, 663 bp, synthetic construct; identical to SEQ ID NO: 9121
  misc_feature 1..663: note = Synthetic polypeptide
  source 1..663: mol_type = other DNA

SEQ ID NO: 10708 - DNA, 846 bp, synthetic construct; identical to SEQ ID NO: 9122
  misc_feature 1..846: note = Synthetic polypeptide
  source 1..846: mol_type = other DNA

SEQ ID NO: 10709 - DNA, 456 bp, synthetic construct; identical to SEQ ID NO: 9037
  misc_feature 1..456: note = Synthetic polypeptide
  source 1..456: mol_type = other DNA

SEQ ID NO: 10710 - DNA, 776 bp, synthetic construct
  misc_feature 1..776: note = Synthetic polypeptide
  source 1..776: mol_type = other DNA
ctgccctactagccatgtgacctgggctgccttgcgaagaccagatcatcctcctgaaggggtgctgcatggagatcatgtccctgcgggcggctgtccgctacgaccctgagagcgacaccctgacgctgagtggggagatggctgtcaagcgggagcagctcaagaatggcggcctgggcgtagtctccgacgccatctttgaactgggcaagtcactctctgcctttaacctggatgacacggaagtggctctgctgcaggctgtgctgctaatgtcaacagaccgctcgggcctgctgtgtgtggacaagatcgagaagagtcaggaggcgtacctgctggcgttcgagcactacgtcaaccaccgcaaacacaacattccgcacttctggcccaagctgctgatgaaggagagagaagtgcagagttcgattctgtacaagggggcagcggcagaaggccggccgggcgggtcactgggcgtccacccggaaggacagcagcttctcggaatgcatgttgttcagggtccgcaggtccggcagcttgagcagcagcttggtgaagcgggaagtctccaagggccggttcttcagcaccagagcccgaagagcccgcagcagcgtctcctggagctgctccaccgaagcggaattctccatgcccgagcggtctgtggggaagacgacagcagtgaggcggactccccgagctcctctgaggaggaaccggaggtctgcgaggacctggcaggcaatgcagcctctccctga

SEQ ID NO: 10711 - DNA, 659 bp, synthetic construct
  misc_feature 1..659: note = Synthetic polypeptide
  source 1..659: mol_type = other DNA
ctgccctactagccatgtgacctgggctgccttgcgaagaccagatcatcctcctgaaggggtgctgcatggagatcatgtccctgcgggcggctgtccgctacgaccctgagagcgacaccctgacgctgagtggggagatggctgtcaagcgggagcagctcaagaatggcggcctgggcgtagtctccgacgccatctttgaactgggcaagtcactctctgcctttaacctggatgacacggaagtggctctgctgcaggctgtgctgctaatgtcaacagaccgctcgggcctgctgtgtgtggacaagatcgagaagagtcaggaggcgtacctgctggcgttcgagcactacgtcaaccaccgcaaacacaacattccgcacttctggcccaagctgctgatgaagggtccgcaggtccggcagcttgagcagcagcttggtgaagcgggaagtctccaagggccggttcttcagcaccagagcccgaagagcccgcagcagcgtctcctggagctgctccaccgaagcggaattctccatgcccgagcggtctgtggggaagacgacagcagtgaggcggactccccgagctcctctgaggaggaaccggaggtctgcgaggacctggcaggcaatgcagcctctccctga

SEQ ID NO: 10712 - DNA, 536 bp, synthetic construct
  misc_feature 1..536: note = Synthetic polypeptide
  source 1..536: mol_type = other DNA
ctgccctactagccatgtgacctgggctgccttgcgaagaccagatcatcctcctgaaggggtgctgcatggagatcatgtccctgcgggcggctgtccgctacgaccctgagagcgacaccctgacgctgagtggggagatggctgtcaagcgggagcagctcaagaatggcggcctgggcgtagtctccgacgccatctttgaactgggcaagtcactctctgcctttaacctggatgacacggaagtggctctgctgcaggctgtgctgctaatgtcaacagaccgctcgggcctgctgtgtgtggacaagatcgagaagagtcaggaggcgtacctgctggcgttcgagcactacgtcaaccaccgcaaacacaacattccgcacttctggcccaagctgctgatgaaggtgactgacctccgcatgatcggggcctgccacgccagccgcttcctccacatgaaagtcgagtgccccaccgaactcttccccccactcttcctcgaggtctttgaggatcaggaagtctaa

SEQ ID NO: 10713 - DNA, 1164 bp, synthetic construct; identical to SEQ ID NO: 7133
  misc_feature 1..1164: note = Synthetic polypeptide
  source 1..1164: mol_type = other DNA

SEQ ID NO: 10714 - DNA, 376 bp, synthetic construct; identical to SEQ ID NO: 7134
  misc_feature 1..376: note = Synthetic polypeptide
  source 1..376: mol_type = other DNA

SEQ ID NO: 10715 - DNA, 2084 bp, synthetic construct; identical to SEQ ID NO: 10260
  misc_feature 1..2084: note = Synthetic polypeptide
  source 1..2084: mol_type = other DNA

SEQ ID NO: 10716 - DNA, 1946 bp, synthetic construct; identical to SEQ ID NO: 10261
  misc_feature 1..1946: note = Synthetic polypeptide
  source 1..1946: mol_type = other DNA

SEQ ID NO: 10717 - DNA, 647 bp, synthetic construct; identical to SEQ ID NO: 10262
  misc_feature 1..647: note = Synthetic polypeptide
  source 1..647: mol_type = other DNA

SEQ ID NO: 10718 - DNA, 182 bp, synthetic construct; identical to SEQ ID NO: 10263
  misc_feature 1..182: note = Synthetic polypeptide
  source 1..182: mol_type = other DNA

SEQ ID NO: 10719 - DNA, 514 bp, synthetic construct; identical to SEQ ID NO: 9048
  misc_feature 1..514: note = Synthetic polypeptide
  source 1..514: mol_type = other DNA

SEQ ID NO: 10720 - DNA, 475 bp, synthetic construct; identical to SEQ ID NO: 9049
  misc_feature 1..475: note = Synthetic polypeptide
  source 1..475: mol_type = other DNA

SEQ ID NO: 10721 - DNA, 553 bp, synthetic construct; identical to SEQ ID NO: 9050
  misc_feature 1..553: note = Synthetic polypeptide
  source 1..553: mol_type = other DNA

SEQ ID NO: 10722 - DNA, 1445 bp, synthetic construct
  misc_feature 1..1445: note = Synthetic polypeptide
  source 1..1445: mol_type = other DNA
atgcagctgaagttgcctcagggctaccagcccggtggagggttgggagaattttgcagaaacctctttgctcctctggtaggcatttgaaaatgtggcttgggtcaggaacaggcgcccccacccgccgggtcccaggtgttcttcgattttcctttgcattgatggataggtcactcattccccctttgcaccggcacatgcctggacaccaccgtttctttcgccgtcgccccgtatgcctccggtgatacacgttcacaccatctgctgtgggatacgccagtgcctcgcatgttcccgtggtctccacctcgcattcgcccctgttcctgtttgcacgagtcctgtaaagcgcggtcggctttcctgagccccagggcttttagaagcggggtatgccactgctctttcaaaggaggagggaggcagagggttgaatgatcagtgaatttgcagccgacactttgcctcgagacctgtgggatcattctttgctgcatggaggccctgcctgccccagcagatgtggcgagcccatcctatgtcactcggtgggggcctaaatcggatctgaaggggtgtcctgagaacacagcaggcgtcctgaagctccctctccctccctccgtggaagtcagctcaaggagttcctgaggacaggattcctgggggtttggtcctgggacaggacaagacacccacggtcccgtctcccacgccgccacaaactggagcccggatccaggccgcggctgcagcgggaacctcgctgccctgcgctgcagtagcgttatttaaaggggatgcagcctgactgccagaagcggagcgctagtcaggccagccaatgcgcatgcgcgcggcgcgagcgacttctcctgtcacagtggttcccacggttgtcttagaaaccagtccctgaggcttggcaaagcaggagccctccgtggcagtgcttgtgtgtcggggctctgaggctccggcctgacctctccacagggtcgacgggaacgtctctggatgccaggagacgcaaagggccgaccagaatgaggaattcccaggcggagtccaggggaggcagcacggcatcccagcctcagggctgcccggacggtgttggttgggtttcttttgatttctcctgcttagaaatggtgcgagaactttggatgtggaacgtggaggaggaggaacacgaagtggggatctgcacttggggtggtcagcactgcggatgcccagcaaagtcactgcctggtccacatcccggaggggtctctgcgcctcagtcggcatcgcagctgatggtgaaacttttggtgtggcagaagagtgtccacaaacttcggaaggtatccgctacatcctccatagccgtgtatccctgcccagggcaatcttctgggggagcggaaagtcctgctcccgggccagggctg

SEQ ID NO: 10723 - DNA, 790 bp, synthetic construct
  misc_feature 1..790: note = Synthetic polypeptide
  source 1..790: mol_type = other DNA
gctgggcacagtggctcatacctgtaatcccagcacttttggaggccaaggcagcagctccagctatgacaacggtttccccaccggagaccatgagctcttcaccactttcagctgggatgaccagaaagttcgtcgagtctttgtcagaaaggtctacaccatcctgctgattcagctgctggtgaccttggctgtcgtggctctctttactttctgtgaccctgtcaaggactatgtccaggccaacccaggctggtactgggcatcctatgctgtgttctttgcaacctacctgaccctggcttgctgttctggacccaggaggcatttcccctggaacctgattctcctgaccgtctttaccctgtccatggcctacctcactgggatgctgtccagctactacaacaccacctccgtgctgctgtgcctgggcatcacggcccttgtctgcctctcagtcaccgtcttcagcttccagaccaagttcgacttcacctcctgccagggcgtgctcttcgtgcttctcatgactcttttcttcagcggactcatcctggccatcctcctacccttccaatatgtgccctggctccatgcagtttatgcagcactgggagcgggtgtatttacattgttcctggcacttgacacccagttgctgatgggtaaccgacgccactcgctgagccctgaggagtatatttttggagccctcaacatttacctagacatcatctatatcttcaccttcttcctgcagctttttggcactaaccgagaatga

SEQ ID NO: 10724 - DNA, 466 bp, synthetic construct
  misc_feature 1..466: note = Synthetic polypeptide
  source 1..466: mol_type = other DNA
gctgggcacagtggctcatacctgtaatcccagcacttttggaggccaaggcagcagctccagctatgacaacggtttccccaccggagaccatgagctcttcaccactttcagctgggatgaccagaaagttcgtcgagtctttgtcagaaagaacccctcccacccccaggtctacaccatcctgctgattcagctgctggtgaccttggctgtcgtggctctctttactttctgtgaccctgtcaaggactatgtccaggccaacccaggctggtactgggcatcctatgctgtgttctttgcaacctacctgaccctggcttgctgttctggacccaggaggcatttcccctggaacctgattctcctgaccgtctttaccctgtccatggcctacctcactgggatgctgtccagttcgacttcacctcctgccagggcgtgctcttcgtgcttctcatga

SEQ ID NO: 10725 - DNA, 763 bp, synthetic construct
  misc_feature 1..763: note = Synthetic polypeptide
  source 1..763: mol_type = other DNA
gctgggcacagtggctcatacctgtaatcccagcacttttggaggccaaggcagcagctccagctatgacaacggtttccccaccggagaccatgagctcttcaccactttcagctgggatgaccagaaagttcgtcgagtctttgtcagaaaggtctacaccatcctgctgattcagctgctggtgaccttggctgtcgtggctctctttactttctgtgaccctgtcaaggactatgtccaggccaacccaggctggtactgggcatcctatgctgtgttctttgcaacctacctgaccctggcttgctgttctggacccaggaggcatttcccctggaacctgattctcctgaccgtctttaccctgtccatggcctacctcactgggatgctgtccagctactacaacaccacctccgtgctgctgtgcctgggcatcacggcccttgtctgcctctcagtcaccgtcttcagcttccagaccaagttcgacttcacctcctgccagggcgtgctcttcgtgcttctcatgactcttttcttcagcggactcatcctggccatcctcctacccttccaatatgtgccctggctccatgcagtttatgcagcactgggagcgggtgtatttacattgttcctggcacttgacacccagttgctgatgggtaaccgacgccactcgctgagccctgaggagtatatttttggagccctcaacatttacctagacatcatctatatcttcaccttcttcctg

SEQ ID NO: 10726 - DNA, 585 bp, synthetic construct
  misc_feature 1..585: note = Synthetic polypeptide
  source 1..585: mol_type = other DNA
gctgggcacagtggctcatacctgtaatcccagcacttttggaggccaaggcagcagctccagctatgacaacggtttccccaccggagaccatgagctcttcaccactttcagctgggatgaccagaaagttcgtcgagtctttgtcagaaaggtctacaccatcctgctgattcagctgctggtgaccttggctgtcgtggctctctttactttctgtgaccctgtcaaggactatgtccaggccaacccaggctggtactgggcatcctatgctgtgttctttgcaacctacctgaccctggcttgctgttctggacccaggaggcatttcccctggaacctgattctcctgaccgtctttaccctgtccatggcctacctcactgggatgctgtccagctactacaacaccacctccgtgctgctgtgcctgggcatcacggcccttgtctgcctctcagtcaccgtcttcagcttccagaccaagttcgacttcacctcctgccagggcgtgctcttcgtgcttctcatgactcttttcttcagcggactcatcctggccatcctcctacccttccaata

SEQ ID NO: 10727 - DNA, 311 bp, synthetic construct
  misc_feature 1..311: note = Synthetic polypeptide
  source 1..311: mol_type = other DNA
gctgggcacagtggctcatacctgtaatcccagcacttttggaggccaaggcagcagctccagctatgacaacggtttccccaccggagaccatgagctcttcaccactttcagctgggatgaccagaaagttcgtcgagtctttgtcagaaaggtctacaccatcctgctgattcagctgctggtgaccttggctgtcgtggctctctttactttctgtgaccctgtcaaggactatgtccaggccaacccaggctggtactgggcatcctatgctgtgttctttgcaacctacctgaccctggcttgct

SEQ ID NO: 10728 - DNA, 1457 bp, synthetic construct
  misc_feature 1..1457: note = Synthetic polypeptide
  source 1..1457: mol_type = other DNA
tgcagccgaatttgcctcagggctaccagcgcggtggagggttgggggtggggagaattttgcagaaacctctttgctcctctggtaggcatttgaaaacgtggcttgggtcaggcacaggcgcccccacccgccgggtcccaggtggtcttcgattttcctttgcattgatggataggtcactcgttccccccttgcaccggcacatgcctggacaccaccgtttctttcgctgtcgcccggtttgcctccggtgacacacgttcacaccatctgctgtgggatacgccagtgccattcgtgttcacatggtctccacctcgcaatctcccctgttcttgtttgcacgagtcctgtaaagcgcggtcggctttcctgagccccagggcttttagaagaggggtaggccactgctctttcaaaggaggagggaggcagagggttgaaggatcagtgaatttgcagcggacacttggcctcgagacctatgggatcattcttggctgcagcgaggccctgcctgcctcagcgcatgtggcgagcccatcctatctcactcagtgggggccgaaatgggatctgaaggggtgtcctgagaacacagcaggcgtcctgaagctccccctccctccctcggtggaagtcagctcaaggagttcctgaggacaggactcctgggggtttggccctgggacaggacaagacacccacggtccggtctcccaagccgccacaaactggagcccggatccagccgccgccgcggctgcagcaggaggctcgctgccgccgcgctgcggtggcgttatttaaaggggacgcagcctgaccgccaggagcggagcgccagtcgggcgggccaatgcgcatgcgcgaggcgcgagcctcttctcccgtcacagtggttcccacggttgtcttagaaaccagtccccgaggcttggcaaagcaggagcccttcgtggcagtgcttgtgtgtcggagctctgaggctccggcctgacctctcctcggggtcgacgggaacgtctccggatgccaggactcgcaaagggctgacaagaatgaggaaatcccaggcggagtccgggggaggcagcacggcatcccagcctcagggctgcccggacggtgttggttgggtttcttttgatttctcctgcttagaaatggtgcgagaactttggatgtggaacgtggaggaggaggaacacgaagtggggatctgcacttggggtggtcagcactgcggatgcccagcaaagtcactgcctggtccacatcccggaggggtctctgcgcctcagtcggcatcgcagctgatggtgaaacttttggtgtggcagaagagtgtccacaaacttcggaaggtatccgctacatcctccatagccgtgtatccctgcccagggcaatcttctgggggagcggaaagtcctgctcccgggccagggctg

SEQ ID NO: 10729 - DNA, 2438 bp, synthetic construct; identical to SEQ ID NO: 9790
  misc_feature 1..2438: note = Synthetic polypeptide
  source 1..2438: mol_type = other DNA

SEQ ID NO: 10730 - DNA, 2471 bp, synthetic construct; identical to SEQ ID NO: 9791
  misc_feature 1..2471: note = Synthetic polypeptide
  source 1..2471: mol_type = other DNA

SEQ ID NO: 10731 - DNA, 396 bp, synthetic construct; identical to SEQ ID NO: 9008
  misc_feature 1..396: note = Synthetic polypeptide
  source 1..396: mol_type = other DNA

SEQ ID NO: 10732 - DNA, 393 bp, synthetic construct; identical to SEQ ID NO: 9009
  misc_feature 1..393: note = Synthetic polypeptide
  source 1..393: mol_type = other DNA

SEQ ID NO: 10733 - DNA, 311 bp, synthetic construct; identical to SEQ ID NO: 9010
  misc_feature 1..311: note = Synthetic polypeptide
  source 1..311: mol_type = other DNA

SEQ ID NO: 10734 - DNA, 423 bp, synthetic construct; identical to SEQ ID NO: 9011
  misc_feature 1..423: note = Synthetic polypeptide
  source 1..423: mol_type = other DNA

SEQ ID NO: 10735 - DNA, 1012 bp, synthetic construct; identical to SEQ ID NO: 9012
  misc_feature 1..1012: note = Synthetic polypeptide
  source 1..1012: mol_type = other DNA

SEQ ID NO: 10736 - DNA, 1391 bp, synthetic construct; identical to SEQ ID NO: 8908
  misc_feature 1..1391: note = Synthetic polypeptide
  source 1..1391: mol_type = other DNA

SEQ ID NO: 10737 - DNA, 206 bp, synthetic construct
  misc_feature 1..206: note = Synthetic polypeptide
  source 1..206: mol_type = other DNA
cagctctgccacttactactggcagactctgcatataaacctctcagaacttcatcttcctcctctgtaaattagagtaattgtagaatctatttcaggattgcagtaaggatgaaatgacataataatgcaaagctctggtgaggacagtgggatgctgcctggatactgccaggcaaacgccacatccttcgatgcatgggtaa

SEQ ID NO: 10738 - DNA, 1060 bp, synthetic construct
  misc_feature 1..1060: note = Synthetic polypeptide
  source 1..1060: mol_type = other DNA
gaccaccaggattcgaacctcggctctacgcattaagctgtgtggccgtggggaagccaaaaagcttctgtgagcatcggtctatactcgctatgggaagtgttacaccttcaacgcggacccgcggagctcgctgcccagccgggcagggggcatgggcagtggcctggagatcatgctggacatccagcaggaggagtacctgcccatctggagggagacaaatgagacgtcgtttgaggcaggtattcgggtgcagatccacagccaggaggagccgccctacatccaccagctggggttcggggtgtccccaggcttccagacctttgtgtcctgccaggaacagcggctgacctacctgccccagccctggggcaactgccgcgcagagagtgagctcagggagcctgagcttcagggctactcggcctacagtgtgtctgcctgccggctgcgctgtgaaaaggaggccgtgcttcagcgctgccactgccggatggtgcacatgccagactccctgggtgggggccctgagggcccgtgcttctgccccaccccctgcaacctgacacgctatgggaaagagatctccatggtcaggatccccaacaggggctcagcccggtacctggcgaggaagtacaaccgcaacgagacctacatacgggagaacttcctggtcctagatgtcttctttgaggccctgacctctgaagccatggagcagcgagcagcctatggcctgtcagccctgctgggagacctcgggggacagatgggcctgttcattggggccagcatcctcacgttgctggagatcctcgactacatctatgaggtgtcctgggatcgactgaagcgggtatggaggcgtcccaagacccccctgcggacctccactgggggcatctccactttggggcttcaggagctgaaggaacagagtccctgcccgagccggggccgagtggagggtgggggggtcagcagtctgctccccaatcaccaccacccccacggtcccccaggaggtctctttgaagattttgcttgctag

SEQ ID NO: 10739 - DNA, 1117 bp, synthetic construct
  misc_feature 1..1117: note = Synthetic polypeptide
  source 1..1117: mol_type = other DNA
gaccaccaggattcgaacctcggctctacgcattaagctgtgtggccgtggggaagccaaaaagcttctgtgagcatcggtctatactcgctatgggaagtgttacaccttcaacgcggacccgcggagctcgctgcccagccgggcagggggcatgggcagtggcctggagatcatgctggacatccagcaggaggagtacctgcccatctggagggagacaaatgagacgtcgtttgaggcaggtattcgggtgcagatccacagccaggaggagccgccctacatccaccagctggggttcggggtgtccccaggcttccagacctttgtgtcctgccaggaacagcggctgacctacctgccccagccctggggcaactgccgcgcagagagtgagctcagggagcctgagcttcagggctactcggcctacagtgtgtctgcctgccggctgcgctgtgaaaaggaggccgtgcttcagcgctgccactgccggatggtgcacatgccaggcaatgagaccatctgcccaccaaatatctacatcgagtgtgcagaccacacactggactccctgggtgggggccctgagggcccgtgcttctgccccaccccctgcaacctgacacgctatgggaaagagatctccatggtcaggatccccaacaggggctcagcccggtacctggcgaggaagtacaaccgcaacgagacctacatacgggagaacttcctggtcctagatgtcttctttgaggccctgacctctgaagccatggagcagcgagcagcctatggcctgtcagccctgctgggagacctcgggggacagatgggcctgttcattggggccagcatcctcacgttgctggagatcctcgactacatctatgaggtgtcctgggatcgactgaagcgggtatggaggcgtcccaagacccccctgcggacctccactgggggcatctccactttggggcttcaggagctgaaggaacagagtccctgcccgagccggggccgagtggagggtgggggggtcagcagtctgctccccaatcaccaccacccccacggtcccccaggaggtctctttgaagattttgcttgctag

SEQ ID NO: 10740 - DNA, 210 bp, synthetic construct
  misc_feature 1..210: note = Synthetic polypeptide
  source 1..210: mol_type = other DNA
ggccagcccaacaccgagggcatctgggagctggtgaccggaggggtcttctactgcctgggcatggtcttcttcaagagtgacgggaggatcccctttgcccacgccatctggcatctctttgtagcatttggtgctggtacccactactatgccatctggaggtacctctatctgcccagcaccctgcagaccaaggtgtccaaatga

SEQ ID NO: 10741 - DNA, 894 bp, synthetic construct
  misc_feature 1..894: note = Synthetic polypeptide
  source 1..894: mol_type = other DNA
gagagagccctagtctgcaagccagaagatttggatgatagtcctagctctactgctactctctacgagctgattgtggatgcagaagacacctggattcgactggagggcctgttggagaacacagactacacggtgctcctgcaggcagcacaggacaccacgtggagcagcatcacctccaccgctttcaccacaggaggccgggtgttccctcatccccaagactgtgcccagcatttgatgaatggagacactttgagtggggtttaccccatcttcctcaatggggagctgagccagaaattacaagtgtactgtgatatgaccaccgacgggggcggctggattgtattccagaggcggcagaatggccaaactgattttttccggaaatgggctgattaccgtgttggcttcgggaacgtggaggatgagttctggctggggctggacaatatacacaggatcacatcccagggccgctatgagctgcgcgtggacatgcgggatggccaagaggccgccttcgcctcctacgacaggttctctgtcgaggacagcagaaacctgtacaaactccgcataggaagctacaacggcactgcgggggactccctcagctatcatcaaggacgccctttctccacagaggatagagacaatgatgttgcagtgactaactgtgccatgtcgtacaagggagcatggtggtataagaactgccaccggaccaacctcaatgggaagtacggggagtccaggcacagtcagggcatcaactggtaccattggaaaggccatgagttctccatcccctttgtggaaatgaagatgcgcccctacaaccaccgtctcatggcagggagaaaacggcagtccttacagttctga

SEQ ID NO: 10742 - DNA, 1455 bp, synthetic construct
  misc_feature 1..1455: note = Synthetic polypeptide
  source 1..1455: mol_type = other DNA
tggtgcaggggaggttgtgtgagggctacctgggcggtggagctttggccttggggtgaattttgcagaaacctatttgttgctctggcaggaatttcaaattttggatccggtcagtcacaagccgcctcctgtttcccaagtgttctttaatttttcattgctgtgatggaaatgtcacttgaccctcccttccaccgggcacatgcctagacagcatcgtttgtttcgccgtcgccccacattcctctggttacacacattcaagccatctgctgtgggattggtcagtgccacacgtcaacgcatggtctccacctgggattcgcccctgttcctgtttgcacgtgtcctgtaaattgcgattggcttccagagccccagggcttttagaagcccggcaggccagtgttctttaaaaggagaagggaggcagagggctgatggatcagtgaaatttcagctgacagcatgccttgagacccatgggatcattgtgtgctgcagcgaggccctgcctgcctcaccagatgtggtgagcccatcctatctcactcggtgggggccaaaatcagatctgaaggggagtcctgagaacacagcaggcgtcctgaagctccccctccctccctcggtggaagtcggctcaaggagtttctgaggacaggactcctgggggtttggccgtgggacagaagaagacacccgcggtcccctctcccacgccgacccaaactggagcccggatccagccgccgccgcggctgcagcaggagcctccctgccgccgcgctgcggtggcgttatttaaaggggacgcagcctgaccgccaggagcggagcgccagtcgggtgggccaatgcgcatgcgcgaggcgcgagcgccttctcccgtcacagtggttcccacggttgtcttagaaaccagtccccgaggcttggcaaagcaggagcgctccgtggcagtgcttgtgtgtcggggctctgaggctccggcctgacctctcctcggggtcgacgggaaggtctccggatgccaggactcgcaaagggccgaccagaatgaggaaatcccaggcggagtccgggggaggcagcacggcatcccagcctcagggctgcccggacggtgttggttgggtttcttttgatttctcctgcttagaaatggtgcgagaactttggatgtggaacgtggaggaggaggaacacgaagtggggatctgcacttggggtggtcagcactgcggatgcccagcaaagtcactgcctggtccacatcccggaggggtctctgcgcctcagtcggcatcgcagctgatggtgaaacttttggtgtggcagaagagtgtccacaaacttcggaaggtatccgctacatcctccatagccgtgtatccctgcccagggcaatcttctgggggagcggaaagtcctgctcccgggccagggctg

SEQ ID NO: 10743 - DNA, 985 bp, synthetic construct; identical to SEQ ID NO: 9063
  misc_feature 1..985: note = Synthetic polypeptide
  source 1..985: mol_type = other DNA

SEQ ID NO: 10744 - DNA, 207 bp, synthetic construct; identical to SEQ ID NO: 9064
  misc_feature 1..207: note = Synthetic polypeptide
  source 1..207: mol_type = other DNA

SEQ ID NO: 10745 - DNA, 246 bp, synthetic construct
  misc_feature 1..246: note = Synthetic polypeptide
  source 1..246: mol_type = other DNA
aagccgaggcagggtgatcacgaggtcaggagttcaagaccagcctggcaaacatggtgaagccctgtttctactaaaaatacaaaaattagctaggcatggtggcatgtgctgtagtcccagctactcgggaggctgaggcaggagaatcgcttgaacccgggaggcggaggttgcagtgagccgagattgtgccactgcactccagcctagacgtgcctgcttccccttcgccttctgccgtga

SEQ ID NO: 10746 - DNA, 424 bp, synthetic construct
  misc_feature 1..424: note = Synthetic polypeptide
  source 1..424: mol_type = other DNA
aagccgaggcagggtgatcacgaggtcaggagttcaagaccagcctggcaaacatggtgaagccctgtttctactaaaaatacaaaaattagctaggcatggtggcatgtgctgtagtcccagctactcgggaggctgaggcaggagaatcgcttgaacccgggaggcggaggttgcagtgagccgagattgtgccactgcactccagcctagacgtgcctgcttccccttcgccttctgccgtgattgtcagtttcctgaggcctccccagccacgcttcctgtacagcctgcagaactctgccccagagcacatcagctatgtgccccagctctcaaacgacaccttggcggggaggctcaccctgtccaccttcacgctggagcagcctctaggccagttcagcagccacaacatctctga

SEQ ID NO: 10747 - DNA, 896 bp, synthetic construct
  misc_feature 1..896: note = Synthetic polypeptide
  source 1..896: mol_type = other DNA
aagccgaggcagggtgatcacgaggtcaggagttcaagaccagcctggcaaacatggtgaagccctgtttctactaaaaatacaaaaattagctaggcatggtggcatgtgctgtagtcccagctactcgggaggctgaggcaggagaatcgcttgaacccgggaggcggaggttgcagtgagccgagattgtgccactgcactccagcctagacgtgcctgcttccccttcgccttctgccgtgattgtcagtttcctgaggcctccccagccacgcttcctgtacagcctgcagaacttctggcatggaaaagcccctgtgcaactggtaaagatatcaataagcaccaggaggtatctaaatccaccaggagccataggcatcacgttgacatccatttaccagtcttccctggcaagattcttctgaattgtgctgccttggccaaaagagctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaacaaagtggtccagcgacactcgcc

SEQ ID NO: 10748 - DNA, 617 bp, synthetic construct
  misc_feature 1..617: note = Synthetic polypeptide
  source 1..617: mol_type = other DNA
aagccgaggcagggtgatcacgaggtcaggagttcaagaccagcctggcaaacatggtgaagccctgtttctactaaaaatacaaaaattagctaggcatggtggcatgtgctgtagtcccagctactcgggaggctgaggcaggagaatcgcttgaacccgggaggcggaggttgcagtgagccgagattgtgccactgcactccagcctagacgtgcctgcttccccttcgccttctgccgtgattgtcagtttcctgaggcctccccagccacgcttcctgtacagcctgcagaacttctggcatggaaaagcccctgtgcaactggtaaagatatcaataagcaccaggaggtatctaaatccaccaggagccataggcatcacgttgacatccatttaccagtcttccctggcaagattcttctgaattgtgctgccttggccaaaagagctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacg

SEQ ID NO: 10749 - DNA, 304 bp, synthetic construct
  misc_feature 1..304: note = Synthetic polypeptide
  source 1..304: mol_type = other DNA
aagccgaggcagggtgatcacgaggtcaggagttcaagaccagcctggcaaacatggtgaagccctgtttctactaaaaatacaaaaattagctaggcatggtggcatgtgctgtagtcccagctactcgggaggctgaggcaggagaatcgcttgaacccgggaggcggaggttgcagtgagccgagattgtgccactgcactccagcctagacgtgcctgcttccccttcgccttctgccgtgattgtcagtttcctgaggcctccccagccacgcttcctgtacagcctgcagaactatga

SEQ ID NO: 10750 - DNA, 304 bp, synthetic construct
  misc_feature 1..304: note = Synthetic polypeptide
  source 1..304: mol_type = other DNA
aagccgaggcagggtgatcacgaggtcaggagttcaagaccagcctggcaaacatggtgaagccctgtttctactaaaaatacaaaaattagctaggcatggtggcatgtgctgtagtcccagctactcgggaggctgaggcaggagaatcgcttgaacccgggaggcggaggttgcagtgagccgagattgtgccactgcactccagcctagacgtgcctgcttccccttcgccttctgccgtgattgtcagtttcctgaggcctccccagccacgcttcctgtacagcctgcagaactgtga

SEQ ID NO: 10751 - DNA, 357 bp, synthetic construct
  misc_feature 1..357: note = Synthetic polypeptide
  source 1..357: mol_type = other DNA
agttgacctgtaaacaacatgggtttaaactgcatgagtcacttatgcatggattttcttctgcttctgccaccccgggaacagcaagaccaacccttcctcttcctcctctcctcagcctactcggtgtgaagacaatgaggatgaagacctttacgatgatacacttccacttaataaccagaaaaatgctggcaggtggtgcaagcaaggacatctatgcatagaattctgacagcagctggaccctcaacttcttcagaagacgagaaccctgcctggcaccgctggcaggcatctggcctgacaccgctctggaggcctcccacaagcagcaaccaagccagaaaaagttga

SEQ ID NO: 10752 - DNA, 1571 bp, synthetic construct
  misc_feature 1..1571: note = Synthetic polypeptide
  source 1..1571: mol_type = other DNA
gagtcggaagtgctggattttactcctcccttaccattgtttctgagaccacaaattacttcagcctctctgagatctggaaaatggaaagagcgatttacttatctctctgagcttgtctgatcccagtgaaacaatctcccagtaagaagaaaatcatcatcattttagaaaatttagaaaaatcttcactgtcggagttattgagggactttttggcacctcttgaaaatcgcagcactgaaagcccctgcactttccaaaaaggaaatggactgtccgaatgttattactttcatgagaactgctttctgatgggaaccatcgccaaggcctgtctccagggctccgacttgctggtgcagcagcatttccgctgggtgcagctgcggtgggatggcgagcccatgcaaggactgctgcagaggttcttacgaaggaaagttgtgaataagttcaaaggtcaggcgccctccccctgcgatcctgtgtgcaagattgtcgactgggctctgtccgtctggcgtcagcttaactcctgcctggcccgcttgggcacacctgaagcacttcttggaccaaaatatttcctgtcttgtcctgtagttcctgggcatgcccaagtgacagtgaagtggatgtctaagctgtggaatggcgtcatcgcacccagagttcaagaagcaatattgtcaagagcctctgtgaaaagacaacctggctttgggcagacaactgctaaaagacaccctagccaaggacagcaggctgtggtcaaagctgctctcagcatcttgctaaataaagctgtactgcatggctgtcccctccccagagcagagctagaccagcatacagctgatttcaaaggaggaagtttccctttatccatagtttccagttataacacttgtaacaagaagaaaggagagagtggtgcctggagaaaggtgaacaccagtcctcgcaggaagtctggccgcttctctttacccacctggaataagccagacctaagcactgaaggtatgaaaaataagactatatcacagctgaattgtaacaggaatgcttctctgtcaaaacaaaagtctttagagaatgatctatcactgacgttgaatttggatcagagactctctctgggttcagatgacgaagcagatcttgtcaaggaacttcagagcatgtgctccagcaagtctgagtctgatatcagcaagattgctgattccagggatgatttaaggatgtttgatagttctggaaacaaccctgtactttcagcaactattaataatctgagaatgccagtgtcacaaaaggaggtcagtcctctcagcagccatcaaactactgaatgcagcaacagtaaatcaaagactgagttgggtgtttcaagagttaaatcttttcttcctgttcctagaagtaaagtcacccagtgttcccagaacaccaaaagaagcagcagcagcagtaatacaaggcaaatagaaatcaacaacaactcaaaagaagtgaattggaacttacacaaaaatgaacacctagaaaaacctaacaaatag

SEQ ID NO: 10753 - DNA, 205 bp, synthetic construct
  misc_feature 1..205: note = Synthetic polypeptide
  source 1..205: mol_type = other DNA
gagtcggaagtgctggattttactcctcccttaccattgtttctgagaccacaaattacttcagcctctctgagatctggaaaatggaaagagcgatttacttatctctctgagcttgtctgatcccagtgaaacaatctcccagtaagaagaaaatcatcatcattttagaaaatttagaaaaatcttcactgtcggagttatt

SEQ ID NO: 10754 - DNA, 1394 bp, synthetic construct
  misc_feature 1..1394: note = Synthetic polypeptide
  source 1..1394: mol_type = other DNA
actggacaaggtcatgaactcatcaagcttcatcaaacccagaagtcatcaagataaattcaattctggatatagtaacaaaagtggaaaactattatcttaaaggatatattgtcggggctattcatcctgttatacaacctgtggggcagcgaaaacacctacctgcaagttacctatacagagtggtgctattgcgcttgaaattaagcccaaagaattcggcagcacccagtggacaaagacgcccaaggctcgtgattgaggaatgtcccctaacttctgaggcacaaacaaatgacgcagcaaaagaactgatagaaaagattaatgtcgctgctaaaagaggaatgaaatttgttggattcatatcacagcattattctccatctaaattctgcaatggaaccaaccatgatggagatatagaatcgatgctacatgtgagacacggttcagatgaaaactgtagaagttggaatgaagggacgttaagtgggcagtcatctgaaagcggaattgaggaagaacttcatcatgaaagtggacagtatcaaatggaacaaaatggcagccctacttcctctaaatcaagaaagggagaagcctcagataacaaattgtatacagtcttcaatgcttttgatgatgattcaacctcctgggcctatcaggaaggcatcctgtcaatgaaagtaacaagaaaaggatcagtcattagtacacttgatgctgattggctggagttaactaccttttattataaacaaggcttgtctttaattgattcttttgtattctgggaaacatctaaaggggaacatttgcctaaatctttggaaggattttttatctatgaagaagaaggttctggagttccaggttctagtaggaaaggaaatgatgccatcgtagtagaacaatggactgttattgagggatgtgaaatcaaaacagattatggccctctgctgcacactctggctgaattcggatggcttctgacaagcgtgttgcccacacctgtattgagacatgacagtgaagggaatttggctacaaagcagatcgtattccttcagaggccagttatgtggaattcagctgctcaaacaccagataagaaagccagccgccacataaaaggtgaagacaagaataaagccactagtagaagcatcggattagacacaacctcgtcacaacctgcagagagcagacacctgcctgaggagtgccgcctttctccctcccgggaatgctggacaaaggagggaaggctggcacagcacaacagcttctctgggttcagcagcagtgacaacgtcctccgggaattagacgacggacagtttgatcaggaagatggagtgactcaggtcacttgtatgtga

SEQ ID NO: 10755 - DNA, 237 bp, synthetic construct
  misc_feature 1..237: note = Synthetic polypeptide
  source 1..237: mol_type = other DNA
actggacaaggtcatgaactcatcaagcttcatcaaacccagaagtcatcaagataaattcaattctggatatagtaacaaaagtggaaaactattatcttaaaggatatattgtcggggctattcatcctgttatacaacctgtggggcagcgaaaacacctacctgcaagttacctatacagagtggtgctattgcgcttgaaattaagcccaaagaattcggcagcacccagtg

SEQ ID NO: 10756 - DNA, 1463 bp, synthetic construct; identical to SEQ ID NO: 8862
  misc_feature 1..1463: note = Synthetic polypeptide
  source 1..1463: mol_type = other DNA

SEQ ID NO: 10757 - DNA, 170 bp, synthetic construct; identical to SEQ ID NO: 8863
  misc_feature 1..170: note = Synthetic polypeptide
  source 1..170: mol_type = other DNA

SEQ ID NO: 10758 - DNA, 239 bp, synthetic construct; identical to SEQ ID NO: 8864
  misc_feature 1..239: note = Synthetic polypeptide
  source 1..239: mol_type = other DNA

SEQ ID NO: 10759 - DNA, 376 bp, synthetic construct
  misc_feature 1..376: note = Synthetic polypeptide
  source 1..376: mol_type = other DNA
tgttggtagacaattctccatggatccctacatttctgcttttcttgttagcagggacactgagagcattttttctggactatattttcaaggatgttggaacagtaaatgaccttggaagatataaatagtgtctctctcaaggacagagggcagatacatctacctcggattgccggcagcactaagaggatcaagctttgttccagccttaatcatcttaattcttttgaggaagtgtcatctacctggtgaaaatgcctcttcaggaacagagcttatagagacaaaagtcaaagggaaggaaaatgagtgcaaagatatataccaaaagtccacggttttgaaagatgatgaattgaaaactaaattgtaa

SEQ ID NO: 10760 - DNA, 590 bp, synthetic construct
  misc_feature 1..590: note = Synthetic polypeptide
  source 1..590: mol_type = other DNA
gaccagaacccggcagtgggcaggtgtttgtgacttcagagaaccaacttgtgtattaccccagcatcacctatgccatcatcggcagctccgtcatttttgtgctggtggtggccctgctggcactggtcttgcaccaccagcggaagcggaacaacctcatgacgctgcccgtgcaccggctgcagcaccctgtgctgctgtcccgcctggtggtcctggaccacccccaccactgcaacgtcacctacaacgtcaataatggcatccagtatgtggccagccaggcggagcagaatgcgtcggaagtaggctccccaccctcctactccgaggccttgctggaccagaggcctgcgtggtatgaccttcctccaccgccctactcttctgacacggaatctctgaaccaagccgacctgcccccctaccgctcccggtccgggagtgccaacagtgccagctcccaggcagccagcagcctcctgagcgtggaagacaccagccacagcccggggcagcctggcccccaggagggcactgctgagcccagggactctgagcccagccagggcactgaagaagtataa

SEQ ID NO: 10761 - DNA, 614 bp, synthetic construct
  misc_feature 1..614: note = Synthetic polypeptide
  source 1..614: mol_type = other DNA
gtgtgtgagcctctatccggctgtggaggtcacgtctgggccgggtgatgtactccatggcaaactgtctgctcctgatgaaggattatgtgctggccgtggaggcgtatcattcggttatcaagtattacccagagcaagagccccagctgctcagcggcatcggccggatttccctgcagattggagacataaaaacagctgaaaagtattttcaagacgttgagaaagtaacacagaaattagatggactacagggtaaaatcatggttttgatgaacagcgcgttccttcacctcgggcagaataactttgcagaagcccacaggttcttcacagagatcttaaggatggatccaagaaacgcagtggccaacaacaacgctgccgtgtgtctgctctacctgggcaagctcaaggactccctgcggcagctggaggccatggtccagcaggaccccaggcactacctgcacgagagcgtgctcttcaacctgaccaccatgtacgagctggagtcctcacggagcatgcagaagaaacaggccctgctggaggctgtcgccggcaaggagggggacagcttcaacacacagtgcctcaagctggcctag

SEQ ID NO: 10762 - DNA, 50 bp, synthetic construct
  misc_feature 1..50: note = Synthetic polypeptide
  source 1..50: mol_type = other DNA
gtgtgtgagcctctatccggctgtggaggtcacgtctgggccgggtgatg

SEQ ID NO: 10763 - DNA, 209 bp, synthetic construct
  misc_feature 1..209: note = Synthetic polypeptide
  source 1..209: mol_type = other DNA
gtgtgtgagcctctatccggctgtggaggtcacgtctgggccgggtgatgtactccatggcaaactgtctgctcctgatgaaggattatgtgctggccgtggaggcgtatcattcggttatcaagtattacccagagcaagagccccagctgctcagcggcatcggccggatttccctgcagcgcgttccttcacctcgggcagaataa

SEQ ID NO: 10764 - DNA, 617 bp, synthetic construct
  misc_feature 1..617: note = Synthetic polypeptide
  source 1..617: mol_type = other DNA
gtgtgtgagcctctatccggctgtggaggtcacgtctgggccgggtgatgtactccatggcaaactgtctgctcctgatgaaggattatgtgctggccgtggaggcgtatcattcggttatcaagtattacccagagcaagagccccagctgctcagcggcatcggccggatttccctgcagcagattggagacataaaaacagctgaaaagtattttcaagacgttgagaaagtaacacagaaattagatggactacagggtaaaatcatggttttgatgaacagcgcgttccttcacctcgggcagaataactttgcagaagcccacaggttcttcacagagatcttaaggatggatccaagaaacgcagtggccaacaacaacgctgccgtgtgtctgctctacctgggcaagctcaaggactccctgcggcagctggaggccatggtccagcaggaccccaggcactacctgcacgagagcgtgctcttcaacctgaccaccatgtacgagctggagtcctcacggagcatgcagaagaaacaggccctgctggaggctgtcgccggcaaggagggggacagcttcaacacacagtgcctcaagctggcctag

SEQ ID NO: 10765 - DNA, 724 bp, synthetic construct; identical to SEQ ID NO: 8796
  misc_feature 1..724: note = Synthetic polypeptide
  source 1..724: mol_type = other DNA

SEQ ID NO: 10766 - DNA, 75 bp, synthetic construct; identical to SEQ ID NO: 8797
  misc_feature 1..75: note = Synthetic polypeptide
  source 1..75: mol_type = other DNA

SEQ ID NO: 10767 - DNA, 625 bp, synthetic construct
  misc_feature 1..625: note = Synthetic polypeptide
  source 1..625: mol_type = other DNA
tgacatagttcggctgtgtccccacccaaatcttatcctgaattgtaatcccataatccccatatgtcatgagagggacccggtggaaggtaattcaatcatgtgggtggttgcgccatgctgttatcatgatagtgagttctcatgagatctgatggttttataagcatctggcatttcccctgctggcattcattctctctcctgccgcctggtgaagaggaaccttctgccatgattgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaagggagcaagaagaagacaaggaaatggctgatttcctgagaatcaagttaaaacctctagacaaagtaaccaaatctccagccagctcccgggcagagaagaaagcagagcccccacctagcaagcccacggtggccaagacggggctggcactgatcaaggattgttgcggggccacccagtgcaacatcatgtag

SEQ ID NO: 10768 - DNA, 466 bp, synthetic construct
  misc_feature 1..466: note = Synthetic polypeptide
  source 1..466: mol_type = other DNA
tgacatagttcggctgtgtccccacccaaatcttatcctgaattgtaatcccataatccccatatgtcatgagagggacccggtggaaggtaattcaatcatgtgggtggttgcgccatgctgttatcatgatagtgagttctcatgagatctgatggttttataagcatctggcatttcccctgctggcattcattctctctcctgccgcctggtgaagaggaaccttctgccatgattgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaaggctcccgggcagagaagaaagcagagcccccacctag

SEQ ID NO: 10769 - DNA, 643 bp, synthetic construct
  misc_feature 1..643: note = Synthetic polypeptide
  source 1..643: mol_type = other DNA
tgacatagttcggctgtgtccccacccaaatcttatcctgaattgtaatcccataatccccatatgtcatgagagggacccggtggaaggtaattcaatcatgtgggtggttgcgccatgctgttatcatgatagtgagttctcatgagatctgatggttttataagcatctggcatttcccctgctggcattcattctctctcctgccgcctggtgaagaggaaccttctgccatgattgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaagggagcaagaagaagacaaggaaatggctgatttcctgagaatcaagttaaaacctctagacaaagtaaccaaatctccagccatctgcctcaggtgtgtgcctggagggggcctggactggcatggatccagtgtgcagaagagccagcagggaaccggaagctctgatgtcaaggccagagcagttgagaatgggacccagagtagatgctga

SEQ ID NO: 10770 - DNA, 559 bp, synthetic construct
  misc_feature 1..559: note = Synthetic polypeptide
  source 1..559: mol_type = other DNA
tgacatagttcggctgtgtccccacccaaatcttatcctgaattgtaatcccataatccccatatgtcatgagagggacccggtggaaggtaattcaatcatgtgggtggttgcgccatgctgttatcatgatagtgagttctcatgagatctgatggttttataagcatctggcatttcccctgctggcattcattctctctcctgccgcctggtgaagaggaaccttctgccatgattgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaagggagcaagaagaagacaaggaaatggctgatttcctgagaatcaagttaaaacctctagacaaagtaaccaaatctccagccagtctggaatctctggagaagccagaagcatatgtctcagaatattaa

SEQ ID NO: 10771 - DNA, 586 bp, synthetic construct
  misc_feature 1..586: note = Synthetic polypeptide
  source 1..586: mol_type = other DNA
tgacatagttcggctgtgtccccacccaaatcttatcctgaattgtaatcccataatccccatatgtcatgagagggacccggtggaaggtaattcaatcatgtgggtggttgcgccatgctgttatcatgatagtgagttctcatgagatctgatggttttataagcatctggcatttcccctgctggcattcattctctctcctgccgcctggtgaagaggaaccttctgccatgattgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaagggagcaagaagaagacaaggaaatggctgatttcctgagaatcaagttaaaacctctagacaaagtaaccaaatctccagccaatgaggaagtagcagtaaatccattacccttttcaagcggaggttgcaagaggttgcaagcggaggcagaataa

SEQ ID NO: 10772 - DNA, 3055 bp, synthetic construct; identical to SEQ ID NO: 709
  misc_feature 1..3055: note = Synthetic polypeptide
  source 1..3055: mol_type = other DNA

SEQ ID NO: 10773 - DNA, 3058 bp, synthetic construct; identical to SEQ ID NO: 710
  misc_feature 1..3058: note = Synthetic polypeptide
  source 1..3058: mol_type = other DNA

SEQ ID NO: 10774 - DNA, 2665 bp, synthetic construct
  misc_feature 1..2665: note = Synthetic polypeptide
  source 1..2665: mol_type = other DNA
caagaggatgtggttgaaacagtctgccccaggaacaaccaataagaaggtgactacacttgtcaacacaagcaacaaaggcccatctggtaaaaagaaagggaggtcaaagaaagcccatgtactagctgcctctgtagagcaagccactcagaatttcctggaaaagggtgaacagatcgctaaggagagtcaagatctcaaagaagagttggtggctgctgtagaggatgtgcgcaaacaaggtgagacgatgcggatcgcctcctccgagtttgcagatgacccttgctcgtcggtaaagcgcggcaccatggtacgggcggcaagggctttgctctccgcggtgacacgcttactcatcctggcggacatggcagatgtcatgagacttttatcccatctgaaaattgtggaagaggccctggaagctgtcaaaaatgctacaaatgagcaagaccttgcaaaccgttttaaagagtttgggaaagagatggtgaaacttaactatgtagcagcaagaagacaacaggagctgaaggatcctcactgtcgggatgagatggcagccgcccgaggggctctgaagaagaatgccacaatgctgtacacggcctctcaagcatttctccgccacccagatgtcgccgctacgagagccaaccgagattatgtgttcaaacaagtccaggaggccatcgccggcatctccaatgctgctcaagctacctcgcccactgacgaagccaagggccacacgggcatcggcgagctggctgcggctcttaatgagtttgacaataagattatcctggaccccatgacgttcagcgaggccaggttccggccgtccctggaggagaggctggagagcatcatcagcggcgcagcgctgatggccgactcctcctgcacgcgagacgaccggcgcgagaggatcgtggcggagtgcaacgccgtgcggcaggcgctccaggacctgctcagcgagtacatgaataatactggaaggaaagaaaaaggagatcctctcaacattgcgattgataagatgactaagaaaacaagagatctaaggagacagcttcggaaagcagtgatggatcacatatctgactctttcctggaaaccaatgttcctttgctagttctcattgaggctgcaaagagcggaaatgaaaaggaagtgaaagaatatgcccaagttttccgtgagcatgccaacaaactggtagaggttgccaatttggcctgttccatctccaacaatgaagaaggggtgaaattagttcggatggcagccacccagattgacagcctgtgtccccaggtcatcaatgccgctctgacactggctgcccggccacagagcaaagttgctcaggataacatggacgtcttcaaagaccagtgggagaagcaggtccgagtgttgacagaggccgtggatgacatcacctcagtggatgacttcctctctgtctcagaaaatcacatcttggaggatgtgaacaagtgtgtgatagccctccaagagggcgatgtggacactctggaccggactgcaggggccatcaggggccgggcagctcgagtcatacacatcatcaatgctgagatggagaactatgaagctggggtttatactgagaaggtgttggaagctacaaaattgctttctgaaacagtgatgccacgcttcgctgaacaagtagaggttgccattgaagccctgagtgccaacgttcctcaaccgtttgaggagaatgagttcatcgatgcctctcgcctggtgtatgatggcgttcgggacatcagaaaggctgtgctgatgatcaggaccccagaagaactagaggatgattctgactttgagcaggaagattatgatgtgcgtagcaggacaagtgttcagactgaggatgaccagctcattgcagggcagagcgcacgggccatcatggcgcaactaccgcaggaggagaaggcaaaaatagctgagcaggtggagatattccatcaagagaaaagcaagctggatgcagaagtggccaaatgggacgacagcggcaatgatatcattgtactggccaagcagatgtgtatgatcatgatggaaatgacagacttcacaagaggcaaaggcccattgaaaaatacatctgatgtcattaatgctgccaagaaaattgccgaagcaggttctcgaatggacaaattagctcgtgctgtggctgatcagtgtcctgattcagcatgtaagcaggatttattagcctaccttcaacgaattgccttgtattgccatcagcttaatatctgcagcaaggtgaaggcagaagtgcagaatctgggaggagagctcattgtgtcagggctggacagtgccacatcgcttatccaggcagctaaaaacctgatgaatgctgttgtcctcacggtgaaagcatcctatgtggcctcaaccaaataccagaaggtctatgggacagcagctgtcaactcacctgttgtgtcttggaagatgaaggctccagagaagaagccccttgtgaagagagaaaagcctgaagaattccagacacgagttcgacgaggttctcagaagaaacacatttcgcctgtacaggctttaagtgaattcaaagcaatggattccttctag

SEQ ID NO: 10775 - DNA, 146 bp, synthetic construct
  misc_feature 1..146: note = Synthetic polypeptide
  source 1..146: mol_type = other DNA
caagaggatgtggttgaaacagtctgccccaggaacaaccaataagaaggtgactacacttgtcaacacaagcaacaaaggcccatctggtaaaaagaaagggaggtcaaagaaagcccatgtactagctgcctctgtagagcaag

SEQ ID NO: 10776 - DNA, 299 bp, synthetic construct
  misc_feature 1..299: note = Synthetic polypeptide
  source 1..299: mol_type = other DNA
caagaggatgtggttgaaacagtctgccccaggaacaaccaataagaaggtgactacacttgtcaacacaagcaacaaaggcccatctggtaaaaagaaagggaggtcaaagaaagcccatgtactagctgcctctgtagagcaagccactcagaatttcctggaaaagggtgaacagatcgctaaggagagtcaagatctcaaagaagagttggtggctgctgtagaggatgtgcgcaaacaaggtgagacgatgcggatcgcctcctccgagtttgcagatgacccttgctcgtcgg

SEQ ID NO: 10777 - DNA, 2809 bp, synthetic construct
  misc_feature 1..2809: note = Synthetic polypeptide
  source 1..2809: mol_type = other DNA
caagaggatgtggttgaaacagtctgccccaggaacaaccaataagaaggtgactacacttgtcaacacaagcaacaaaggcccatctggtaaaaagaaagggaggtcaaagaaagcccatgtactagctgcctctgtagagcaagccactcagaatttcctggaaaagggtgaacagatcgctaaggagagtcaagatctcaaagaagagttggtggctgctgtagaggatgtgcgcaaacaaggtgagacgatgcggatcgcctcctccgagtttgcagatgacccttgctcgtcggtaaagcgcggcaccatggtacgggcggcaagggctttgctctccgcggtgacacgcttactcatcctggcggacatggcagatgtcatgagacttttatcccatctgaaaattgtggaagaggccctggaagctgtcaaaaatgctacaaatgagcaagaccttgcaaaccgttttaaagagtttgggaaagagatggtgaaacttaactatgtagcagcaagaagacaacaggagctgaaggatcctcactgtcgggatgagatggcagccgcccgaggggctctgaagaagaatgccacaatgctgtacacggcctctcaagcatttctccgccacccagatgtcgccgctacgagagccaaccgagattatgtgttcaaacaagtccaggaggccatcgccggcatctccaatgctgctcaagctacctcgcccactgacgaagccaagggccacacgggcatcggcgagctggctgcggctcttaatgagtttgacaataagattatcctggaccccatgacgttcagcgaggccaggttccggccgtccctggaggagaggctggagagcatcatcagcggcgcagcgctgatggccgactcctcctgcacgcgagacgaccggcgcgagaggatcgtggcggagtgcaacgccgtgcggcaggcgctccaggacctgctcagcgagtacatgaataatactggaaggaaagaaaaaggagatcctctcaacattgcgattgataagatgactaagaaaacaagagatctaaggagacagcttcggaaagcagtgatggatcacatatctgactctttcctggaaaccaatgttcctttgctagttctcattgaggctgcaaagagcggaaatgaaaaggaagtgaaagaatatgcccaagttttccgtgagcatgccaacaaactggtagaggttgccaatttggcctgttccatctccaacaatgaagaaggggtgaaattagttcggatggcagccacccagattgacagcctgtgtccccaggtcatcaatgccgctctgacactggctgcccggccacagagcaaagttgctcaggataacatggacgtcttcaaagaccagtgggagaagcaggtccgagtgttgacagaggccgtggatgacatcacctcagtggatgacttcctctctgtctcagaaaatcacatcttggaggatgtgaacaagtgtgtgatagccctccaagagggcgatgtggacactctggaccggactgcaggggccatcaggggccgggcagctcgagtcatacacatcatcaatgctgagatggagaactatgaagctggggtttatactgagaaggtgttggaagctacaaaattgctttctgaaacagtgatgccacgcttcgctgaacaagtagaggttgccattgaagccctgagtgccaacgttcctcaaccgtttgaggagaatgagttcatcgatgcctctcgcctggtgtatgatggcgttcgggacatcagaaaggctgtgctgatgatcaggaccccagaagaactagaggatgattctgactttgagcaggaagattatgatgtgcgtagcaggacaagtgttcagactgaggatgaccagctcattgcagggcagagcgcacgggccatcatggcgcaactaccgcaggaggagaaggcaaaaatagctgagcaggtggagatattccatcaagagaaaagcaagctggatgcagaagtggccaaatgggacgacagcggcaatgatatcattgtactggccaagcagatgtgtatgatcatgatggaaatgacagacttcacaagaggcaaaggcccattgaaaaatacatctgatgtcattaatgctgccaagaaaattgccgaagcaggttctcgaatggacaaattagctcgtgctgtggctgatcagtgtcctgattcagcatgtaagcaggatttattagcctaccttcaacgaattgccttgtattgccatcagcttaatatctgcagcaaggtgaaggcagaagtgcagaatctgggaggagagctcattgtgtcagggacaggagttcagagcactttcactaccttttatgaggtagattgtgatgtcatagatgggggcagggctagtcaactttctacccacctcccaacctgtgctgagggagctccgatcgggagtggaagcagtgattcctccatgctggacagtgccacatcgcttatccaggcagctaaaaacctgatgaatgctgttgtcctcacggtgaaagcatcctatgtggcctcaaccaaataccagaaggtctatgggacagcagctgtcaactcacctgttgtgtcttggaagatgaaggctccagagaagaagccccttgtgaagagagaaaagcctgaagaattccagacacgagttcgacgaggttctcagaagaaacacatttcgcctgtacaggctttaagtgaattcaaagcaatggattccttctag

SEQ ID NO: 10778 - DNA, 2530 bp, synthetic construct
  misc_feature 1..2530: note = Synthetic polypeptide
  source 1..2530: mol_type = other DNA
caagaggatgtggttgaaacagtctgccccaggaacaaccaataagaaggtgactacacttgtcaacacaagcaacaaaggcccatctggtaaaaagaaagggaggtcaaagaaagcccatgtactagctgcctctgtagagcaagccactcagaatttcctggaaaagggtgaacagatcgctaaggagagtcaagatctcaaagaagagttggtggctgctgtagaggatgtgcgcaaacaaggtgagacgatgcggatcgcctcctccgagtttgcagatgacccttgctcgtcggtaaagcgcggcaccatggtacgggcggcaagggctttgctctccgcggtgacacgcttactcatcctggcggacatggcagatgtcatgagacttttatcccatctgaaaattgtggaagaggccctggaagctgtcaaaaatgctacaaatgagcaagaccttgcaaaccgttttaaagagtttgggaaagagatggtgaaacttaactatgtagcagcaagaagacaacaggagctgaaggatcctcactgtcgggatgagatggcagccgcccgaggggctctgaagaagaatgccacaatgctgtacacggcctctcaagcatttctccgccacccagatgtcgccgctacgagagccaaccgagattatgtgttcaaacaagtccaggaggccatcgccggcatctccaatgctgctcaagctacctcgcccactgacgaagccaagggccacacgggcatcggcgagctggctgcggctcttaatgagtttgacaataagattatcctggaccccatgacgttcagcgaggccaggttccggccgtccctggaggagaggctggagagcatcatcagcggcgcagcgctgatggccgactcctcctgcacgcgagacgaccggcgcgagaggatcgtggcggagtgcaacgccgtgcggcaggcgctccaggacctgctcagcgagtacatgaataatactggaaggaaagaaaaaggagatcctctcaacattgcgattgataagatgactaagaaaacaagagatctaaggagacagcttcggaaagcagtgatggatcacatatctgactctttcctggaaaccaatgttcctttgctagttctcattgaggctgcaaagagcggaaatgaaaaggaagtgaaagaatatgcccaagttttccgtgagcatgccaacaaactggtagaggttgccaatttggcctgttccatctccaacaatgaagaaggggtgaaattagttcggatggcagccacccagattgacagcctgtgtccccaggtcatcaatgccgctctgacactggctgcccggccacagagcaaagttgctcaggataacatggacgtcttcaaagaccagtgggagaagcaggtccgagtgttgacagaggccgtggatgacatcacctcagtggatgacttcctctctgtctcagaaaatcacatcttggaggatgtgaacaagtgtgtgatagccctccaagagggcgatgtggacactctggaccggactgcaggggccatcaggggccgggcagctcgagtcatacacatcatcaatgctgagatggagaactatgaagctggggtttatactgagaaggtgttggaagctacaaaattgctttctgaaacagtgatgccacgcttcgctgaacaagtagaggttgccattgaagccctgagtgccaacgttcctcaaccgtttgaggagaatgagttcatcgatgcctctcgcctggtgtatgatggcgttcgggacatcagaaaggctgtgctgatgatcaggaccccagaagaactagaggatgattctgactttgagcaggaagattatgatgtgcgtagcaggacaagtgttcagactgaggatgaccagctcattgcagggcagagcgcacgggccatcatggcgcaactaccgcaggaggagaaggcaaaaatagctgagcaggtggagatattccatcaagagaaaagcaagctggatgcagaagtggccaaatgggacgacagcggcaatgatatcattgtactggccaagcagatgtgtatgatcatgatggaaatgacagacttcacaagaggcaaaggcccattgaaaaatacatctgatgtcattaatgctgccaagaaaattgccgaagcaggttctcgaatggacaaattagctcgtgctgtggctgatcagctggacagtgccacatcgcttatccaggcagctaaaaacctgatgaatgctgttgtcctcacggtgaaagcatcctatgtggcctcaaccaaataccagaaggtctatgggacagcagctgtcaactcacctgttgtgtcttggaagatgaaggctccagagaagaagccccttgtgaagagagaaaagcctgaagaattccagacacgagttcgacgaggttctcagaagaaacacatttcgcctgtacaggctttaagtgaattcaaagcaatggattccttctag

SEQ ID NO: 10779 - DNA, 806 bp, synthetic construct; identical to SEQ ID NO: 6950
  misc_feature 1..806: note = Synthetic polypeptide
  source 1..806: mol_type = other DNA

SEQ ID NO: 10780 - DNA, 200 bp, synthetic construct
  misc_feature 1..200: note = Synthetic polypeptide
  source 1..200: mol_type = other DNA
cagtagccttggactccacttaaagtcctgcctgtcactggccatgtgaccttggagccatcactgcccctctctgaggcaaaggggaagaggcccgagctctgcacccagaggaggacccagaaggacgtcaggggaggctactgggacgctggaaggcgctgttgatccccccttccagccccatgccaggtccctag

SEQ ID NO: 10781 - DNA, 6915 bp, synthetic construct
  misc_feature 1..6915: note = Synthetic polypeptide
  source 1..6915: mol_type = other DNA
ctggaaaacaatcaagatgtttatcagagcaggaagagtgaacaaattaaggcacatctcgactgtggagtactctgcagatgggtatgaggagcactgaatcaaaaaaattggggaaagaaatatccaacatgtaatagcccaaaacaatctcctatcaatattgatgaagatcttacacaagtaaatgtgaatcttaagaaacttaaatttcagggttgggataaaacatcattggaaaacacattcattcataacactgggaaaacagtggaaattaatctcactaatgactaccgtgtcagcggaggagtttcagaaatggtgtttaaagcaagcaagataacttttcactggggaaaatgcaatatgtcatctgatggatcagagcatagtttagaaggacaaaaatttccacttgagatgcaaatctactgctttgatgcggaccgattttcaagttttgaggaagcagtcaaaggaaaagggaagttaagagctttatccattttgtttgaggttgggacagaagaaaatttggatttcaaagcgattattgatggagtcgaaagtgttagtcgttttgggaagcaggctgctttagatccattcatactgttgaaccttctgccaaactcaactgacaagtattacatttacaatggctcattgacatctcctccctgcacagacacagttgactggattgtttttaaagatacagttagcatctctgaaagccagttggctgttttttgtgaagttcttacaatgcaacaatctggttatgtcatgctgatggactacttacaaaacaattttcgagagcaacagtacaagttctctagacaggtgttttcctcatacactggaaaggaagagattcatgaagcagtttgtagttcagaaccagaaaatgttcaggctgacccagagaattataccagccttcttgttacatgggaaagacctcgagtcgtttatgataccatgattgagaagtttgcagttttgtaccagcagttggatggagaggaccaaaccaagcatgaatttttgacagatggctatcaagacttgggtgctattctcaataatttgctacccaatatgagttatgttcttcagatagtagccatatgcactaatggcttatatggaaaatacagcgaccaactgattgtcgacatgcctactgataatcctgaacttgatcttttccctgaattaattggaactgaagaaataatcaaggaggaggaagagggaaaagacattgaagaaggcgctattgtgaatcctggtagagacagtgctacaaaccaaatcaggaaaaaggaaccccagatttctaccacaacacactacaatcgcatagggacgaaatacaatgaagccaagactaaccgatccccaacaagaggaagtgaattctctggaaagggtgatgttcccaatacatctttaaattccacttcccaaccagtcactaaattagccacagaaaaagatatttccttgacttctcagactgtgactgaactgccacctcacactgtggaaggtacttcagcctctttaaatgatggctctaaaactgttcttagatctccacatatgaacttgtcggggactgcagaatccttaaatacagtttctataacagaatatgaggaggagagtttattgaccagtttcaagcttgatactggagctgaagattcttcaggctccagtcccgcaacttctgctatcccattcatctctgagaacatatcccaagggtatatattttcctccgaaaacccagagacaataacatatgatgtccttataccagaatctgctagaaatgcttccgaagattcaacttcatcaggttcagaagaatcactaaaggatccttctatggagggaaatgtgtggtttcctagctctacagacataacagcacagcccgatgttggatcaggcagagagagctttctccagactaattacactgagatacgtgttgatgaatctgagaagacaaccaagtccttttctgcaggcccagtgatgtcacagggtccctcagttacagatctggaaatgccacattattctacctttgcctacttcccaactgaggtaacacctcatgcttttaccccatcctccagacaacaggatttggtctccacggtcaacgtggtatactcgcagacaacccaaccggtatacaatggtgagacacctcttcaaccttcctacagtagtgaagtctttcctctagtcacccctttgttgcttgacaatcagatcctcaacactacccctgctgcttcaagtagtgattcggccttgcatgctacgcctgtatttcccagtgtcgatgtgtcatttgaatccatcctgtcttcctatgatggtgcacctttgcttccattttcctctgcttccttcagtagtgaattgtttcgccatctgcatacagtttctcaaatccttccacaagttacttcagctaccgagagtgataaggtgcccttgcatgcttctctgccagtggctgggggtgatttgctattagagcccagccttgctcagtattctgatgtgctgtccactactcatgctgcttcagagacgctggaatttggtagtgaatctggtgttctttataaaacgcttatgttttctcaagttgaaccacccagcagtgatgccatgatgcatgcacgttcttcagggcctgaaccttcttatgccttgtctgataatgagggctcccaacacatcttcactgtttcttacagttctgcaatacctgtgcatgattctgtgggtgtaacttatcagggttccttatttagcggccctagccatataccaatacctaagtcttcgttaataaccccaactgcatcattactgcagcctactcatgccctctctggtgatggggaatggtctggagcctcttctgatagtgaatttcttttacctgacacagatgggctgacagcccttaacatttcttcacctgtttctgtagctgaatttacatatacaacatctgtgtttggtgatgataataaggcgctttctaaaagtgaaataatatatggaaatgagactgaactgcaaattccttctttcaatgagatggtttacccttctgaaagcacagtcatgcccaacatgtatgataatgtaaataagttgaatgcgtctttacaagaaacctctgtttccatttctagcaccaagggcatgtttccagggtcccttgctcataccaccactaaggtttttgatcatgagattagtcaagttccagaaaataacttttcagttcaacctacacatactgtctctcaagcatctggtgacacttcgcttaaacctgtgcttagtgcaaactcagagccagcatcctctgaccctgcttctagtgaaatgttatctccttcaactcagctcttattttatgagacctcagcttcttttagtactgaagtattgctacaaccttcctttcaggcttctgatgttgacaccttgcttaaaactgttcttccagctgtgcccagtgatccaatattggttgaaacccccaaagttgataaaattagttctacaatgttgcatctcattgtatcaaattctgcttcaagtgaaaacatgctgcactctacatctgtaccagtttttgatgtgtcgcctacttctcatatgcactctgcttcacttcaaggtttgaccatttcctatgcaagtgagaaatatgaaccagttttgttaaaaagtgaaagttcccaccaagtggtaccttctttgtacagtaatgatgagttgttccaaacggccaatttggagattaaccaggcccatcccccaaaaggaaggcatgtatttgctacacctgttttatcaattgatgaaccattaaatacactaataaataagcttatacattccgatgaaattttaacctccaccaaaagttctgttactggtaaggtatttgctggtattccaacagttgcttctgatacatttgtatctactgatcattctgttcctataggaaatgggcatgttgccattacagctgtttctccccacagagatggttctgtaacctcaacaaagttgctgtttccttctaaggcaacttctgagctgagtcatagtgccaaatctgatgccggtttagtgggtggtggtgaagatggtgacactgatgatgatggtgatgatgatgatgatgacagaggtagtgatggcttatccattcataagtgtatgtcatgctcatcctatagagaatcacaggaaaaggtaatgaatgattcagacacccacgaaaacagtcttatggatcagaataatccaatctcatactcactatctgagaattctgaagaagataatagagtcacaagtgtatcctcagacagtcaaactggtatggacagaagtcctggtaaatcaccatcagcaaatgggctatcccaaaagcacaatgatggaaaagaggaaaatgacattcagactggtagtgctctgcttcctctcagccctgaatctaaagcatgggcagttctgacaagtgatgaagaaagtggatcagggcaaggtacctcagatagccttaatgagaatgagacttccacagatttcagttttgcagacactaatgaaaaagatgctgatgggatcctggcagcaggtgactcagaaataactcctggattcccacagtccccaacatcatctgttactagcgagaactcagaagtgttccacgtttcagaggcagaggccagtaatagtagccatgagtctcgtattggtctagctgaggggttggaatccgagaagaaggcagttataccccttgtgatcgtgtcagccctgacttttatctgtctagtggttcttgtgggtattctcatctactggaggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgagacactgaaagagttttaccaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaa

SEQ ID NO: 10782 - DNA, 4314 bp, synthetic construct
  misc_feature 1..4314: note = Synthetic polypeptide
  source 1..4314: mol_type = other DNA
ctggaaaacaatcaagatgtttatcagagcaggaagagtgaacaaattaaggcacatctcgactgtggagtactctgcagatgggtatgaggagcactgaatcaaaaaaattggggaaagaaatatccaacatgtaatagcccaaaacaatctcctatcaatattgatgaagatcttacacaagtaaatgtgaatcttaagaaacttaaatttcagggttgggataaaacatcattggaaaacacattcattcataacactgggaaaacagtggaaattaatctcactaatgactaccgtgtcagcggaggagtttcagaaatggtgtttaaagcaagcaagataacttttcactggggaaaatgcaatatgtcatctgatggatcagagcatagtttagaaggacaaaaatttccacttgagatgcaaatctactgctttgatgcggaccgattttcaagttttgaggaagcagtcaaaggaaaagggaagttaagagctttatccattttgtttgaggttgggacagaagaaaatttggatttcaaagcgattattgatggagtcgaaagtgttagtcgttttgggaagcaggctgctttagatccattcatactgttgaaccttctgccaaactcaactgacaagtattacatttacaatggctcattgacatctcctccctgcacagacacagttgactggattgtttttaaagatacagttagcatctctgaaagccagttggctgttttttgtgaagttcttacaatgcaacaatctggttatgtcatgctgatggactacttacaaaacaattttcgagagcaacagtacaagttctctagacaggtgttttcctcatacactggaaaggaagagattcatgaagcagtttgtagttcagaaccagaaaatgttcaggctgacccagagaattataccagccttcttgttacatgggaaagacctcgagtcgtttatgataccatgattgagaagtttgcagttttgtaccagcagttggatggagaggaccaaaccaagcatgaatttttgacagatggctatcaagacttgggtgctattctcaataatttgctacccaatatgagttatgttcttcagatagtagccatatgcactaatggcttatatggaaaatacagcgaccaactgattgtcgacatgcctactgataatcctgaacttgatcttttccctgaattaattggaactgaagaaataatcaaggaggaggaagagggaaaagacattgaagaaggcgctattgtgaatcctggtagagacagtgctacaaaccaaatcaggaaaaaggaaccccagatttctaccacaacacactacaatcgcatagggacgaaatacaatgaagccaagactaaccgatccccaacaagaggaagtgaattctctggaaagggtgatgttcccaatacatctttaaattccacttcccaaccagtcactaaattagccacagaaaaagatatttccttgacttctcagactgtgactgaactgccacctcacactgtggaaggtacttcagcctctttaaatgatggctctaaaactgttcttagatctccacatatgaacttgtcggggactgcagaatccttaaatacagtttctataacagaatatgaggaggagagtttattgaccagtttcaagcttgatactggagctgaagattcttcaggctccagtcccgcaacttctgctatcccattcatctctgagaacatatcccaagggtatatattttcctccgaaaacccagagacaataacatatgatgtccttataccagaatctgctagaaatgcttccgaagattcaacttcatcaggttcagaagaatcactaaaggatccttctatggagggaaatgtgtggtttcctagctctacagacataacagcacagcccgatgttggatcaggcagagagagctttctccagactaattacactgagatacgtgttgatgaatctgagaagacaaccaagtccttttctgcaggcccagtgatgtcacagggtccctcagttacagatctggaaatgccacattattctacctttgcctacttcccaactgaggtaacacctcatgcttttaccccatcctccagacaacaggatttggtctccacggtcaacgtggtatactcgcagacaacccaaccggtatacaatgaggccagtaatagtagccatgagtctcgtattggtctagctgaggggttggaatccgagaagaaggcagttataccccttgtgatcgtgtcagccctgacttttatctgtctagtggttcttgtgggtattctcatctactggaggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaa

SEQ ID NO: 10783 - DNA, 599 bp, synthetic construct
  misc_feature 1..599: note = Synthetic polypeptide
  source 1..599: mol_type = other DNA
ggccgggcgcggcggctcaagcttgtaatcccagcactttgggaggccgaggcgggcggatcacctgagaaccacagaataagagaactccagatttgcctgaagaagagtatgtgaaggaagaaatccaggagaatgaagaagcagtcaaaaagatgcttgtggaagccacccgggagtttgaggaggttgtggtggatgagagccctcctgattttgaaatacatataactatgtgtgatgatgatccacccacacctgaggaagactcagaaacacagcctgatgaggaggaagaagaagaagaagaaaaagtttctcaaccagaggtgggagctgccattaagatcattcggcagttaatggagaagtttaacttggatctatcaacagttacacaggccttcctaaaaaatagtggtgagctggaggctacttccgccttcttagcgtctggtcagagagctgatggatatcccatttggtcccgacaagatgacatagatttgcaaaaagatgatgaggataccagagaggcattggtcaaaaaatttggtgctcagaatgtagctcggaggattgaatttcgaaagaaataa

SEQ ID NO: 10784 - DNA, 82 bp, synthetic construct
  misc_feature 1..82: note = Synthetic polypeptide
  source 1..82: mol_type = other DNA
ggccgggcgcggcggctcaagcttgtaatcccagcactttgggaggccgaggcgggcggatcacctgagaaccacagaataa

SEQ ID NO: 10785 - DNA, 2450 bp, synthetic construct
  misc_feature 1..2450: note = Synthetic polypeptide
  source 1..2450: mol_type = other DNA
acctccctcagaaccaacttcatcctccctcccatggcctctcaggtccactgggatctgccctggcctgggtctgacctctctccctcccggtctctgcttcaccactttgctccaggcacactggccttcttgctgttcctcaaacctgccaagctcgtccctacctcagaaccttttcgctttccgttccttctgcccggaaacctcttcctccagatcttcgcgtggctcgcgtcctcacctcattcagaattgctgtgttttctgtgtctgtattttatgatgagcgcattgtggtggttgcggaacaaagacctgatgcttctgaggaagatagtttccagtggatgagccgcgtgctgcaggcgatcgatagcattcatcaagtgggggtttattgtcttgctctggtgccagccaatacattgccaaaaactccactaggaggaatccatatatctcagacgaaacaactctttctggagggatcactgcatccttgcaacatcctcatgtgcccccatacatgtgtgacaaacttgccaaagccccggcaaaaacaaccaggtgtaggccctgcttccgtgatggttgggaatctggttgctggaaaacgtatagcacaagctgctggaagggatctgggacaaatagaagagaatgatttggtgaggaagcaccagtttctggcagagatcctacagtggcgagcccaggcgactcctgaccatgtactcttcatgctgttaaatgccaagggaaccactgtatgcacagccagctgccttcagcttcataagcgagcagagaggattgcatctgttcttggtgataagggacatctaaatgcaggagataatgtggtgttgctctatccacctggcattgagttaatcgccgccttctatggctgcctgtatgcgggctgtatacctgtgaccgtcagacctccacatgctcagaacctcacggccacgctgcccactgtccgaatgattgttgatgtcagcaaagcagcctgtattctcaccagtcagaccctaatgaggctactgaggtcccgagaggcagcagcagctgtggatgtgaaaacctggccaaccatcattgacacagatgatttacccaggaaaaggttacctcagctgtataaaccgcccactcctgagatgttggcatatcttgattttagtgtctccacaactggcatgcttacaggagtgaagatgtcccactctgcagtgaacgctctgtgtcgagccatcaagctccagtgtgagttgtactcttctcggcagatcgccatctgccttgacccttactgtggacttggcttcgcgctctggtgtctctgcagtgtctattcaggccaccagtctgtcttaattcctcctatggagttagagaacaaccttttcctctggctctccacagtcaaccagtacaaaataagggacactttctgctcctattcagtgatggagctctgcaccaaaggtcttgggaaccaagtggaagtgctaaagaccagagggatcaacctctcctgcgtccggacctgtgtggtggtggcggaggagaggccccgcgttgcactccagcagtccttctctaagctcttcaaagacatcgggctgtccccgcgggctgtcagcaccacttttggatcaagagtcaatgtagcaatatgtttacagggaacctcagggcctgatccgactactgtgtatgtggatctgaaatcactaagacatgacagggttcgtctcgtggaacgtggcgcccctcagagtttgcttctctcagagtctggaaagattttacctggagtgaaagtggttattgttaatcctgagaccaaagggccggttggagactctcaccttggagagatttgggtgaacagtccccatacagccagcggctactacaccatctatgatagcgagactcttcaagctgatcatttcaacactcgcctcagctttggagatgcagctcagacactctgggctcggacaggataccttggttttgtccgccggaccgagctcacagcggccactggagagcgtcatgatgcattgtatgtggtgggagcgctggatgaaacactggagctgagaggattacgataccacccaattgatattgagacctcggtgtcccggatccacagaagcattgctgaatgtgccgtgttcacatggaccaacttgcttgtggtggttgtggaactgtgcggctctgaacaggaagccctagatctggtcccattagtgaccaacgtggtcctggaagagcattacctcatcgttggcgtcgtggttgtggtggacccaggtgtcatcccgatcaactccagaggagagaagcagaggatgcacctccgtgatagcttcctagctgaccagttagaccccatctacgtggcttataacatgtaa

SEQ ID NO: 10786 - DNA, 2075 bp, synthetic construct; identical to SEQ ID NO: 8876
  misc_feature 1..2075: note = Synthetic polypeptide
  source 1..2075: mol_type = other DNA

SEQ ID NO: 10787 - DNA, 1901 bp, synthetic construct; identical to SEQ ID NO: 8877
  misc_feature 1..1901: note = Synthetic polypeptide
  source 1..1901: mol_type = other DNA

SEQ ID NO: 10788 - DNA, 2377 bp, synthetic construct
  misc_feature 1..2377: note = Synthetic polypeptide
  source 1..2377: mol_type = other DNA
ctaccaggagttgactcatgttgaccaagcaagcttccaggttgatgcctttggaacgtcattcattctcgatgtcgtgctaaatcatgatttgctgtcctctgaatacatagagagacacattgaacatggaggcaagactgtggaagttaaaggaggagagcactgttactaccagggccatatccgaggaaaccctgactcatttgttgcattgtcaacatgccacggacttcatgggatgttctatgacgggaaccacacatatctcattgagccagaagaaaatgacactactcaagaggatttccattttcattcagtttacaaatccagactgtttgaattttccttggatgatcttccatctgaatttcagcaagtaaacattactccatcaaaatttattttgaagccaagaccaaaaaggagtaaacggcagcttcgtcgatatcctcgtaatgtagaagaagaaaccaaatacattgaactgatgattgtgaatgatcaccttatgtttaaaaaacatcggctttccgttgtacataccaatacctatgcgaaatctgtggtgaacatggcagatttaatatataaagaccaacttaagaccaggatagtattggttgctatggaaacctgggcgactgacaacaagtttgccatatctgaaaatccattgatcaccctacgtgagtttatgaaatacaggagggattttatcaaagagaaaagtgatgcagttcaccttttttcgggaagtcaatttgagagtagccggagcggggcagcttatattggtgggatttgctcgttgctgaaaggaggaggcgtgaatgaatttgggaaaactgatttaatggctgttacacttgcccagtcattagcccataatattggtattatctcagacaaaagaaagttagcaagtggtgaatgtaaatgcgaggacacgtggtccgggtgcataatgggagacactggctattatcttcctaaaaagttcacccagtgtaatattgaagagtatcatgacttcctgaatagtggaggtggtgcctgccttttcaacaaaccttctaagcttcttgatcctcctgagtgtggcaatggcttcattgaaactggagaggagtgtgattgtggaaccccggccgaatgtgtccttgaaggagcagagtgttgtaagaaatgcaccttgactcaagactctcaatgcagtgacggtctttgctgtaaaaagtgcaagtttcagcctatgggcactgtgtgccgagaagcagtaaatgattgtgatattcgtgaaacgtgctcaggaaattcaagccagtgtgcccctaatattcataaaatggatggatattcatgtgatggtgttcagggaatttgctttggaggaagatgcaaaaccagagatagacaatgcaaatacatttgggggcaaaaggtgacagcatcagacaaatattgctatgagaaactgaatattgaagggacggagaagggtaactgtgggaaagacaaagacacatggatacagtgcaacaaacgggatgtgctttgtggttaccttttgtgtaccaatattggcaatatcccaaggcttggagaactcgatggtgaaatcacatctactttagttgtgcagcaaggaagaacattaaactgcagtggtgggcatgttaagcttgaagaagatgtagatcttggctatgtggaagatgggacaccttgtggtccccaaatgatgtgcttagaacacaggtgtcttcctgtggcttctttcaactttagtacttgcttgagcagtaaagaaggcactatttgctcaggaaatggagtttgcagtaatgagctgaagtgtgtgtgtaacagacactggataggttctgattgcaacacttacttccctcacaatgatgatgcaaagactggtatcactctgtctggcaatggtgttgctggcaccaatatcataataggcataattgctggcaccattttagtgctggccctcatattaggaataactgcgtggggttataaaaactatcgagaacagaggtcaaatgggctctctcattcttggagtgaaaggattccagacacaaaacatatttcagacatctgtgaaaatgggcgacctcgaagtaactcttggcaaggtaacctgggaggcaacaaaaagaaaatcagaggcaaaagatttagacctcggtctaattcaactgagactttatctcctgccaagtctccttcttcatcaactgggtctattgcctccagcagaaaatacccttacccaatgcctccacttcctgatgaggacaagaaagtgaaccgacaaagtgccaggctatgggagacatccatttaa

SEQ ID NO: 10789 - DNA, 793 bp, synthetic construct
  misc_feature 1..793: note = Synthetic polypeptide
  source 1..793: mol_type = other DNA
ctaccaggagttgactcatgttgaccaagcaagcttccaggttgatgcctttggaacgtcattcattctcgatgtcgtgctaaatcatgatttgctgtcctctgaatacatagagagacacattgaacatggaggcaagactgtggaagttaaaggaggagagcactgttactaccagggccatatccgaggaaaccctgactcatttgttgcattgtcaacatgccacggacttcatgggatgttctatgacgggaaccacacatatctcattgagccagaagaaaatgacactactcaagaggatttccattttcattcagtttacaaatccagactgtttgaattttccttggatgatcttccatctgaatttcagcaagtaaacattactccatcaaaatttattttgaagccaagaccaaaaaggagtaaacggcagcttcgtcgatatcctcgtaatgtagaagaagaaaccaaatacattgaactgatgattgtgaatgatcaccttatgtttaaaaaacatcggctttccgttgtacataccaatacctatgcgaaatctgtggtgaacatggcagatttaatatataaagaccaacttaagaccaggatagtattggttgctatggaaacctgggcgactgacaacaagtttgccatatctgaaaatccattgatcaccctacgtgagtttatgaaatacaggagggattttatcaaagagaaaagtgatgcagttcaccttttttcgtacgtaacttctgtaatgatgtattactttttttga

SEQ ID NO: 10790 - DNA, 302 bp, synthetic construct
  misc_feature 1..302: note = Synthetic polypeptide
  source 1..302: mol_type = other DNA
ctaccaggagttgactcatgttgaccaagcaagcttccaggttgatgcctttggaacgtcattcattctcgatgtcgtgctaaatcatgatttgctgtcctctgaatacatagagagacacattgaacatggaggcaagactgtggaagttaaaggaggagagcactgttactaccagggccatatccgaggaaaccctgactcatttgttgcattgtcaacatgccacggacttcatgggatgttctatgacgggaaccacacatatctcattgagccagaagaaaatgacactactcaag

SEQ ID NO: 10791 - DNA, 2344 bp, synthetic construct
  misc_feature 1..2344: note = Synthetic polypeptide
  source 1..2344: mol_type = other DNA
ctaccaggagttgactcatgttgaccaagcaagcttccaggttgatgcctttggaacgtcattcattctcgatgtcgtgctaaatcatgatttgctgtcctctgaatacatagagagacacattgaacatggaggcaagactgtggaagttaaaggaggagagcactgttactaccagggccatatccgaggaaaccctgactcatttgttgcattgtcaacatgccacggacttcatgggatgttctatgacgggaaccacacatatctcattgagccagaagaaaatgacactactcaagaggatttccattttcattcagtttacaaatccagactgtttgaattttccttggatgatcttccatctgaatttcagcaagtaaacattactccatcaaaatttattttgaagccaagaccaaaaaggagtaaacggcagcttcgtcgatatcctcgtaatgtagaagaagaaaccaaatacattgaactgatgattgtgaatgatcaccttatgtttaaaaaacatcggctttccgttgtacataccaatacctatgcgaaatctgtggtgaacatggcagatttaatatataaagaccaacttaagaccaggatagtattggttgctatggaaacctgggcgactgacaacaagtttgccatatctgaaaatccattgatcaccctacgtgagtttatgaaatacaggagggattttatcaaagagaaaagtgatgcagttcaccttttttcgggaagtcaatttgagagtagccggagcggggcagcttatattggtgggatttgctcgttgctgaaaggaggaggcgtgaatgaatttgggaaaactgatttaatggctgttacacttgcccagtcattagcccataatattggtattatctcagacaaaagaaagttagcaagtggtgaatgtaaatgcgaggacacgtggtccgggtgcataatgggagacactggctattatcttcctaaaaagttcacccagtgtaatattgaagagtatcatgacttcctgaatagtggaggtggtgcctgccttttcaacaaaccttctaagcttcttgatcctcctgagtgtggcaatggcttcattgaaactggagaggagtgtgattgtggaaccccggccgaatgtgtccttgaaggagcagagtgttgtaagaaatgcaccttgactcaagactctcaatgcagtgacggtctttgctgtaaaaagtgcaagtttcagcctatgggcactgtgtgccgagaagcagtaaatgattgtgatattcgtgaaacgtgctcaggaaattcaagccagtgtgcccctaatattcataaaatggatggatattcatgtgatggtgttcagggaatttgctttggaggaagatgcaaaaccagagatagacaatgcaaatacatttgggggcaaaaggtgacagcatcagacaaatattgctatgagaaactgaatattgaagggacggagaagggtaactgtgggaaagacaaagacacatggatacagtgcaacaaacgggatgtgctttgtggttaccttttgtgtaccaatattggcaatatcccaaggcttggagaactcgatggtgaaatcacatctactttagttgtgcagcaaggaagaacattaaactgcagtggtgggcatgttaagcttgaagaagatgtagatcttggctatgtggaagatgggacaccttgtggtccccaaatgatgtgcttagaacacaggtgtcttcctgtggcttctttcaactttagtacttgcttgagcagtaaagaaggcactatttgctcaggaaatggagtttgcagtaatgagctgaagtgtgtgtgtaacagacactggataggttctgattgcaacacttacttccctcacaatgatgatgcaaagactggtatcactctgtctggcaatggtgttgctggcaccaatatcataataggcataattgctggcaccattttagtgctggccctcatattaggaataactgcgtggggttataaaaactatcgagaacagagacagttaccccagggagattatgtaaaaaagcctggagatggtgactctttttatagcgacattcctcccggagtcagcacaaactcagcatctagttctaagaagaggtcaaatgggctctctcattcttggagtgaaaggattccagacacaaaacatatttcagacatctgtgaaaatgggcgacctcgaagtaactcttggcaaggtaacctgggaggcaacaaaaagaaaatcagaggcaaaagatttagacctcggtctaattcaactgagtaa

SEQ ID NO: 10792 - DNA, 2485 bp, synthetic construct
  misc_feature 1..2485: note = Synthetic polypeptide
  source 1..2485: mol_type = other DNA
ctaccaggagttgactcatgttgaccaagcaagcttccaggttgatgcctttggaacgtcattcattctcgatgtcgtgctaaatcatgatttgctgtcctctgaatacatagagagacacattgaacatggaggcaagactgtggaagttaaaggaggagagcactgttactaccagggccatatccgaggaaaccctgactcatttgttgcattgtcaacatgccacggacttcatgggatgttctatgacgggaaccacacatatctcattgagccagaagaaaatgacactactcaagaggatttccattttcattcagtttacaaatccagactgtttgaattttccttggatgatcttccatctgaatttcagcaagtaaacattactccatcaaaatttattttgaagccaagaccaaaaaggagtaaacggcagcttcgtcgatatcctcgtaatgtagaagaagaaaccaaatacattgaactgatgattgtgaatgatcaccttatgtttaaaaaacatcggctttccgttgtacataccaatacctatgcgaaatctgtggtgaacatggcagatttaatatataaagaccaacttaagaccaggatagtattggttgctatggaaacctgggcgactgacaacaagtttgccatatctgaaaatccattgatcaccctacgtgagtttatgaaatacaggagggattttatcaaagagaaaagtgatgcagttcaccttttttcgggaagtcaatttgagagtagccggagcggggcagcttatattggtgggatttgctcgttgctgaaaggaggaggcgtgaatgaatttgggaaaactgatttaatggctgttacacttgcccagtcattagcccataatattggtattatctcagacaaaagaaagttagcaagtggtgaatgtaaatgcgaggacacgtggtccgggtgcataatgggagacactggctattatcttcctaaaaagttcacccagtgtaatattgaagagtatcatgacttcctgaatagtggaggtggtgcctgccttttcaacaaaccttctaagcttcttgatcctcctgagtgtggcaatggcttcattgaaactggagaggagtgtgattgtggaaccccggccgaatgtgtccttgaaggagcagagtgttgtaagaaatgcaccttgactcaagactctcaatgcagtgacggtctttgctgtaaaaagtgcaagtttcagcctatgggcactgtgtgccgagaagcagtaaatgattgtgatattcgtgaaacgtgctcaggaaattcaagccagtgtgcccctaatattcataaaatggatggatattcatgtgatggtgttcagggaatttgctttggaggaagatgcaaaaccagagatagacaatgcaaatacatttgggggcaaaaggtgacagcatcagacaaatattgctatgagaaactgaatattgaagggacggagaagggtaactgtgggaaagacaaagacacatggatacagtgcaacaaacgggatgtgctttgtggttaccttttgtgtaccaatattggcaatatcccaaggcttggagaactcgatggtgaaatcacatctactttagttgtgcagcaaggaagaacattaaactgcagtggtgggcatgttaagcttgaagaagatgtagatcttggctatgtggaagatgggacaccttgtggtccccaaatgatgtgcttagaacacaggtgtcttcctgtggcttctttcaactttagtacttgcttgagcagtaaagaaggcactatttgctcaggaaatggagtttgcagtaatgagctgaagtgtgtgtgtaacagacactggataggttctgattgcaacacttacttccctcacaatgatgatgcaaagactggtatcactctgtctggcaatggtgttgctggcaccaatatcataataggcataattgctggcaccattttagtgctggccctcatattaggaataactgcgtggggttataaaaactatcgagaacagagacagttaccccagggagattatgtaaaaaagcctggagatggtgactctttttatagcgacattcctcccggagtcagcacaaactcagcatctagttctaagaagaggtcaaatgggctctctcattcttggagtgaaaggattccagacacaaaacatatttcagacatctgtgaaaatgggcgacctcgaagtaactcttggcaaggtaacctgggaggcaacaaaaagaaaatcagaggcaaaagatttagacctcggtctaattcaactgagactttatctcctgccaagtctccttcttcatcaactgggtctattgcctccagcagaaaatacccttacccaatgcctccacttcctgatgaggacaagaaagtgaaccgacaaagtgccaggctatgggagacatccatttaa

SEQ ID NO: 10793 - DNA, 2464 bp, synthetic construct
  misc_feature 1..2464: note = Synthetic polypeptide
  source 1..2464: mol_type = other DNA
ctaccaggagttgactcatgttgaccaagcaagcttccaggttgatgcctttggaacgtcattcattctcgatgtcgtgctaaatcatgatttgctgtcctctgaatacatagagagacacattgaacatggaggcaagactgtggaagttaaaggaggagagcactgttactaccagggccatatccgaggaaaccctgactcatttgttgcattgtcaacatgccacggacttcatgggatgttctatgacgggaaccacacatatctcattgagccagaagaaaatgacactactcaagaggatttccattttcattcagtttacaaatccagactgtttgaattttccttggatgatcttccatctgaatttcagcaagtaaacattactccatcaaaatttattttgaagccaagaccaaaaaggagtaaacggcagcttcgtcgatatcctcgtaatgtagaagaagaaaccaaatacattgaactgatgattgtgaatgatcaccttatgtttaaaaaacatcggctttccgttgtacataccaatacctatgcgaaatctgtggtgaacatggcagatttaatatataaagaccaacttaagaccaggatagtattggttgctatggaaacctgggcgactgacaacaagtttgccatatctgaaaatccattgatcaccctacgtgagtttatgaaatacaggagggattttatcaaagagaaaagtgatgcagttcaccttttttcgggaagtcaatttgagagtagccggagcggggcagcttatattggtgggatttgctcgttgctgaaaggaggaggcgtgaatgaatttgggaaaactgatttaatggctgttacacttgcccagtcattagcccataatattggtattatctcagacaaaagaaagttagcaagtggtgaatgtaaatgcgaggacacgtggtccgggtgcataatgggagacactggctattatcttcctaaaaagttcacccagtgtaatattgaagagtatcatgacttcctgaatagtggaggtggtgcctgccttttcaacaaaccttctaagcttcttgatcctcctgagtgtggcaatggcttcattgaaactggagaggagtgtgattgtggaaccccggccgaatgtgtccttgaaggagcagagtgttgtaagaaatgcaccttgactcaagactctcaatgcagtgacggtctttgctgtaaaaagtgcaagtttcagcctatgggcactgtgtgccgagaagcagtaaatgattgtgatattcgtgaaacgtgctcaggaaattcaagccagtgtgcccctaatattcataaaatggatggatattcatgtgatggtgttcagggaatttgctttggaggaagatgcaaaaccagagatagacaatgcaaatacatttgggggcaaaaggtgacagcatcagacaaatattgctatgagaaactgaatattgaagggacggagaagggtaactgtgggaaagacaaagacacatggatacagtgcaacaaacgggatgtgctttgtggttaccttttgtgtaccaatattggcaatatcccaaggcttggagaactcgatggtgaaatcacatctactttagttgtgcagcaaggaagaacattaaactgcagtggtgggcatgttaagcttgaagaagatgtagatcttggctatgtggaagatgggacaccttgtggtccccaaatgatgtgcttagaacacaggtgtcttcctgtggcttctttcaactttagtacttgcttgagcagtaaagaaggcactatttgctcaggaaatggagtttgcagtaatgagctgaagtgtgtgtgtaacagacactggataggttctgattgcaacacttacttccctcacaatgatgatgcaaagactggtatcactctgtctggcaatggtgttgctggcaccaatatcataataggcataattgctggcaccattttagtgctggccctcatattaggaataactgcgtggggttataacaatattttcaatttcaggtcaaatgggctctctcattcttggagtgaaaggattccagacacaaaacatatttcagacatctgtgaaaatgggcgacctcgaagtaactcttggcaaggtaacctgggaggcaacaaaaagaaaatcagaggcaaaagatttagacctcggtctaattcaactgagtatttaaacccatggttcaaaagagactataatgtagctaagtgggtagaagatgtgaataaaaacactgaaggaccatactttaggactttatctcctgccaagtctccttcttcatcaactgggtctattgcctccagcagaaaatacccttacccaatgcctccacttcctgatgaggacaagaaagtgaaccgacaaagtgccaggctatgggagacatccatttaa

SEQ ID NO: 10794 - DNA, 2464 bp, synthetic construct
  misc_feature 1..2464: note = Synthetic polypeptide
  source 1..2464: mol_type = other DNA
ctaccaggagttgactcatgttgaccaagcaagcttccaggttgatgcctttggaacgtcattcattctcgatgtcgtgctaaatcatgatttgctgtcctctgaatacatagagagacacattgaacatggaggcaagactgtggaagttaaaggaggagagcactgttactaccagggccatatccgaggaaaccctgactcatttgttgcattgtcaacatgccacggacttcatgggatgttctatgacgggaaccacacatatctcattgagccagaagaaaatgacactactcaagaggatttccattttcattcagtttacaaatccagactgtttgaattttccttggatgatcttccatctgaatttcagcaagtaaacattactccatcaaaatttattttgaagccaagaccaaaaaggagtaaacggcagcttcgtcgatatcctcgtaatgtagaagaagaaaccaaatacattgaactgatgattgtgaatgatcaccttatgtttaaaaaacatcggctttccgttgtacataccaatacctatgcgaaatctgtggtgaacatggcagatttaatatataaagaccaacttaagaccaggatagtattggttgctatggaaacctgggcgactgacaacaagtttgccatatctgaaaatccattgatcaccctacgtgagtttatgaaatacaggagggattttatcaaagagaaaagtgatgcagttcaccttttttcgggaagtcaatttgagagtagccggagcggggcagcttatattggtgggatttgctcgttgctgaaaggaggaggcgtgaatgaatttgggaaaactgatttaatggctgttacacttgcccagtcattagcccataatattggtattatctcagacaaaagaaagttagcaagtggtgaatgtaaatgcgaggacacgtggtccgggtgcataatgggagacactggctattatcttcctaaaaagttcacccagtgtaatattgaagagtatcatgacttcctgaatagtggaggtggtgcctgccttttcaacaaaccttctaagcttcttgatcctcctgagtgtggcaatggcttcattgaaactggagaggagtgtgattgtggaaccccggccgaatgtgtccttgaaggagcagagtgttgtaagaaatgcaccttgactcaagactctcaatgcagtgacggtctttgctgtaaaaagtgcaagtttcagcctatgggcactgtgtgccgagaagcagtaaatgattgtgatattcgtgaaacgtgctcaggaaattcaagccagtgtgcccctaatattcataaaatggatggatattcatgtgatggtgttcagggaatttgctttggaggaagatgcaaaaccagagatagacaatgcaaatacatttgggggcaaaaggtgacagcatcagacaaatattgctatgagaaactgaatattgaagggacggagaagggtaactgtgggaaagacaaagacacatggatacagtgcaacaaacgggatgtgctttgtggttaccttttgtgtaccaatattggcaatatcccaaggcttggagaactcgatggtgaaatcacatctactttagttgtgcagcaaggaagaacattaaactgcagtggtgggcatgttaagcttgaagaagatgtagatcttggctatgtggaagatgggacaccttgtggtccccaaatgatgtgcttagaacacaggtgtcttcctgtggcttctttcaactttagtacttgcttgagcagtaaagaaggcactatttgctcaggaaatggagtttgcagtaatgagctgaagtgtgtgtgtaacagacactggataggttctgattgcaacacttacttccctcacaatgatgatgcaaagactggtatcactctgtctggcaatggtgttgctggcaccaatatcataataggcataattgctggcaccattttagtgctggccctcatattaggaataactgcgtggggttataaaaactatcgagaacagaggtcaaatgggctctctcattcttggagtgaaaggattccagacacaaaacatatttcagacatctgtgaaaatgggcgacctcgaagtaactcttggcaaggtaacctgggaggcaacaaaaagaaaatcagaggcaaaagatttagacctcggtctaattcaactgagtatttaaacccatggttcaaaagagactataatgtagctaagtgggtagaagatgtgaataaaaacactgaaggaccatactttaggactttatctcctgccaagtctccttcttcatcaactgggtctattgcctccagcagaaaatacccttacccaatgcctccacttcctgatgaggacaagaaagtgaaccgacaaagtgccaggctatgggagacatccatttaa

SEQ ID NO: 10795 - DNA, 2276 bp, synthetic construct
  misc_feature 1..2276: note = Synthetic polypeptide
  source 1..2276: mol_type = other DNA
ctaccaggagttgactcatgttgaccaagcaagcttccaggttgatgcctttggaacgtcattcattctcgatgtcgtgctaaatcatgatttgctgtcctctgaatacatagagagacacattgaacatggaggcaagactgtggaagttaaaggaggagagcactgttactaccagggccatatccgaggaaaccctgactcatttgttgcattgtcaacatgccacggacttcatgggatgttctatgacgggaaccacacatatctcattgagccagaagaaaatgacactactcaagaggatttccattttcattcagtttacaaatccagactgtttgaattttccttggatgatcttccatctgaatttcagcaagtaaacattactccatcaaaatttattttgaagccaagaccaaaaaggagtaaacggcagcttcgtcgatatcctcgtaatgtagaagaagaaaccaaatacattgaactgatgattgtgaatgatcaccttatgtttaaaaaacatcggctttccgttgtacataccaatacctatgcgaaatctgtggtgaacatggcagatttaatatataaagaccaacttaagaccaggatagtattggttgctatggaaacctgggcgactgacaacaagtttgccatatctgaaaatccattgatcaccctacgtgagtttatgaaatacaggagggattttatcaaagagaaaagtgatgcagttcaccttttttcgggaagtcaatttgagagtagccggagcggggcagcttatattggtgggatttgctcgttgctgaaaggaggaggcgtgaatgaatttgggaaaactgatttaatggctgttacacttgcccagtcattagcccataatattggtattatctcagacaaaagaaagttagcaagtggtgaatgtaaatgcgaggacacgtggtccgggtgcataatgggagacactggctattatcttcctaaaaagttcacccagtgtaatattgaagagtatcatgacttcctgaatagtggaggtggtgcctgccttttcaacaaaccttctaagcttcttgatcctcctgagtgtggcaatggcttcattgaaactggagaggagtgtgattgtggaaccccggccgaatgtgtccttgaaggagcagagtgttgtaagaaatgcaccttgactcaagactctcaatgcagtgacggtctttgctgtaaaaagtgcaagtttcagcctatgggcactgtgtgccgagaagcagtaaatgattgtgatattcgtgaaacgtgctcaggaaattcaagccagtgtgcccctaatattcataaaatggatggatattcatgtgatggtgttcagggaatttgctttggaggaagatgcaaaaccagagatagacaatgcaaatacatttgggggcaaaaggtgacagcatcagacaaatattgctatgagaaactgaatattgaagggacggagaagggtaactgtgggaaagacaaagacacatggatacagtgcaacaaacgggatgtgctttgtggttaccttttgtgtaccaatattggcaatatcccaaggcttggagaactcgatggtgaaatcacatctactttagttgtgcagcaaggaagaacattaaactgcagtggtgggcatgttaagcttgaagaagatgtagatcttggctatgtggaagatgggacaccttgtggtccccaaatgatgtgcttagaacacaggtgtcttcctgtggcttctttcaactttagtacttgcttgagcagtaaagaaggcactatttgctcaggaaatggagtttgcagtaatgagctgaagtgtgtgtgtaacagacactggataggttctgattgcaacacttacttccctcacaatgatgatgcaaagactggtatcactctgtctggcaatggtgttgctggcaccaatatcataataggcataattgctggcaccattttagtgctggccctcatattaggaataactgcgtggggttataaaaactatcgagaacagagacagttaccccagggagattatgtaaaaaagcctggagatggtgactctttttatagcgacattcctcccggagtcagcacaaactcagcatctagttctaagaagaggtcaaatgggctctctcattcttggagtgaaaggattccagacacaaaacatatttcagacatctgtgaaaatgggcgacctcgaagtaactcttggcaaggta

SEQ ID NO: 10796 - DNA, 119 bp, synthetic construct; identical to SEQ ID NO: 6582
  misc_feature 1..119: note = Synthetic polypeptide
  source 1..119: mol_type = other DNA

SEQ ID NO: 10797 - DNA, 395 bp, synthetic construct
  misc_feature 1..395: note = Synthetic polypeptide
  source 1..395: mol_type = other DNA
gatttttaaactgtgtttctagcagcgcttaggcttagcaaagatgccggggataggaggagctgctgagagggaaggactggccatcggcacctcagttatggcagctctgccttggcatgctggaagatggactgccctccaatggtgtgccccgatctacagccccaggtggaatacccaacccagagaagaagacgaactgtgagacccagtgcccaaatccccagagcctcagctcaggccctctgacccagaaacagaatggccttcagaccacagaggctaaaagagatgctaagagaatgcctgcaaaagaagtcaccattaatgtaacagatagcatccaacagatggacagaagtcgaagaatcacaaagaactgtgtcaactag

SEQ ID NO: 10798 - DNA, 906 bp, synthetic construct; identical to SEQ ID NO: 8754
  misc_feature 1..906: note = Synthetic polypeptide
  source 1..906: mol_type = other DNA

SEQ ID NO: 10799 - DNA, 795 bp, synthetic construct; identical to SEQ ID NO: 8755
  misc_feature 1..795: note = Synthetic polypeptide
  source 1..795: mol_type = other DNA

SEQ ID NO: 10800 - DNA, 399 bp, synthetic construct; identical to SEQ ID NO: 8756
  misc_feature 1..399: note = Synthetic polypeptide
  source 1..399: mol_type = other DNA

SEQ ID NO: 10801 - DNA, 393 bp, synthetic construct; identical to SEQ ID NO: 8757
  misc_feature 1..393: note = Synthetic polypeptide
  source 1..393: mol_type = other DNA

SEQ ID NO: 10802 - DNA, 1769 bp, synthetic construct
  misc_feature 1..1769: note = Synthetic polypeptide
  source 1..1769: mol_type = other DNA
ggccggttccagccaccaagttaaacacgatgagcaaaaccagccttggccagagcatgagcaagtatgacctcctggtttggtttgagatcagtgaactggagcctacaggagagtatatcccagctgtggttgaccacacagcaggcttgccttgccaggggacatttttgcttcatcagggcatccagcgaaggatcacagtgaccattatccatgagaaggggagcgagctccattggaaagatgttcgtgaactggtggtaggtcgtattcggaataagcctgaggtggatgaagctgcagttgatgccatcctctccctaaatattatttctgccaagtacctgaagtcttcccacaactctagcaggaccttctaccgctttgaggctgtgtgggatagctctctgcataactcccttcttctgaaccgagtgacaccctatggagaaaagatctacatgaccttgtcggcctacctagagctggatcattgcatccagccggctgtcatcaccaaggatgtgtgcatggtcttctactcccgagatgccaagatctcaccaccacgctctctgcgtagcctctttggcagcggctactcaaagtcaccagattcgaatcgagtcactggcatttacgaactcagcttatgcaaaatgtcagacacaggtagtccaggtatgcagagaaggagaagaaaaatcttagatacgtcagtggcatatgtgcggggagaagagaacttagcaggctggcggccccgtggagacagcctcatccttgagcaccagtgggagctggagaagctggagctcctacatgaggtggaaaaaacccgccactttttgctgctgcgtgagagacttggtgacagcatccccaaatccctgagcgactcgttatcccccagcctcagcagtgggaccctcagcacctccaccagtatctcctctcagatctcaaccactacctttgaaagcgccatcacacctagcgagagcagtggctatgattcaggagacatcgaaagcctggtggaccgagagaaagagctggctaccaagtgcctgcaacttctcacccacactttcaacagagaattcagccaggtgcacggcagcgtcagtgactgtaagttgtctgatatctctccaattggacgggatccctctgagtccagtttcagcagtgccaccctcactccctcctccacctgtccctctctggtagactctaggagcaactctctggatcagaagaccccagaagccaattcccgggcctctagtccctgcccagaatttgaacagtttcagattgtcccagctgtggaaacaccatatttggcccgagcaggaaaaaacgaatttctcaatcttgttccagatattgaagaaattagaccaagctcagtggtctctaagaaaggataccttcatttcaaggagcctctttacagtaactgggctaaacattttgttgtcgtccgtcggccttatgtcttcatctataacagtgacaaagaccctgtggagcgtggaatcattaacctgtccacagcacaggtggagtacagtgaggaccagcaggccatggtgaagacaccaaacacctttgctgtctgcacaaagcaccgtggggtccttttgcaggccctcaatgacaaagacatgaacgactggttgtatgccttcaacccacttctagctggcacaatacggtcaaagctttcccgcagatgcccgagccagtcgaaatactaa

SEQ ID NO: 10803 - DNA, 1790 bp, synthetic construct
  misc_feature 1..1790: note = Synthetic polypeptide
  source 1..1790: mol_type = other DNA
ggccggttccagccaccaagttaaacacgatgagcaaaaccagccttggccagagcatgagcaagtatgacctcctggtttggtttgagatcagtgaactggagcctacaggagagtatatcccagctgtggttgaccacacagcaggcttgccttgccaggggacatttttgcttcatcagggcatccagcgaaggatcacagtgaccattatccatgagaaggggagcgagctccattggaaagatgttcgtgaactggtggtaggtcgtattcggaataagcctgaggtggatgaagctgcagttgatgccatcctctccctaaatattatttctgccaagtacctgaagtcttcccacaactctagcaggaccttctaccgctttgaggctgtgtgggatagctctctgcataactcccttcttctgaaccgagtgacaccctatggagaaaagatctacatgaccttgtcggcctacctagagctggatcattgcatccagccggctgtcatcaccaaggatgtgtgcatggtcttctactcccgagatgccaagatctcaccaccacgctctctgcgtagcctctttggcagcggctactcaaagtcaccagattcgaatcgagtcactggcatttacgaactcagcttatgcaaaatgtcagacacaggtagtccaggtatgcagagaaggagaagaaaaatcttagatacgtcagtggcatatgtgcggggagaagagaacttagcaggctggcggccccgtggagacagcctcatccttgagcaccagtgggagctggagaagctggagctcctacatgaggtggaaaaaacccgccactttttgctgctgcgtgagagacttggtgacagcatccccaaatccctgagcgactcgttatcccccagcctcagcagtgggaccctcagcacctccaccagtatctcctctcagatctcaaccactacctttgaaagcgccatcacacctagcgagagcagtggctatgattcaggagacatcgaaagcctggtggaccgagagaaagagctggctaccaagtgcctgcaacttctcacccacactttcaacagagaattcagccaggtgcacggcagcgtcagtgactgtaagttgtctgatatctctccaattggacgggatccctctgagtccagtttcagcagtgccaccctcactccctcctccacctgtccctctctggtagactctaggagcaactctctggatcagaagaccccagaagccaattcccgggcctctagtccctgcccagaatttgaacagtttcagattgtcccagctgtggaaacaccatatttggcccgagcaggaaaaaacgaatttctcaatcttgttccagatattgaagaaattagaccaagctcagtggtctctaagaaaggataccttcatttcaaggagcctctttacagtaactgggctaaacattttgttgtcgtccgtcggccttatgtcttcatctataacagtgacaaagaccctgtggagcgtggaatcattaacctgtccacagcacaggtggagtacagtgaggaccagcaggccatggtgaagacaccaaacacctttgctgtctgcacaaagcaccgtggggtccttttgcaggccctcaatgacaaagacatgaacgactggttgtatgccttcaacccacttctagctggcacaatacgaccaggtcatctggcttccgagatcatcagagaagataagtctgtctctttcagctgccagtaa

SEQ ID NO: 10804 - DNA, 2524 bp, synthetic construct
  misc_feature 1..2524: note = Synthetic polypeptide
  source 1..2524: mol_type = other DNA
tctttatctccatttgcatcacttgctgctattgggcatgcatctgttttatgtgtgtccacccatttgactgtgagcctgcgagggcaggcatggctgatggtgcctgggtcacagtatgggcgtcgtcaatattgattggtccccggaggccagctccctgcacatcctggagagacaggtgcaagagctacagcagttgctggtggagagacaagaggagaaggagagcctgggacgggaggtggagagtttgcagagccggctgtccctgctggagaacgagcgggagaatactagctatgacgtaaccaccctgcaggatgaggagggtgagctgcctgaccttccaggggccgaggtgctgctgtccagacaactcagtccgtcggcccaggaacacctggcctcgctgcaggaacaggtggctgtgctcaccagacagaaccaggaactgatggagaaggtccagatcctggagaactttgagaaggacgagacacagatggaagtggaagctttggcagaggtcatccctcttgccctctatgactctctccgggccgagtttgaccagctacgcaggcagcacgctgaggccctgcaggccctgaggcagcaggagacacgagaggtccccagagaagagggggcagcctgtggggagagtgaggttgctggagccacggccaccaaaaacgggccaacccacatggagctaaatggctcagtggctccagaaaccaaagttaacggagccgagaccatagatgaggaggctgcaggagatgaaaccatggaagccaggactatggaagctgaggccacgggagccgaggccacgggagctgaggccacaggagccaaggtcacagaaacaaaacccacaggggctgaggtcagagaaatggagaccacagaagaagaagcaaacatggaaactaagcccacaggagctcaggccacagacacagagaccacgggagtggaggccatgggggtggaggccacaaaaacaaaagcagaggaagcagaaatgcaggcctacggagtgggtgctgggcaagcagagcccccagtcacagggaccacaaacatggaggccacgggctctagggccacagggatggaatccacaggagtcagtgccacaggtgtggagaacccaggggtagaggccacggtcccggggatctctgctggccccatcctacatcctggtgccgcagaggcctcggaaaagcttcaagtagagctggagaccaggatccgtggcttggaggaggctctccggcagcgggagcgggaggcagctgcggagctggaggcggccctggggaagtgcgaggccgcggaggccgaggcaggccggctgcgagagcgtgtccgcgaggccgagggcagcggggccagcgggggcggtggcggtgacaccacacagctgcgggcggccctggagcaggcccgggaggacctccgagaccgggactcccgcctgcgggagctggaggcggcctcggcctgcctggatgaggctcgggccagccggctgctggcggaggaggaggcgcggggcctgcgggccgagctggcccagcgggaggaggcgcggctggagcagagccgggagctggaggttctgcgggagcagctggccacggccagggccacgggggagcagcagcgcacggcggccgcggaactgggccgggcacgggacgccgctgaggcccgagtggctgagctgcctgcggcctgcgaggaggcgcggcagggcctggccgagctgcgggaggcctccgaggccctccgccagtccgtggtgccggcctctgagcaccgccggctgcaggaggaggccctggagctgcggggccgggcagccagtctggagcaggaggtggtggccacgggcaaggaggccgcccggctgcgcgcggagctggagcgggagcgtgtgtgcagcgtggcgctctcggagcacgaacgcatcgtgggcaccctgcaggccaacgtggcccagctggaggggcagctggaggagctgggacggcggcatgagaagaccagcgcagaggtcttccaggtgcagcgtgaggccctgttcatgaagagtgagcgacacgcagccgaggcacagctggccacagcagagcagcagctacgggggctacggaccgaggcggaaagggctcgccaggcccagagccgggcccaggaggctctggacaaggccaaggagaaggacaagaagatcacagaactctccaaagaagtcttcaatcttaaggaagccttgaaggagcagccggccgccctcgccacccctgaggtggaggctctccgtgaccaggtgaaggatttacagcagcagctgcaggaagctgccagggaccactccagcgtggtggctttgtacagaagccacctcctatatgccattcagggccagatggatgaagatgtgcagcggattctcagccagattctgcagatgcagagactccaggctcagggccgctga

SEQ ID NO: 10805 - DNA, 1689 bp, synthetic construct
  misc_feature 1..1689: note = Synthetic polypeptide
  source 1..1689: mol_type = other DNA
tctttatctccatttgcatcacttgctgctattgggcatgcatctgttttatgtgtgtccacccatttgactgtgagcctgcgagggcaggcatggctgatggtgcctgggtcacagtatgggcgtcgtcaatattgattggtccccggaggccagctccctgcacatcctggagagacaggtgcaagagctacagcagttgctggtggagagacaagaggagaaggagagcctgggacgggaggtggagagtttgcagagccggctgtccctgctggagaacgagcgggagaatactagctatgacgtaaccaccctgcaggatgaggagggtgagctgcctgaccttccaggggccgaggtgctgctgtccagacaactcagtccgtcggcccaggaacacctggcctcgctgcaggaacaggtggctgtgctcaccagacagaaccaggaactgatggagaaggtccagatcctggagaactttgagaaggacgagacacagatggaagtggaagctttggcagaggtcatccctcttgccctctatgactctctccgggccgagtttgaccagctacgcaggcagcacgctgaggccctgcaggccctgaggcagcaggagacacgagaggtccccagagaagagggggcagcctgtggggagagtgaggttgctggagccacggccaccaaaaacgggccaacccacatggagctaaatggctcagtggctccagaaaccaaagttaacggagccgagaccatagatgaggaggctgcaggagatgaaaccatggaagccaggactatggaagctgaggccacgggagccgaggccacgggagctgaggccacaggagccaaggtcacagaaacaaaacccacaggggctgaggtcagagaaatggagaccacagaagaagaagcaaacatggaaactaagcccacaggagctcaggccacagacacagagaccacgggagtggaggccatgggggtggaggccacaaaaacaaaagcagaggaagcagaaatgcaggcctacggagtgggtgctgggcaagcagagcccccagtcacagggaccacaaacatggaggccacgggctctagggccacagggatggaatccacaggagtcagtgccacaggtgtggagaacccaggggtagaggccacggtcccggggatctctgctggccccatcctacatcctggtgccgcagaggcctcggaaaagcttcaagtagagctggagaccaggatccgtggcttggaggaggctctccggcagcgggagcgggaggcagctgcggagctggaggcggccctggggaagtgcgaggccgcggaggccgaggcaggccggctgcgagagcgtgtccgcgaggccgagggcagcggggccagcgggggcggtggcggtgacaccacacagctgcgggcggccctggagcaggcccgggaggacctccgagaccgggactcccgcctgcgggagctggaggcggcctcggcctgcctggatgaggctcgggccagccggctgctggcggaggaggaggcgcggggcctgcgggccgagctggcccagcgggaggaggcgcggctggagcagagccgggagctggaggttctgcgggagcagctggccacggccagggccacgggggagcagcagcgcac

SEQ ID NO: 10806 - DNA, 673 bp, synthetic construct
  misc_feature 1..673: note = Synthetic polypeptide
  source 1..673: mol_type = other DNA
ttctttattacaaagaactgcaaaagaggatatcgccttaccttacaaaataagatttaggtttgatttacaagcaccaccaaaaaacatttctttggagaatctaatgctggacaaagatggccacataaaaattacagattttggactttgcaaagaagggatcacagatgcagccaccatgaagacattctgtggcactccagaatatctggcaccagaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaagcttgtacctccttttaaacctcaagtaacatctgagacagatactagatattttgatgaagaatttacagctcagactattacaataacaccacctgaaaaatgtcagcaatcagattgtggcatgctgggtaactggaaaaaataa

SEQ ID NO: 10807 - DNA, 715 bp, synthetic construct
  misc_feature 1..715: note = Synthetic polypeptide
  source 1..715: mol_type = other DNA
ttctttattacaaagaactgcaaaagaggatatcgccttaccttacaaaataagatttaggtttgatttacaagcaccaccaaaaaacatttctttggagaatctaatgctggacaaagatggccacataaaaattacagattttggactttgcaaagaagggatcacagatgcagccaccatgaagacattctgtggcactccagaatatctggcaccagaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaagcttgtacctccttttaaacctcaagtaacatctgagacagatactagatattttgatgaagaatttacagctcagactattacaataacaccacctgaaaaatatgatgaggatggtatggactgcatggacaatgagaggcggccgcatttccctcaattttcctactctgcaagtggacgagaataa

SEQ ID NO: 10808 - DNA, 1352 bp, synthetic construct
  misc_feature 1..1352: note = Synthetic polypeptide
  source 1..1352: mol_type = other DNA
ttaattaattaaataaaatggacaaattcatttggaaataaaaaccaacattgacataagcagaaatttaaaaatggaattagaataatcctaacatctattaaagaaatctataattacaaactgttttacaaagaaaagtcccagcccagatgggcttggtggtgaattcttccaaatattccaatatgaaataataccatcttacataaactctttcagcaaatacaggagggagtaacattttctaacttgctttgtgaggccagtataaacctaatacaaaaatctaagctatcacaagatgtacaagcatattgcaagaaaagaaaattgaaggacaatatttcttcaatatggatacaaaaattctacacaaaatattagcatattgaatccaaattgaatagtgatatattaaaatgatgtcacatagaagccatgtgaggttattctagaaatgcaaagtttaacattcaaaatttgatgcatgtaatttttatattaaaaaaataaaaaaatccatgtggtcatctcaatagctttagaaaaagtatttgataaaattcaatatctgttcataacaaaaactctcagaaaactgggaaacaaaggacactttattaatctgataaaggacagctaaaaactcacagccaacatcatacttcatagtaaaaattttgagcacagttttcccttacttcaggagtaagacaaagaataatctgttaccacttctactcatcattatactggaggtcatagccagtgcagtaggacaagctattgacctgttgtattggcgggacatcaagcagacgggcatcgtgtttgggagtttcctgctgctgctcttctccctgacccagttcagcgtggtgagcgtcgtggcctacctggccctggccgcactctcagccaccatcagtttccgcatctacaagtctgttttacaagcagtgcagaaaaccgacgaaggccaccctttcaaggcctacttggagcttgagatcaccctttctcaggagcagattcagaagtacacggactgcctgcagttctacgtgaacagcacacttaaggaactgaggaggctcttccttgtccaggacctggtggattccttaaaatttgcagtcctgatgtggctcctgacctacgttggcgctctcttcaatggcctgaccctgctgctcatggctgtggtttcaatgtttactctacctgtagtgtatgttaagcaccaggcacagattgaccaatatctgggacttgtgaggactcacataaatgctgttgtggcaaagattcaggctaaaatcccaggcgctaagaggcatgctgagtaa

SEQ ID NO: 10809 - DNA, 237 bp, synthetic construct
  misc_feature 1..237: note = Synthetic polypeptide
  source 1..237: mol_type = other DNA
ggccaggcgcagtggcttacgcctgtaatctcaccacttagggaggccaaagcgggcggatcacctgaggtcgggagtttgagaccagcctgaccaacatggagaaaccccatctctactgaaaatccaaaatagccaggtggggatagcagtgcaacagaaagctgggatgaggagctttctccttccactgtgttgtatacagcaacacagcacacacctacaagcatcacctta

SEQ ID NO: 10810 - DNA, 4080 bp, synthetic construct
  misc_feature 1..4080: note = Synthetic polypeptide
  source 1..4080: mol_type = other DNA
ggccaggcgcagtggcttacgcctgtaatctcaccacttagggaggccaaagcgggcggatcacctgaggtcgggagtttgagaccagcctgaccaacatggagaaaccccatctctactgaaaatccaaaatagccaggtggggatagcagtgcaacagaaagctgggatgaggagctttctccttccactgtgttgtatacagcaacacagcacacacctacaagcatcaccttaactgttagaagaaccaaacccaagaagcggaaaaagagtccagaaaagggtcgtgcagcaccaaagacgaagaaaatcaagaattctccctctgaagcacagaatttagatgagaatacaactgagggctgggaaaatcggataagactatggactgaccagtatgaagaagctttcactaatcagtacagtgcagatgtacagaacgcgcttgaacaacacctacattctagcaaggaatttgtgggcaaacctactattttagacactattaataagactgaattggcctgtaataacacagttattggttcccaaatgcagttacagctgggaagagtcactcgtgttcaaaagcaccggaagatcctgagggctgcaagagatttggctttggacactcttataatagagtatcgtgggaaagtcatgttacgacagcaatttgaggtcaatgggcatttcttcaaaaaaccatacccctttgtgctcttctactcaaaattcaatggtgtagagatgtgtgtggatgcccgtactttcggtaatgatgctcggttcatcagaagatcatgtacaccaaatgcagaggtgcgacacatgattgcagatgggatgattcacctgtgcatctatgctgtgtctgccatcaccaaggatgctgaggtcaccatagcatttgattatgagtatagtaactgtaattataaagtggactgtgcctgtcacaagggaaaccggaattgtcctatacaaaaaaggaatcctaatgctacagaactgccactcctaccacctcctccaagcctacccaccattggagcagagactagacgtagaaaagcacgacggaaagagctagagatggagcagcagaatgaggcttcagaggagaataatgaccagcaatcacaagaagttccagaaaaagtaactgtatccagtgatcatgaggaagtagacaatccagaagaaaaaccagaagaagagaaagaagaggttatagatgaccaggagaacctagctcatagcaggaggaccagggaagatagaaaggtagaagccatcatgcatgcttttgaaaacttagagaaaagaaagaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggatattgctgcagaaaaactagtccccaagccacctccagcaaagccttctaggccccggccgaagagtcgaatttctcggtacaggaccagttcagcccaaagactaaagcgtcagaagcaggccaatgcacagcaggcagaattgtcacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaataccccaaaaccaaaaagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagctcctgtaagaagcgctggataaaacaagccttagaagaagggatgactcaaacatcatctgtaccccaagagactagaactcagcacctataccaaagcaatgagaatagtagctcttctagtatctgcaaagacaatgcagacttgttgagcccattaaagaaatggaagtctcgctatctgatggagcagaatgtcaccaagttacttcggcctctgtctccagtcacaccaccccctcccaattcaggctcaaagagtccccagctggccacacctggctcatctcacccaggagaagaggagtgtcgaaatggatacagcctcatgttttcaccagtcacatctcttactactgctagtcgctgcaacactcctctacagtttgagctttgtcaccgaaaagacctggatttggcaaaagtaggataccttgactccaacactaacagctgtgctgatagaccttccctactcaactcaggtcattctgacctggctcctcatccctccctcggacccacttctgagactggtttcccaagcagaagtggagatggacatcagaccctcgtgagaaactcagaccaggcatttcggacagagttcaacttgatgtatgcctactcccctttgaatgctatgcctcgagcagatggactgtatcgaggatctcctctagtgggggataggaagcctttacatttggatgggggatattgttcccctgcagaaggattttccagcagatatgaacatggcttaatgaaagacctctctcgtggatccttgtcacctggtggtgaaagggcctgtgaaggagtcccatctgccccccagaacccaccacagaggaaaaaagtatccctgctggagtaccgaaaacggaaacaagaagctaaggaaaattctgctggtgggggaggtgactctgcacagagcaaaagcaagtctgcaggagctgggcaaggcagcagtaactccgtttccgacactggtgcccatggtgtgcagggatcctcagcccgaactccatcttcccctcacaaaaaattctccccatctcattcctctatgtcccatttggaggcggtaagcccatcagattccagaggcacttcttcatctcactgcagacctcaagagaatatcagcagtaggtggatggttcccacatcagtagaacgactccgagaaggagggagcatccccaaggtcctccgaagcagcgtgagggtggcccaaaagggagagccctctcccacatgggagagtaacatcacagagaaagactcagaccctgcagatggagaaggcccagagacattaagctcagcactctctaaaggagcaacagtttacagcccttccagatacagctaccagctcctgcagtgtgatagtcctcggacagaatcacaaagcctccttcagcagagttcctcccccttcagaggacatcctacacagtctccaggatacagttatcgaactactgcactgagacctggaaaccccccctctcacggttcttcagaatcatccctctcttccacgtcctattccagccccgcccaccctgtgtccacagactcgttggccccatttacggggacaccagggtattttagcagccagccacattctggaaacagcactggcagcaatcttccaaggaggagctgcccttctagtgctgctagccctaccctgcagggaccctcagactcgccaacctcagattcagtttctcagtccagcacaggaactctgagttccacctcctttcctcagaactctaggtcgtcattgccatcagacttacggactatcagtctgcccagtgctgggcagtcagctgtctaccaggcctccagggtatctgcggtttccaattcacagcactacccacaccgtgggagtgggggtgtgcaccagtaccgactccagccactgcaagggtcaggagtcaagactcagacgggactttcctag

SEQ ID NO: 10811 - DNA, 4119 bp, synthetic construct
  misc_feature 1..4119: note = Synthetic polypeptide
  source 1..4119: mol_type = other DNA
ggccaggcgcagtggcttacgcctgtaatctcaccacttagggaggccaaagcgggcggatcacctgaggtcgggagtttgagaccagcctgaccaacatggagaaaccccatctctactgaaaatccaaaatagccaggtggggatagcagtgcaacagaaagctgggatgaggagctttctccttccactgtgttgtatacagcaacacagcacacacctacaagcatcaccttaactgttagaagaaccaaacccaagaagcggaaaaagagtccagaaaagggtcgtgcagcaccaaagacgaagaaaatcaaggcatttcgagagggatcccggaagtccttgcggatgaagaattctccctctgaagcacagaatttagatgagaatacaactgagggctgggaaaatcggataagactatggactgaccagtatgaagaagctttcactaatcagtacagtgcagatgtacagaacgcgcttgaacaacacctacattctagcaaggaatttgtgggcaaacctactattttagacactattaataagactgaattggcctgtaataacacagttattggttcccaaatgcagttacagctgggaagagtcactcgtgttcaaaagcaccggaagatcctgagggctgcaagagatttggctttggacactcttataatagagtatcgtgggaaagtcatgttacgacagcaatttgaggtcaatgggcatttcttcaaaaaaccatacccctttgtgctcttctactcaaaattcaatggtgtagagatgtgtgtggatgcccgtactttcggtaatgatgctcggttcatcagaagatcatgtacaccaaatgcagaggtgcgacacatgattgcagatgggatgattcacctgtgcatctatgctgtgtctgccatcaccaaggatgctgaggtcaccatagcatttgattatgagtatagtaactgtaattataaagtggactgtgcctgtcacaagggaaaccggaattgtcctatacaaaaaaggaatcctaatgctacagaactgccactcctaccacctcctccaagcctacccaccattggagcagagactagacgtagaaaagcacgacggaaagagctagagatggagcagcagaatgaggcttcagaggagaataatgaccagcaatcacaagaagttccagaaaaagtaactgtatccagtgatcatgaggaagtagacaatccagaagaaaaaccagaagaagagaaagaagaggttatagatgaccaggagaacctagctcatagcaggaggaccagggaagatagaaaggtagaagccatcatgcatgcttttgaaaacttagagaaaagaaagaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggatattgctgcagaaaaactagtccccaagccacctccagcaaagccttctaggccccggccgaagagtcgaatttctcggtacaggaccagttcagcccaaagactaaagcgtcagaagcaggccaatgcacagcaggcagaattgtcacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaataccccaaaaccaaaaagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagctcctgtaagaagcgctggataaaacaagccttagaagaagggatgactcaaacatcatctgtaccccaagagactagaactcagcacctataccaaagcaatgagaatagtagctcttctagtatctgcaaagacaatgcagacttgttgagcccattaaagaaatggaagtctcgctatctgatggagcagaatgtcaccaagttacttcggcctctgtctccagtcacaccaccccctcccaattcaggctcaaagagtccccagctggccacacctggctcatctcacccaggagaagaggagtgtcgaaatggatacagcctcatgttttcaccagtcacatctcttactactgctagtcgctgcaacactcctctacagtttgagctttgtcaccgaaaagacctggatttggcaaaagtaggataccttgactccaacactaacagctgtgctgatagaccttccctactcaactcaggtcattctgacctggctcctcatccctccctcggacccacttctgagactggtttcccaagcagaagtggagatggacatcagaccctcgtgagaaactcagaccaggcatttcggacagagttcaacttgatgtatgcctactcccctttgaatgctatgcctcgagcagatggactgtatcgaggatctcctctagtgggggataggaagcctttacatttggatgggggatattgttcccctgcagaaggattttccagcagatatgaacatggcttaatgaaagacctctctcgtggatccttgtcacctggtggtgaaagggcctgtgaaggagtcccatctgccccccagaacccaccacagaggaaaaaagtatccctgctggagtaccgaaaacggaaacaagaagctaaggaaaattctgctggtgggggaggtgactctgcacagagcaaaagcaagtctgcaggagctgggcaaggcagcagtaactccgtttccgacactggtgcccatggtgtgcagggatcctcagcccgaactccatcttcccctcacaaaaaattctccccatctcattcctctatgtcccatttggaggcggtaagcccatcagattccagaggcacttcttcatctcactgcagacctcaagagaatatcagcagtaggtggatggttcccacatcagtagaacgactccgagaaggagggagcatccccaaggtcctccgaagcagcgtgagggtggcccaaaagggagagccctctcccacatgggagagtaacatcacagagaaagactcagaccctgcagatggagaaggcccagagacattaagctcagcactctctaaaggagcaacagtttacagcccttccagatacagctaccagctcctgcagtgtgatagtcctcggacagaatcacaaagcctccttcagcagagttcctcccccttcagaggacatcctacacagtctccaggatacagttatcgaactactgcactgagacctggaaaccccccctctcacggttcttcagaatcatccctctcttccacgtcctattccagccccgcccaccctgtgtccacagactcgttggccccatttacggggacaccagggtattttagcagccagccacattctggaaacagcactggcagcaatcttccaaggaggagctgcccttctagtgctgctagccctaccctgcagggaccctcagactcgccaacctcagattcagtttctcagtccagcacaggaactctgagttccacctcctttcctcagaactctaggtcgtcattgccatcagacttacggactatcagtctgcccagtgctgggcagtcagctgtctaccaggcctccagggtatctgcggtttccaattcacagcactacccacaccgtgggagtgggggtgtgcaccagtaccgactccagccactgcaagggtcaggagtcaagactcagacgggactttcctag

SEQ ID NO: 10812 - DNA, 595 bp, synthetic construct
  misc_feature 1..595: note = Synthetic polypeptide
  source 1..595: mol_type = other DNA
ggccaggcgcagtggcttacgcctgtaatctcaccacttagggaggccaaagcgggcggatcacctgaggtcgggagtttgagaccagcctgaccaacatggagaaaccccatctctactgaaaatccaaaatagccaggtggggatagcagtgcaacagaaagctgggatgaggagctttctccttccactgtgttgtatacagcaacacagcacacacctacaagcatcaccttaactgttagaagaaccaaacccaagaagcggaaaaagagtccagaaaagggtcgtgcagcaccaaagacgaagaaaatcaagaattctccctctgaagcacagaatttagatgagaatacaactgagggctgggaaaatcggataagactatggactgaccagtatgaagaagctttcactaatcagtacagtgcagatgtacagaacgcgcttgaacaacacctacattctagcaaggaatttgtgggcaaacctactattttagacactattaataagactgaattggcctgtaataacacagttattggttcccaaatgcagttacagctgggaagagtcactcgtgttcaaaagc

SEQ ID NO: 10813 - DNA, 1166 bp, synthetic construct; identical to SEQ ID NO: 9148
  misc_feature 1..1166: note = Synthetic polypeptide
  source 1..1166: mol_type = other DNA

SEQ ID NO: 10814 - DNA, 1061 bp, synthetic construct; identical to SEQ ID NO: 9149
  misc_feature 1..1061: note = Synthetic polypeptide
  source 1..1061: mol_type = other DNA

SEQ ID NO: 10815 - DNA, 954 bp, synthetic construct
  misc_feature 1..954: note = Synthetic polypeptide
  source 1..954: mol_type = other DNA
cagtgtgagcctgaggaatgagcacagatttcaggatcaggaaggccaggctggagtgctggctctgcagcgtcacaggagcttccagcccgtgtgaacctctcagctgccccagccccagtctctgctgtgcccaccggcctacactccaagatggaccagctggaggggcagctgctggcccaggtgctggcactggagaaggagcgtgtggccctcagccacagcagccgccggcagaggcaggaagtggaaaaggagttggacgtcctgcagggtcgtgtggctgagctggagcacgggtcctcagcctacagtcctccagatgccttcaagatcagcatccccatccgtaacaactacatgtacgcccgcgtgcggaaggctctgcccgagctctacgcattcaccgcctgcatgtggctgcggtccaggtccagcggcaccggccagggcacccccttctcctactcagtgcccgggcaggccaacgagattgtactgctagaggcgggccatgagcccatggagctgctgatcaacgacaaggtggcccagctgcccctgagcctgaaggacaatggctggcaccacatctgcatcgcctggaccacaagggatggcctatggtctgcctaccaggacggggagctgcagggctccggtgagaacctggctgcctggcaccccatcaagcctcatgggatccttatcttgggccaggagcaggataccctgggtggccggtttgatgccacccaggcctttgtcggtgacattgcccagtttaacctgtgggaccacgccctgacaccagcccaggtcctgggcattgccaactgcactgcgccactgctgggcaacgtccttccctgggaagacaagttggtggaggcctttgggggtgcaacaaaggctgccttcgatgtctgcaaggggagggccaaggcatga

SEQ ID NO: 10816 - DNA, 1168 bp, synthetic construct
  misc_feature 1..1168: note = Synthetic polypeptide
  source 1..1168: mol_type = other DNA
aacctatcaatagcatcagaaagccaacaacccaatgtgatcctacatttgtgaaaaaacccacagacagtataaaggacattttagctgtgtttagagaaagaagaggaccaaagaagaattgaaatcaccacctcctgtaatcttaataggcaactccccatcagatgagtctgaggagcgggaaagagaccccaaggtgctgacattcccagaatacatcaccagcttgtcagactccggcaccaagcacatggcggctggagtccgcatggagtgccacagcaagggacgatgcccctcgtcctgccccctgtgtcatgtgacatccagccctgacacccctgctgagccggttctgctggaggtgaccaaagcagcccccatctatgaactagtgaccaacaaccagacccagaggctcttgcaggaggctaccatgagctctctctggtgctcagggactggagatgtcatcgaggactggtgtcgatgtgactccactgcttttggagctgatggactccccacctgtgcgcctctcccacagcctgtgctgagactctccacggttcacgagcccagcagcactcttgtggtcctggagtgggaacactcagagccaccaatcggggtgcagattgtagattacctcctccgtcaagagaaagtcactgacaggatggaccactccaaagtggagacagaaacagtgctgagctttgtggacgacatcatctctggagcaaagtctccttgtgcaatgccatctcaggtgccggacaagcagctcaccaccatctctctgatcatacgatgcctggaacctgacaccatttacatgttcacgctgtggggagtggacaacacaggacggcgctccaggccaagcgacgtgatcgtgaagaccccatgccccgtggtggatgatgtcaaggctcaagaaatagcagacaagatctacaatctcttcaatggctacactagtgggaaggagcagcagaccgcctacaacaccctcctggatctgggttcccccaccttacaccgggtcctctaccactataaccagcactatgagagttttggggaattcacctggcgatgtgaggatgagttaggtcccaggcttccagcgtgttgggacagtcagaggagttgtagatga

SEQ ID NO: 10817 - DNA, 1366 bp, synthetic construct
  misc_feature 1..1366: note = Synthetic polypeptide
  source 1..1366: mol_type = other DNA
aacctatcaatagcatcagaaagccaacaacccaatgtgatcctacatttgtgaaaaaacccacagacagtataaaggacattttagctgtgtttagagaaagaagaggaccaaagaagaattgaaatcaccacctcctgtaatcttaataggcaactccccatcagatgagtctgaggagcgggaaagagaccccaaggtgctgacattcccagaatacatcaccagcttgtcagactccggcaccaagcacatggcggctggagtccgcatggagtgccacagcaagggacgatgcccctcgtcctgccccctgtgtcatgtgacatccagccctgacacccctgctgagccggttctgctggaggtgaccaaagcagcccccatctatgaactagtgaccaacaaccagacccagaggctcttgcaggaggctaccatgagctctctctggtgctcagggactggagatgtcatcgaggactggtgtcgatgtgactccactgcttttggagctgatggactccccacctgtgcgcctctcccacagcctgtgctgagactctccacggttcacgagcccagcagcactcttgtggtcctggagtgggaacactcagagccaccaatcggggtgcagattgtagattacctcctccgtcaagagaaagtcactgacaggatggaccactccaaagtggagacagaaacagtgctgagctttgtggacgacatcatctctggagcaaagtctccttgtgcaatgccatctcaggtgccggacaagcagctcaccaccatctctctgatcatacgatgcctggaacctgacaccatttacatgttcacgctgtggggagtggacaacacaggacggcgctccaggccaagcgacgtgatcgtgaagaccccatgccccgtggtggatgatgtcaaggctcaagaaatagcagacaagatctacaatctcttcaatggctacactagtgggaaggagcagcagaccgcctacaacaccctcctggatctgggttcccccaccttacaccgggtcctctaccactataaccagcactatgagagttttggggaattcacctggcgatgtgaggatgagttaggtcccaggaaagctggtctcatcctttcccagcttggggacctcagcagttggtgcaatggactccttcaggaacccaagataagcttgcggcgcagctcactcaagtacctggggtgccgctacagcgagatcaaaccctacggacttgactgggcggagctcagccgggacctcaggaagacgtgtgaggagcagaccctgagtatcccctacaacgactatggggacagcaaagagatctag

SEQ ID NO: 10818 - DNA, 1132 bp, synthetic construct
  misc_feature 1..1132: note = Synthetic polypeptide
  source 1..1132: mol_type = other DNA
aacctatcaatagcatcagaaagccaacaacccaatgtgatcctacatttgtgaaaaaacccacagacagtataaaggacattttagctgtgtttagagaaagaagaggaccaaagaagaattgaaatcaccacctcctgtaatcttaataggcaactccccatcagatgagtctgaggagcgggaaagagaccccaaggtgctgacattcccagaatacatcaccagcttgtcagactccggcaccaagcacatggcggctggagtccgcatggagtgccacagcaagggacgatgcccctcgtcctgccccctgtgtcatgtgacatccagccctgacacccctgctgagccggttctgctggaggtgaccaaagcagcccccatctatgaactagtgaccaacaaccagacccagaggctcttgcaggaggctaccatgagctctctctggtgctcagggactggagatgtcatcgaggactggtgtcgatgtgactccactgcttttggagctgatggactccccacctgtgcgcctctcccacagcctgtgctgagactctccacggttcacgagcccagcagcactcttgtggtcctggagtgggaacactcagagccaccaatcggggtgcagattgtagattacctcctccgtcaagagaaagtcactgacaggatggaccactccaaagtggagacagaaacagtgctgagctttgtggacgacatcatctctggagcaaagtctccttgtgcaatgccatctcaggtgccggacaagcagctcaccaccatctctctgatcatacgatgcctggaacctgacaccatttacatgttcacgctgtggggagtggacaacacaggacggcgctccaggccaagcgacgtgatcgtgaagaccccatgccccgtggtggatgatgtcaaggctcaagaaatagcagacaagatctacaatctcttcaatggctacactagtgggaaggagcagcagaccgcctacaacaccctcctggatctgggttcccccaccttacaccgggtcctctaccactataaccagcactatgagagttttggggaattcacctggcgatgtgaggatgagttaggtcccaggtaa

SEQ ID NO: 10819 - DNA, 559 bp, synthetic construct; identical to SEQ ID NO: 8901
  misc_feature 1..559: note = Synthetic polypeptide
  source 1..559: mol_type = other DNA

SEQ ID NO: 10820 - DNA, 3916 bp, synthetic construct
  misc_feature 1..3916: note = Synthetic polypeptide
  source 1..3916: mol_type = other DNA
tgctggtgggggtatcaactggctcaaccactctgcagaactgtctagcaggatccactaaggctcaacatctgtccaccctgtgaccctccaactcctactaggccagggagaagcggggcgcgtgcccacctgcaccctgtcctccggctcctgcccggccatgtgcacctgcagcaatggcatcgtggactgtcgtggaaaaggcctcactgccatcccggccaacctgcccgagaccatgacggagatacgcctggagctgaacggcatcaagtccatccctcctggagccttctcaccctacagaaagctacggaggatagacctgagcaacaatcagatcgctgagattgcacccgacgccttccagggcctccgctccctgaactcgctggtcctctatggaaacaagatcacagacctcccccgtggtgtgtttggaggcctatacaccctacagctcctgctcctgaatgccaacaagatcaactgcatccggcccgatgccttccaggacctgcagaacctctcactgctctccctgtatgacaacaagatccagagcctcgccaagggcactttcacctccctgcgggccatccagactctgcacctggcgcagaaccctttcatttgcgactgtaacctcaagtggctggcagacttcctgcgcaccaatcccatcgagacgagtggtgcccgctgtgccagtccccggcgcctcgccaacaagcgcatcgggcagatcaagagcaagaagttccggtgctcagccaaagagcagtacttcattccaggcacggaggattaccagctgaacagcgagtgcaacagcgacgtggtctgtccccacaagtgccgctgtgaggccaacgtggtggagtgctccagcctgaagctcaccaagatccctgagcgcatcccccagtccacggcagaactgcgattgaataacaatgagatttccatcctggaggccactgggatgtttaaaaaacttacacatctgaagaaaatcaatctgagcaacaacaaggtgtcagaaattgaagatggggccttcgagggcgcagcctctgtgagcgagctgcacctaactgccaaccagctggagtccatccggagcggcatgttccggggtctggatggcttgaggaccctaatgctgcggaacaaccgcatcagctgcatccacaacgacagcttcacgggcctgcgcaacgtccggctcctctcgctctacgacaaccagatcaccaccgtatccccaggagccttcgacaccctccagtccctctccacactgaatctcctggccaaccctttcaactgcaactgccagctggcctggctaggaggctggctacggaagcgcaagatcgtgacggggaacccgcgatgccagaaccctgactttttgcggcagattcccctgcaggacgtggccttccctgacttcaggtgtgaggaaggccaggaggaggggggctgcctgccccgcccacagtgcccacaggagtgcgcctgcctggacaccgtggtccgatgcagcaacaagcacctgcgggccctgcccaagggcattcccaagaatgtcacagaactctatttggacgggaaccagttcacgctggttccgggacagctgtctaccttcaagtacctgcagctcgtggacctgagcaacaacaagatcagttccttaagcaattcctccttcaccaacatgagccagctgaccactctgatcctcagctacaatgccctgcagtgcatcccgcctttggccttccagggactccgctccctgcgcctgctgtctctccacggcaatgacatctccaccctccaagagggcatctttgcagacgtgacctccctgtctcacctggccattggtgccaaccccctatactgtgactgccacctccgctggctgtccagctgggtgaagactggctacaaggaaccgggcattgctcgttgtgctgggccccaggacatggagggcaagctgctcctcaccacgcctgccaagaagtttgaatgccaaggtcctccaacgctggctgtccaggccaagtgtgatctctgcttgtccagtccgtgccagaaccagggcacctgccacaacgacccccttgaggtgtacaggtgcgcctgccccagcggctataagggtcgagactgtgaggtgtccctggacagctgttccagtggcccctgtgaaaatgggggcacctgccatgcacaggagggcgaggatgccccgttcacgtgctcctgtcccaccggctttgaaggaccaacctgtggggtgaacacagatgactgtgtggatcatgcctgtgccaatgggggcgtctgtgtggatggtgtgggcaactacacctgccagtgccccctgcagtatgagggaaaggcctgtgagcagctggtggacttgtgctctccggatctgaacccatgtcaacacgaggcccagtgtgtgggcaccccggatgggcccaggtgtgagtgcatgccaggttatgcaggtgacaactgcagtgagaaccaggatgactgcagggaccaccgctgccagaatggggcccagtgtatggatgaagtcaacagctactcctgcctctgtgctgagggctacagtggacagctctgtgagatccctccccatctgcctgcccccaagagcccctgtgaggggactgagtgccagaatggggccaactgtgtggaccagggcaacaggcctgtgtgccagtgcctcccaggcttcggtggccctgagtgtgagaagttgctcagtgtcaactttgtggatcgggacacttacctgcagttcactgacctgcaaaactggccacgggccaacatcacgttgcaggtctccacggcagaggacaatgggatccttctgtacaacggggacaacgaccacattgcagttgagctgtaccagggccatgtgcgtgtcagctacgacccaggcagctaccccagctctgccatctacagtgctgagacgatcaacgatgggcaattccacaccgttgagctggttgcctttgaccagatggtgaatctctccattgatggcgggagccccatgaccatggacaactttggcaaacattacacgctcaacagcgaggcgccactctatgtgggagggatgcccgtggatgtcaactcagctgccttccgcctgtggcagatcctcaacggcaccggcttccacggttgcatccgaaacctgtacatcaacaacgagctgcaggacttcaccaagacgcagatgaagccaggcgtggtgccaggctgcgaaccctgccgcaagctctactgcctgcatggcatctgccagcccaatgccaccccagggcccatgtgccactgcgaggctggctgggtgggcctgcactgtgaccagcccgctgacggcccctgccatggccacaagtgtgtccatgggcaatgcgtgcccctcgacgctctttcctacagctgccagtgccaggatgggtactcgggggcactgtgcaaccaggccggggccctggcagagccctgcagaggcctgcagtgcctgcatggccactgccaggcctcaggcaccaagggggcacactgtgtgtgtgaccccggcttttcgggcgagctgtgtgagcaagagtccgagtgccggggggaccctgtccgggactttcaccaggtccagaggggctatgccatctgccagaccacgcgccccctgtcatgggtggagtgccggggctcgtgcccaggccagggctgctgccagggccttcggctgaagcggaggaagttcacctttgagtgcagcgatgggacctcttttgccgaggaggtggaaaagcccaccaagtgtggctgtgccctctgcgcatag

SEQ ID NO: 10821 - DNA, 3697 bp, synthetic construct
  misc_feature 1..3697: note = Synthetic polypeptide
  source 1..3697: mol_type = other DNA
tgctggtgggggtatcaactggctcaaccactctgcagaactgtctagcaggatccactaaggctcaacatctgtccaccctgtgaccctccaactcctactaggccagggagaagcggggcgcgtgcccacctgcaccctgtcctccggctcctgcccggccatgtgcacctgcagcaatggcatcgtggactgtcgtggaaaaggcctcactgccatcccggccaacctgcccgagaccatgacggagatacgcctggagctgaacggcatcaagtccatccctcctggagccttctcaccctacagaaagctacggaggatagacctgagcaacaatcagatcgctgagattgcacccgacgccttccagggcctccgctccctgaactcgctggtcctctatggaaacaagatcacagacctcccccgtggtgtgtttggaggcctatacaccctacagctcctgctcctgaatgccaacaagatcaactgcatccggcccgatgccttccaggacctgcagaacctctcactgctctccctgtatgacaacaagatccagagcctcgccaagggcactttcacctccctgcgggccatccagactctgcacctggcgcagaaccctttcatttgcgactgtaacctcaagtggctggcagacttcctgcgcaccaatcccatcgagacgagtggtgcccgctgtgccagtccccggcgcctcgccaacaagcgcatcgggcagatcaagagcaagaagttccggtgctcagccaaagagcagtacttcattccaggcacggaggattaccagctgaacagcgagtgcaacagcgacgtggtctgtccccacaagtgccgctgtgaggccaacgtggtggagtgctccagcctgaagctcaccaagatccctgagcgcatcccccagtccacggcagaactgcgattgaataacaatgagatttccatcctggaggccactgggatgtttaaaaaacttacacatctgaagaaaatcaatctgagcaacaacaaggtgtcagaaattgaagatggggccttcgagggcgcagcctctgtgagcgagctgcacctaactgccaaccagctggagtccatccggagcggcatgttccggggtctggatggcttgaggaccctaatgctgcggaacaaccgcatcagctgcatccacaacgacagcttcacgggcctgcgcaacgtccggctcctctcgctctacgacaaccagatcaccaccgtatccccaggagccttcgacaccctccagtccctctccacactgaatctcctggccaaccctttcaactgcaactgccagctggcctggctaggaggctggctacggaagcgcaagatcgtgacggggaacccgcgatgccagaaccctgactttttgcggcagattcccctgcaggacgtggccttccctgacttcaggtgtgaggaaggccaggaggaggggggctgcctgccccgcccacagtgcccacaggagtgcgcctgcctggacaccgtggtccgatgcagcaacaagcacctgcgggccctgcccaagggcattcccaagaatgtcacagaactctatttggacgggaaccagttcacgctggttccgggacagctgtctaccttcaagtacctgcagctcgtggacctgagcaacaacaagatcagttccttaagcaattcctccttcaccaacatgagccagctgaccactctgatcctcagctacaatgccctgcagtgcatcccgcctttggccttccagggactccgctccctgcgcctgctgtctctccacggcaatgacatctccaccctccaagagggcatctttgcagacgtgacctccctgtctcacctggccattggtgccaaccccctatactgtgactgccacctccgctggctgtccagctgggtgaagactggctacaaggaaccgggcattgctcgttgtgctgggccccaggacatggagggcaagctgctcctcaccacgcctgccaagaagtttgaatgccaaggtcctccaacgctggctgtccaggccaagtgtgatctctgcttgtccagtccgtgccagaaccagggcacctgccacaacgacccccttgaggtgtacaggtgcgcctgccccagcggctataagggtcgagactgtgaggtgtccctggacagctgttccagtggcccctgtgaaaatgggggcacctgccatgcacaggagggcgaggatgccccgttcacgtgctcctgtcccaccggctttgaaggaccaacctgtggggtgaacacagatgactgtgtggatcatgcctgtgccaatgggggcgtctgtgtggatggtgtgggcaactacacctgccagtgccccctgcagtatgagggaaaggcctgtgagcagctggtggacttgtgctctccggatctgaacccatgtcaacacgaggcccagtgtgtgggcaccccggatgggcccaggtgtgagtgcatgccaggttatgcaggtgacaactgcagtgagaaccaggatgactgcagggaccaccgctgccagaatggggcccagtgtatggatgaagtcaacagctactcctgcctctgtgctgagggctacagtggacagctctgtgagatccctccccatctgcctgcccccaagagcccctgtgaggggactgagtgccagaatggggccaactgtgtggaccagggcaacaggcctgtgtgccagtgcctcccaggcttcggtggccctgagtgtgagaagttgctcagtgtcaactttgtggatcgggacacttacctgcagttcactgacctgcaaaactggccacgggccaacatcacgttgcaggtctccacggcagaggacaatgggatccttctgtacaacggggacaacgaccacattgcagttgagctgtaccagggccatgtgcgtgtcagctacgacccaggcagctaccccagctctgccatctacagtgctgagacgatcaacgatgggcaattccacaccgttgagctggttgcctttgaccagatggtgaatctctccattgatggcgggagccccatgaccatggacaactttggcaaacattacacgctcaacagcgaggcgccactctatgtgggagggatgcccgtggatgtcaactcagctgccttccgcctgtggcagatcctcaacggcaccggcttccacggttgcatccgaaacctgtacatcaacaacgagctgcaggacttcaccaagacgcagatgaagccaggcgtggtgccaggctgcgaaccctgccgcaagctctactgcctgcatggcatctgccagcccaatgccaccccagggcccatgtgccactgcgaggctggctgggtgggcctgcactgtgaccagcccgctgacggcccctgccatggccacaagtgtgtccatgggcaatgcgtgcccctcgacgctctttcctacagctgccagtgccaggatgggtactcgggggcactgtgcaaccagagtccgagtgccggggggaccctgtccgggactttcaccaggtccagaggggctatgccatctgccagaccacgcgccccctgtcatgggtggagtgccggggctcgtgcccaggccagggctgctgccagggccttcggctga

SEQ ID NO: 10822 - DNA, 1707 bp, synthetic construct
  misc_feature 1..1707: note = Synthetic polypeptide
  source 1..1707: mol_type = other DNA
tgctggtgggggtatcaactggctcaaccactctgcagaactgtctagcaggatccactaaggctcaacatctgtccaccctgtgaccctccaactcctactaggccagggagaagcggggcgcgtgcccacctgcaccctgtcctccggctcctgcccggccatgtgcacctgcagcaatggcatcgtggactgtcgtggaaaaggcctcactgccatcccggccaacctgcccgagaccatgacggagatacgcctggagctgaacggcatcaagtccatccctcctggagccttctcaccctacagaaagctacggaggatatgccccctctccttctgctcaccttgcagagacctgagcaacaatcagatcgctgagattgcacccgacgccttccagggcctccgctccctgaactcgctggtcctctatggaaacaagatcacagacctcccccgtggtgtgtttggaggcctatacaccctacagctcctgctcctgaatgccaacaagatcaactgcatccggcccgatgccttccaggacctgcagaacctctcactgctctccctgtatgacaacaagatccagagcctcgccaagggcactttcacctccctgcgggccatccagactctgcacctggcgcagaaccctttcatttgcgactgtaacctcaagtggctggcagacttcctgcgcaccaatcccatcgagacgagtggtgcccgctgtgccagtccccggcgcctcgccaacaagcgcatcgggcagatcaagagcaagaagttccggtgctcagccaaagagcagtacttcattccaggcacggaggattaccagctgaacagcgagtgcaacagcgacgtggtctgtccccacaagtgccgctgtgaggccaacgtggtggagtgctccagcctgaagctcaccaagatccctgagcgcatcccccagtccacggcagaactgcgattgaataacaatgagatttccatcctggaggccactgggatgtttaaaaaacttacacatctgaagaaaatcaatctgagcaacaacaaggtgtcagaaattgaagatggggccttcgagggcgcagcctctgtgagcgagctgcacctaactgccaaccagctggagtccatccggagcggcatgttccggggtctggatggcttgaggaccctaatgctgcggaacaaccgcatcagctgcatccacaacgacagcttcacgggcctgcgcaacgtccggctcctctcgctctacgacaaccagatcaccaccgtatccccaggagccttcgacaccctccagtccctctccacactgaatctcctggccaaccctttcaactgcaactgccagctggcctggctaggaggctggctacggaagcgcaagatcgtgacggggaacccgcgatgccagaaccctgactttttgcggcagattcccctgcaggacgtggccttccctgacttcaggtgtgaggaaggccaggaggaggggggctgcctgccccgcccacagtgcccacaggagtgcgcctgcctggacaccgtggtccgatgcagcaacaagcacctgcgggccctgcccaagggcattcccaagaatgtcacagaactctatttggacgggaaccagttcacgctggttccgggacagctgtctaccttcaagtacctgcagctcgt

SEQ ID NO: 10823 - DNA, 541 bp, synthetic construct
  misc_feature 1..541: note = Synthetic polypeptide
  source 1..541: mol_type = other DNA
tgctggtgggggtatcaactggctcaaccactctgcagaactgtctagcaggatccactaaggctcaacatctgtccaccctgtgaccctccaactcctactaggccagggagaagcggggcgcgtgcccacctgcaccctgtcctccggctcctgcccggccatgtgcacctgcagcaatggcatcgtggactgtcgtggaaaaggcctcactgccatcccggccaacctgcccgagaccatgacggagatacgcctggagctgaacggcatcaagtccatccctcctggagccttctcaccctacagaaagctacggaggatagacctgagcaacaatcagatcgctgagattgcacccgacgccttccagggcctccgctccctgaactcgctccacactggccccgtcacctgtccacacacgacaggcacacacagctcccactgcagggcctttgctgttgctgtgcctcactccaggaatgaccttgaagccatgtttgaagaggaagtacccaggattttttactcagcttga

SEQ ID NO: 10824 - DNA, 2346 bp, synthetic construct; identical to SEQ ID NO: 9066
  misc_feature 1..2346: note = Synthetic polypeptide
  source 1..2346: mol_type = other DNA

SEQ ID NO: 10825 - DNA, 805 bp, synthetic construct
  misc_feature 1..805: note = Synthetic polypeptide
  source 1..805: mol_type = other DNA
gaacataggccctgcagcccagctgcttgggggcattccactctgctggccaccagctgtgactgcaggtgaagtgaaactgctgctgtcctccgagacacccattgaggggaagaacatgtcctttgtgaatgatcttacagtcactcaggatgggaggaagatttatttcaccgattctagcagcaaatggcaaagacgagactacctgcttctggtgatggagggcacagatgacgggcgcctgctggagtatgatactgtgaccagggaagtaaaagttttattggaccagctgcggttcccgaatggagtccagctgtctcctgcagaagactttgtcctggtggcagaaacaaccatggccaggatacgaagagtctacgtttctggcctgatgaagggcggggctgatctgtttgtggagaacatgcctggatttccagacaacatccggcccagcagctctggggggtactgggtgggcatgtcgaccatccgccctaaccctgggttttccatgctggatttcttatctgagagaccctggattaaaaggatgatttttaagggaagctgcgctggttgtgatctgctctttagtcaagagacggtgatgaagtttgtgccgcggtacagcctcgtcctagaactcagcgacagcggtgccttccggagaagcctgcatgatcccgatgggctggtggccacctacatcagcgaggtgcacgaacacgatgggcacctgtacctgggctctttcaggtcccccttcctctgcagactcagcctccaggctgtttag

SEQ ID NO: 10826 - DNA, 781 bp, synthetic construct
  misc_feature 1..781: note = Synthetic polypeptide
  source 1..781: mol_type = other DNA
gaacataggccctgcagcccagctgcttgggggcattccactctgctggccaccagctgtgactgcaggtgaagtgaaactgctgctgtcctccgagacacccattgaggggaagaacatgtcctttgtgaatgatcttacagtcactcaggatgggaggaagatttatttcaccgattctagcagcaaatggcaaagacgagactacctgcttctggtgatggagggcacagatgacgggcgcctgctggagtatgatactgtgaccagggaagtaaaagttttattggaccagctgcggttcccgaatggagtccagctgtctcctgcagaagactttgtcctggtggcagaaacaaccatggccaggatacgaagagtctacgtttctggcctgatgaagggcggggctgatctgtttgtggagaacatgcctggatttccagacaacatccggcccagcagctctggggggtactgggtgggcatgtcgaccatccgccctaaccctgggttttccatgctggatttcttatctgagagaccctggattaaaaggatgatttttaagctctttagtcaagagacggtgatgaagtttgtgccgcggtacagcctcgtcctagaactcagcgacagcggtgccttccggagaagcctgcatgatcccgatgggctggtggccacctacatcagcgaggtgcacgaacacgatgggcacctgtacctgggctctttcaggtcccccttcctctgcagactcagcctccaggctgtttag

SEQ ID NO: 10827 - DNA, 400 bp, synthetic construct
  misc_feature 1..400: note = Synthetic polypeptide
  source 1..400: mol_type = other DNA
gaacataggccctgcagcccagctgcttgggggcattccactctgctggccaccagctgtgactgcaggtgaagtgaaactgctgctgtcctccgagacacccattgaggggaagaacatgtcctttgtgaatgatcttacagtcactcaggatgggaggaagatttatttcaccgattctagcagcaaatggcaaagacgagactacctgcttctggtgatggagggcacagatgacgggcgcctgctggagtatgatactgtgaccagggaagtaaaagttttattggaccagctgcggttcccgaatggagtccagctgtctcctgcagaagactttgtcctggtggcagaaacaaccatggccaggatacgaagctctttagtcaagagacggtga

SEQ ID NO: 10828 - DNA, 859 bp, synthetic construct; identical to SEQ ID NO: 6990
  misc_feature 1..859: note = Synthetic polypeptide
  source 1..859: mol_type = other DNA

SEQ ID NO: 10829 - DNA, 657 bp, synthetic construct; identical to SEQ ID NO: 6991
  misc_feature 1..657: note = Synthetic polypeptide
  source 1..657: mol_type = other DNA

SEQ ID NO: 10830 - DNA, 587 bp, synthetic construct; identical to SEQ ID NO: 6992
  misc_feature 1..587: note = Synthetic polypeptide
  source 1..587: mol_type = other DNA

SEQ ID NO: 10831 - DNA, 568 bp, synthetic construct; identical to SEQ ID NO: 6993
  misc_feature 1..568: note = Synthetic polypeptide
  source 1..568: mol_type = other DNA

SEQ ID NO: 10832 - DNA, 494 bp, synthetic construct; identical to SEQ ID NO: 6994
  misc_feature 1..494: note = Synthetic polypeptide
  source 1..494: mol_type = other DNA

SEQ ID NO: 10833 - DNA, 368 bp, synthetic construct; identical to SEQ ID NO: 6995
  misc_feature 1..368: note = Synthetic polypeptide
  source 1..368: mol_type = other DNA

SEQ ID NO: 10834 - DNA, 393 bp, synthetic construct; identical to SEQ ID NO: 9054
  misc_feature 1..393: note = Synthetic polypeptide
  source 1..393: mol_type = other DNA

SEQ ID NO: 10835 - DNA, 5813 bp, synthetic construct
  misc_feature 1..5813: note = Synthetic polypeptide
  source 1..5813: mol_type = other DNA
gaggggacagaatgaccttccggccttgagtccctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtgaaaccccatttcatttcactttgcctaaagaaggtgatatcatcccaccattgactggtgcaaccccacctcttattgggcacctaaaattggagcccaagagacacagtactcctattggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctcaaggagaagaggagaaagaaaaattggagggtgaccatacaatcaggcagagtcaacagcctatgaagcccattagtcctgtcaaggaccctgtttctcctgcttcccagaagatggtcatacaagggccatccagtcctcaaggagaggcaatggtgacagatgtgctagaagaccagaaagaaggacggagtactaataaggaaaatcctagtaaggccttgattgaaaggcccagccaaaataacataggaatccaaaccatggagtgttccttgagggtcccagaaactgtttcagcagcaacccagactataaagaatgtgtgtgagcaggggaccagtacagtggaccagaactttggaaagcaagatgccacagttcagactgagagggggagtggtgagaaaccagtcagtgctcctggggatgatacagagtcgctccatagccagggagaagaagagtttgatatgcctcagcctccacatggccatgtcttacatcgtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctggtgcagtaggggcaggagagtttgtgagcccctgtgagagtggagacaacaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggaatttttggaaattcctcctttcaacaagcagtatacagaatcccagcttcgagcaggagctggctatatccttgaagatttcaatgaagcccagtgtaacacagcttaccagtgtcttctaattgcggatcagcattgtcgaacccggaagtacttcctgtgccttgccagtgggattccttgtgtgtctcatgtctgggtccatgatagttgccatgccaaccagctccagaactaccgtaattatctgttgccagctgggtacagccttgaggagcaaagaattctggactggcaaccccgtgaaaatcctttccagaatctgaaggtactcttggtatcagaccaacagcagaacttcctggagctctggtctgagatcctcatgactggtggtgcagcctctgtgaagcagcaccattcaagtgcccataacaaagatattgctttaggggtatttgatgtggtggtgacggacccctcatgcccagcctcggtgctgaagtgtgctgaagcattgcagctgcctgtggtgtcacaagagtgggtgatccagtgcctcattgttggggagagaattggattcaagcagcatccaaaatataaacacgattatgtttctcactaa

SEQ ID NO: 10836 - DNA, 5963 bp, synthetic construct
  misc_feature 1..5963: note = Synthetic polypeptide
  source 1..5963: mol_type = other DNA
gaggggacagaatgaccttccggccttgagtccctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtgaaaccccatttcatttcactttgcctaaagaaggtgatatcatcccaccattgactggtgcaaccccacctcttattgggcacctaaaattggagcccaagagacacagtactcctattggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctcaaggagaagaggagaaagaaaaattggagggtgaccatacaatcaggcagagtcaacagcctatgaagcccattagtcctgtcaaggaccctgtttctcctgcttcccagaagatggtcatacaagggccatccagtcctcaaggagaggcaatggtgacagatgtgctagaagaccagaaagaaggacggagtactaataaggaaaatcctagtaaggccttgattgaaaggcccagccaaaataacataggaatccaaaccatggagtgttccttgagggtcccagaaactgtttcagcagcaacccagactataaagaatgtgtgtgagcaggggaccagtacagtggaccagaactttggaaagcaagatgccacagttcagactgagagggggagtggtgagaaaccagtcagtgctcctggggatgatacagagtcgctccatagccagggagaagaagagtttgatatgcctcagcctccacatggccatgtcttacatcgtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagtcctagaaaaggggtcagtcagacagggacgccagtgtgtgaggaggatggtgatgcaggccttggcatcagacagggagggaaggctccagtcacgcctcgtgggcgtgggcgaaggggccgcccaccttctcggaccactggaaccagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctggtgcagtaggggcaggagagtttgtgagcccctgtgagagtggagacaacaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggaatttttggaaattcctcctttcaacaagcagtatacagaatcccagcttcgagcaggagctggctatatccttgaagatttcaatgaagcccagtgtaacacagcttaccagtgtcttctaattgcggatcagcattgtcgaacccggaagtacttcctgtgccttgccagtgggattccttgtgtgtctcatgtctgggtccatgatagttgccatgccaaccagctccagaactaccgtaattatctgttgccagctgggtacagccttgaggagcaaagaattctggactggcaaccccgtgaaaatcctttccagaatctgaaggtactcttggtatcagaccaacagcagaacttcctggagctctggtctgagatcctcatgactggtggtgcagcctctgtgaagcagcaccattcaagtgcccataacaaagatattgctttaggggtatttgatgtggtggtgacggacccctcatgcccagcctcggtgctgaagtgtgctgaagcattgcagctgcctgtggtgtcacaagagtgggtgatccagtgcctcattgttggggagagaattggattcaagcagcatccaaaatataaacacgattatgtttctcactaa

SEQ ID NO: 10837 - DNA, 5957 bp, synthetic construct
  misc_feature 1..5957: note = Synthetic polypeptide
  source 1..5957: mol_type = other DNA
gaggggacagaatgaccttccggccttgagtccctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtgaaaccccatttcatttcactttgcctaaagaaggtgatatcatcccaccattgactggtgcaaccccacctcttattgggcacctaaaattggagcccaagagacacagtactcctattggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctcaaggagaagaggagaaagaaaaattggagggtgaccatacaatcaggcagagtcaacagcctatgaagcccattagtcctgtcaaggaccctgtttctcctgcttcccagaagatggtcatacaagggccatccagtcctcaaggagaggcaatggtgacagatgtgctagaagaccagaaagaaggacggagtactaataaggaaaatcctagtaaggccttgattgaaaggcccagccaaaataacataggaatccaaaccatggagtgttccttgagggtcccagaaactgtttcagcagcaacccagactataaagaatgtgtgtgagcaggggaccagtacagtggaccagaactttggaaagcaagatgccacagttcagactgagagggggagtggtgagaaaccagtcagtgctcctggggatgatacagagtcgctccatagccagggagaagaagagtttgatatgcctcagcctccacatggccatgtcttacatcgtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagtcctagaaaaggggtcagtcagacagggacgccagtgtgtgaggaggatggtgatgcaggccttggcatcagacagggagggaaggctccagtcacgcctcgtgggcgtgggcgaaggggccgcccaccttctcggaccactggaaccagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctgtaggggcaggagagtttgtgagcccctgtgagagtggagacaacaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggaatttttggaaattcctcctttcaacaagcagtatacagaatcccagcttcgagcaggagctggctatatccttgaagatttcaatgaagcccagtgtaacacagcttaccagtgtcttctaattgcggatcagcattgtcgaacccggaagtacttcctgtgccttgccagtgggattccttgtgtgtctcatgtctgggtccatgatagttgccatgccaaccagctccagaactaccgtaattatctgttgccagctgggtacagccttgaggagcaaagaattctggactggcaaccccgtgaaaatcctttccagaatctgaaggtactcttggtatcagaccaacagcagaacttcctggagctctggtctgagatcctcatgactggtggtgcagcctctgtgaagcagcaccattcaagtgcccataacaaagatattgctttaggggtatttgatgtggtggtgacggacccctcatgcccagcctcggtgctgaagtgtgctgaagcattgcagctgcctgtggtgtcacaagagtgggtgatccagtgcctcattgttggggagagaattggattcaagcagcatccaaaatataaacacgattatgtttctcactaa

SEQ ID NO: 10838 - DNA, 3129 bp, synthetic construct
  misc_feature 1..3129: note = Synthetic polypeptide
  source 1..3129: mol_type = other DNA
gaggggacagaatgaccttccggccttgagtccctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctc

SEQ ID NO: 10839 - DNA, 1609 bp, synthetic construct
  misc_feature 1..1609: note = Synthetic polypeptide
  source 1..1609: mol_type = other DNA
acaaaaagacaccatttgaaaagtgtgcaaatgatgtgaacagatatttctctaaagaaaatatacaaatgaacagtaagcacgtgcaaaaatgttcgacattattagtcattagtaaagtgcaaatcgaaactccaagatagctcttcacacctattaggatggctattactaaaaaataataataaatgttggctaagacttacagaaattggaacccttttacactgttgttggggatgtaaaatggtgccgcggcttgggacagtttatctgttcctcaaaaggctagaattaccatattagtcaacaattccactcctaggtttgtacacagaataattgagaacaagcactgaagcagatgctaccagtgttcattgcagcagtattcacaatagccaaaaggtgtaaacaacccacgtgtccaccaacaggtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaagtaaagattatagttcccaacagcacagcaggtctgataatagggaagggaggtgctactgtgaaggctgtaatggagcagtcaggggcttgggtgcagctttcccagaaacctgatgggatcaacttgcaagagagggttgtcactgtgagtggagaacctgaacaaaaccgaaaagctgttgaacttatcatccagaagatacaagaggatccacaaagtggcagctgtctcaatatcagttatgccaatgtgacaggtccagtggcaaattccaatccaaccggatctccttatgcaaacactgctgaagtgttaccaactgctgcagcagctgcagggctattaggacatgctaaccttgctggcgttgcagcctttccagcagttttatctggcttcacaggcaatgacctggtggccatcacctctgcacttaatacattagccagctatggatataatctcaacactttaggtttaggtctcagtcaagcagcagcaacaggggctttggctgcagcagctgccagtgccaacccagcagcagcagcagccaatttattggccacctatgccagtgaagcctcagccagtggcagcacagctggtggtacggcggggacatttgcattaggtagcctggctgctgctactgctgcaaccaatggatattttggagctgcttctcccctagctgccagtgccattctaggaacagaaaagtccacagatggatccaaggatgtagttgaaatagcagtgccagaaaacttagttggtgcaatacttggcaaaggagggaaaacattagtggaataccaggagttgactggtgcaaggatacagatctccaaaaaaggagaattcgtacctggcacaaggaatcggaaggtaaccattactggaacaccagctgcaacacaggctgctcaatatttaattacacaaaggatcacatatgagcaaggagttcgggctgccaatcctcagaaagtgggttga

SEQ ID NO: 10840 - DNA, 1681 bp, synthetic construct
  misc_feature 1..1681: note = Synthetic polypeptide
  source 1..1681: mol_type = other DNA
acaaaaagacaccatttgaaaagtgtgcaaatgatgtgaacagatatttctctaaagaaaatatacaaatgaacagtaagcacgtgcaaaaatgttcgacattattagtcattagtaaagtgcaaatcgaaactccaagatagctcttcacacctattaggatggctattactaaaaaataataataaatgttggctaagacttacagaaattggaacccttttacactgttgttggggatgtaaaatggtgccgcggcttgggacagtttatctgttcctcaaaaggctagaattaccatattagtcaacaattccactcctaggtttgtacacagaataattgagaacaagcactgaagcagatgctaccagtgttcattgcagcagtattcacaatagccaaaaggtgtaaacaacccacgtgtccaccaacaggtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaaacattgccatcttccccaactaccaccaagtcctctccatctgatcccatgaccacctccagagctaatcaggtaaagattatagttcccaacagcacagcaggtctgataatagggaagggaggtgctactgtgaaggctgtaatggagcagtcaggggcttgggtgcagctttcccagaaacctgatgggatcaacttgcaagagagggttgtcactgtgagtggagaacctgaacaaaaccgaaaagctgttgaacttatcatccagaagatacaagaggatccacaaagtggcagctgtctcaatatcagttatgccaatgtgacaggtccagtggcaaattccaatccaaccggatctccttatgcaaacactgctgaagtgttaccaactgctgcagcagctgcagggctattaggacatgctaaccttgctggcgttgcagcctttccagcagttttatctggcttcacaggcaatgacctggtggccatcacctctgcacttaatacattagccagctatggatataatctcaacactttaggtttaggtctcagtcaagcagcagcaacaggggctttggctgcagcagctgccagtgccaacccagcagcagcagcagccaatttattggccacctatgccagtgaagcctcagccagtggcagcacagctggtggtacggcggggacatttgcattaggtagcctggctgctgctactgctgcaaccaatggatattttggagctgcttctcccctagctgccagtgccattctaggaacagaaaagtccacagatggatccaaggatgtagttgaaatagcagtgccagaaaacttagttggtgcaatacttggcaaaggagggaaaacattagtggaataccaggagttgactggtgcaaggatacagatctccaaaaaaggagaattcgtacctggcacaaggaatcggaaggtaaccattactggaacaccagctgcaacacaggctgctcaatatttaattacacaaaggatcacatatgagcaaggagttcgggctgccaatcctcagaaagtgggttga

SEQ ID NO: 10841 - DNA, 1112 bp, synthetic construct
  misc_feature 1..1112: note = Synthetic polypeptide
  source 1..1112: mol_type = other DNA
acaaaaagacaccatttgaaaagtgtgcaaatgatgtgaacagatatttctctaaagaaaatatacaaatgaacagtaagcacgtgcaaaaatgttcgacattattagtcattagtaaagtgcaaatcgaaactccaagatagctcttcacacctattaggatggctattactaaaaaataataataaatgttggctaagacttacagaaattggaacccttttacactgttgttggggatgtaaaatggtgccgcggcttgggacagtttatctgttcctcaaaaggctagaattaccatattagtcaacaattccactcctaggtttgtacacagaataattgagaacaagcactgaagcagatgctaccagtgttcattgcagcagtattcacaatagccaaaaggtgtaaacaacccacgtgtccaccaacaggtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaaacattgccatcttccccaactaccaccaagtcctctccatctgatcccatgaccacctccagagctaatcaggtaaagattatagttcccaacagcacagcaggtctgataatagggaagggaggtgctactgtgaaggctgtaatggagcagtcaggggcttgggtgcagctttcccagaaacctgatgggatcaacttgcaagagagggttgtcactgtgagtggagaacctgaacaaaaccgaaaagctgttgaacttatcatccagaagatacaagaggatccacaaagtggcagctgtctcaatatcagttatgccaatgtgacaggtccagtggcaaattccaatccaaccggatctccttatgcaaacactgctgaagtgttaccaactgctgcagcagctgcagggctattaggacatgctaaccttgctggcgttgcagcctttccagcagttttatctggcttcacaggcaatgacctggtggccatcacctctgcac

SEQ ID NO: 10842 - DNA, 788 bp, synthetic construct
  misc_feature 1..788: note = Synthetic polypeptide
  source 1..788: mol_type = other DNA
acaaaaagacaccatttgaaaagtgtgcaaatgatgtgaacagatatttctctaaagaaaatatacaaatgaacagtaagcacgtgcaaaaatgttcgacattattagtcattagtaaagtgcaaatcgaaactccaagatagctcttcacacctattaggatggctattactaaaaaataataataaatgttggctaagacttacagaaattggaacccttttacactgttgttggggatgtaaaatggtgccgcggcttgggacagtttatctgttcctcaaaaggctagaattaccatattagtcaacaattccactcctaggtttgtacacagaataattgagaacaagcactgaagcagatgctaccagtgttcattgcagcagtattcacaatagccaaaaggtgtaaacaacccacgtgtccaccaacaggtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaaacattgccatcttccccaactaccaccaagtcctctccatctgatcccatgaccacctccagagctaatcaggtaaagattatagttcccaacagcacagcaggtctgataatagggaagggaggtgctactgtgaaggctgtaatggagcagtcaggggcttgggtgcagctttcccagaaac

SEQ ID NO: 10843 - DNA, 703 bp, synthetic construct
  misc_feature 1..703: note = Synthetic polypeptide
  source 1..703: mol_type = other DNA
acaaaaagacaccatttgaaaagtgtgcaaatgatgtgaacagatatttctctaaagaaaatatacaaatgaacagtaagcacgtgcaaaaatgttcgacattattagtcattagtaaagtgcaaatcgaaactccaagatagctcttcacacctattaggatggctattactaaaaaataataataaatgttggctaagacttacagaaattggaacccttttacactgttgttggggatgtaaaatggtgccgcggcttgggacagtttatctgttcctcaaaaggctagaattaccatattagtcaacaattccactcctaggtttgtacacagaataattgagaacaagcactgaagcagatgctaccagtgttcattgcagcagtattcacaatagccaaaaggtgtaaacaacccacgtgtccaccaacaggtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaaacattgccatcttccccaactaccaccaagtcctctccatctgatcccatgaccacctccagagctaatcagaagcataatatctcctggatatcatga

SEQ ID NO: 10844 - DNA, 793 bp, synthetic construct
  misc_feature 1..793: note = Synthetic polypeptide
  source 1..793: mol_type = other DNA
acaaaaagacaccatttgaaaagtgtgcaaatgatgtgaacagatatttctctaaagaaaatatacaaatgaacagtaagcacgtgcaaaaatgttcgacattattagtcattagtaaagtgcaaatcgaaactccaagatagctcttcacacctattaggatggctattactaaaaaataataataaatgttggctaagacttacagaaattggaacccttttacactgttgttggggatgtaaaatggtgccgcggcttgggacagtttatctgttcctcaaaaggctagaattaccatattagtcaacaattccactcctaggtttgtacacagaataattgagaacaagcactgaagcagatgctaccagtgttcattgcagcagtattcacaatagccaaaaggtgtaaacaacccacgtgtccaccaacaggtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaaacattgccatcttccccaactaccaccaagtcctctccatctgatcccatgaccacctccagagctaatcaggtacagtatcatcctgtcatctacaccatacttttcacgggtgattgcctgcaaactggagaaaaagataatggtgggttaaggatttattcgttcattcacatatatgcaccatag

SEQ ID NO: 10845 - DNA, 616 bp, synthetic construct
  misc_feature 1..616: note = Synthetic polypeptide
  source 1..616: mol_type = other DNA
acaaaaagacaccatttgaaaagtgtgcaaatgatgtgaacagatatttctctaaagaaaatatacaaatgaacagtaagcacgtgcaaaaatgttcgacattattagtcattagtaaagtgcaaatcgaaactccaagatagctcttcacacctattaggatggctattactaaaaaataataataaatgttggctaagacttacagaaattggaacccttttacactgttgttggggatgtaaaatggtgccgcggcttgggacagtttatctgttcctcaaaaggctagaattaccatattagtcaacaattccactcctaggtttgtacacagaataattgagaacaagcactgaagcagatgctaccagtgttcattgcagcagtattcacaatagccaaaaggtgtaaacaacccacgtgtccaccaacaggtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaagtgagtgtttag

SEQ ID NO: 10846 - DNA, 93 bp, synthetic construct
  misc_feature 1..93: note = Synthetic polypeptide
  source 1..93: mol_type = other DNA
tgatggctcagagcatgattctggaggcagctagctaggtcggaatttgctttgccgcatggaagctgtgccatcctgggacgcctcgtctaa

SEQ ID NO: 10847 - DNA, 1079 bp, synthetic construct; identical to SEQ ID NO: 6652
  misc_feature 1..1079: note = Synthetic polypeptide
  source 1..1079: mol_type = other DNA

SEQ ID NO: 10848 - DNA, 267 bp, synthetic construct
  misc_feature 1..267: note = Synthetic polypeptide
  source 1..267: mol_type = other DNA
aatactctcaaaacagagcctccattgccccgacaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtgacgactacgatgacacagacgatgacgaccctttcaaccctcagcaggaatccaagcgctttgtgcagtggcagtcgtctatctga

SEQ ID NO: 10849 - DNA, 264 bp, synthetic construct
  misc_feature 1..264: note = Synthetic polypeptide
  source 1..264: mol_type = other DNA
aatactctcaaaacagagcctccattgccccgacaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtgacgactacgatgacacagacgatgacgaccctttcaaccctcaggaatccaagcgctttgtgcagtggcagtcgtctatctga

SEQ ID NO: 10850 - DNA, 182 bp, synthetic construct
  misc_feature 1..182: note = Synthetic polypeptide
  source 1..182: mol_type = other DNA
aatactctcaaaacagagcctccattgccccgacaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtga

SEQ ID NO: 10851 - DNA, 294 bp, synthetic construct
  misc_feature 1..294: note = Synthetic polypeptide
  source 1..294: mol_type = other DNA
aatactctcaaaacagagcctccattgccccgacaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccaggaatccaagcgctttgtgcagtggcagtcgtctatctgagcccctcctcccggctggactggagcctggctcccctcttcgttccttccctggctgccggaggagaccccactaa

SEQ ID NO: 10852 - DNA, 1508 bp, synthetic construct
  misc_feature 1..1508: note = Synthetic polypeptide
  source 1..1508: mol_type = other DNA
gttcctcaaaaaattaaacatagaattaccatatgatccagcaattctgcttctgagtagatacctgaagaattacaagcagctctcaaagagatatttgtacactcctgttcacagcagcactattcacagtaggcaaaaggtggaagcaagccaagcgttcactgataaatgaattgacactgccgtggaaacagtgcgacaacccctggaacacagaccgctgcttctccaactacagcatggtcaacactaccaacatgaccagcgctgtggtggagttctgggagcgcaacatgcatcagatgacggacgggctggataagccaggtcagatccgctggccactggccatcacgctggccatcgcctggatccttgtgtatttctgtatctggaagggtgttggctggactggaaaggtggtctacttttcagccacatacccctacatcatgctgatcatcctgttcttccgtggagtgacgctgcccggggccaaggagggcatcctcttctacatcacacccaacttccgcaagctgtctgactccgaggtgtggctggatgcggcaacccagatcttcttctcatacgggctgggcctggggtccctgatcgctctcgggagctacaactctttccacaacaatgtctacagggactccatcatcgtctgctgcatcaattcgtgcaccagcatgttcgcaggattcgtcatcttctccatcgtgggcttcatggcccatgtcaccaagaggtccattgctgatgtggcggcctcaggccccgggctggcgttcctggcatacccagaggcggtgacccagctgcctatctccccactctgggccatcctcttcttctccatgctgttgatgctgggcattgacagccagttctgcactgtggagggcttcatcacagccctggtggatgagtaccccaggctcctccgcaaccgcagagagctcttcattgctgctgtctgcatcatctcctacctgatcggtctctctaacatcactcaggggggtatttatgtcttcaaactctttgactactactctgccagtggcatgagcctgctgttcctcgtgttctttgaatgtgtctctatttcctggttttacggtgtcaaccgattctatgacaatatccaagagatggttggatccaggccctgcatctggtggaaactctgctggtctttcttcacaccaatcattgtggcgggcgtgttcattttcagtgctgtgcagatgacgccactcaccatgggaaactatgttttccccaagtggggccagggtgtgggctggctgatggctctgtcttccatggtcctcatccccgggtacatggcctacatgttcctcaccttaaagggctccctgaagcagcgcatccaagtcatggtccagcccagcgaagacatcgttcgcccagagaatggtcctgagcagccccaggcgggcagctccaccagcaaggaggcctacatctag

SEQ ID NO: 10853 - DNA, 6989 bp, synthetic construct
  misc_feature 1..6989: note = Synthetic polypeptide
  source 1..6989: mol_type = other DNA
ggccaggcgcagtggctcatgcctgtaatcccagcactttgggaggccgaggcgggcagatcatgaagtcaagagattgagaccatcctggccaacatgattgggctaatggatactacagacaacagagaaaacttgttgaagagattggctggtcctatacaggagcactgaatcaaaaaaattggggaaagaaatatccaacatgtaatagcccaaaacaatctcctatcaatattgatgaagatcttacacaagtaaatgtgaatcttaagaaacttaaatttcagggttgggataaaacatcattggaaaacacattcattcataacactgggaaaacagtggaaattaatctcactaatgactaccgtgtcagcggaggagtttcagaaatggtgtttaaagcaagcaagataacttttcactggggaaaatgcaatatgtcatctgatggatcagagcatagtttagaaggacaaaaatttccacttgagatgcaaatctactgctttgatgcggaccgattttcaagttttgaggaagcagtcaaaggaaaagggaagttaagagctttatccattttgtttgaggttgggacagaagaaaatttggatttcaaagcgattattgatggagtcgaaagtgttagtcgttttgggaagcaggctgctttagatccattcatactgttgaaccttctgccaaactcaactgacaagtattacatttacaatggctcattgacatctcctccctgcacagacacagttgactggattgtttttaaagatacagttagcatctctgaaagccagttggctgttttttgtgaagttcttacaatgcaacaatctggttatgtcatgctgatggactacttacaaaacaattttcgagagcaacagtacaagttctctagacaggtgttttcctcatacactggaaaggaagagattcatgaagcagtttgtagttcagaaccagaaaatgttcaggctgacccagagaattataccagccttcttgttacatgggaaagacctcgagtcgtttatgataccatgattgagaagtttgcagttttgtaccagcagttggatggagaggaccaaaccaagcatgaatttttgacagatggctatcaagacttgggtgctattctcaataatttgctacccaatatgagttatgttcttcagatagtagccatatgcactaatggcttatatggaaaatacagcgaccaactgattgtcgacatgcctactgataatcctgaacttgatcttttccctgaattaattggaactgaagaaataatcaaggaggaggaagagggaaaagacattgaagaaggcgctattgtgaatcctggtagagacagtgctacaaaccaaatcaggaaaaaggaaccccagatttctaccacaacacactacaatcgcatagggacgaaatacaatgaagccaagactaaccgatccccaacaagaggaagtgaattctctggaaagggtgatgttcccaatacatctttaaattccacttcccaaccagtcactaaattagccacagaaaaagatatttccttgacttctcagactgtgactgaactgccacctcacactgtggaaggtacttcagcctctttaaatgatggctctaaaactgttcttagatctccacatatgaacttgtcggggactgcagaatccttaaatacagtttctataacagaatatgaggaggagagtttattgaccagtttcaagcttgatactggagctgaagattcttcaggctccagtcccgcaacttctgctatcccattcatctctgagaacatatcccaagggtatatattttcctccgaaaacccagagacaataacatatgatgtccttataccagaatctgctagaaatgcttccgaagattcaacttcatcaggttcagaagaatcactaaaggatccttctatggagggaaatgtgtggtttcctagctctacagacataacagcacagcccgatgttggatcaggcagagagagctttctccagactaattacactgagatacgtgttgatgaatctgagaagacaaccaagtccttttctgcaggcccagtgatgtcacagggtccctcagttacagatctggaaatgccacattattctacctttgcctacttcccaactgaggtaacacctcatgcttttaccccatcctccagacaacaggatttggtctccacggtcaacgtggtatactcgcagacaacccaaccggtatacaatggtgagacacctcttcaaccttcctacagtagtgaagtctttcctctagtcacccctttgttgcttgacaatcagatcctcaacactacccctgctgcttcaagtagtgattcggccttgcatgctacgcctgtatttcccagtgtcgatgtgtcatttgaatccatcctgtcttcctatgatggtgcacctttgcttccattttcctctgcttccttcagtagtgaattgtttcgccatctgcatacagtttctcaaatccttccacaagttacttcagctaccgagagtgataaggtgcccttgcatgcttctctgccagtggctgggggtgatttgctattagagcccagccttgctcagtattctgatgtgctgtccactactcatgctgcttcagagacgctggaatttggtagtgaatctggtgttctttataaaacgcttatgttttctcaagttgaaccacccagcagtgatgccatgatgcatgcacgttcttcagggcctgaaccttcttatgccttgtctgataatgagggctcccaacacatcttcactgtttcttacagttctgcaatacctgtgcatgattctgtgggtgtaacttatcagggttccttatttagcggccctagccatataccaatacctaagtcttcgttaataaccccaactgcatcattactgcagcctactcatgccctctctggtgatggggaatggtctggagcctcttctgatagtgaatttcttttacctgacacagatgggctgacagcccttaacatttcttcacctgtttctgtagctgaatttacatatacaacatctgtgtttggtgatgataataaggcgctttctaaaagtgaaataatatatggaaatgagactgaactgcaaattccttctttcaatgagatggtttacccttctgaaagcacagtcatgcccaacatgtatgataatgtaaataagttgaatgcgtctttacaagaaacctctgtttccatttctagcaccaagggcatgtttccagggtcccttgctcataccaccactaaggtttttgatcatgagattagtcaagttccagaaaataacttttcagttcaacctacacatactgtctctcaagcatctggtgacacttcgcttaaacctgtgcttagtgcaaactcagagccagcatcctctgaccctgcttctagtgaaatgttatctccttcaactcagctcttattttatgagacctcagcttcttttagtactgaagtattgctacaaccttcctttcaggcttctgatgttgacaccttgcttaaaactgttcttccagctgtgcccagtgatccaatattggttgaaacccccaaagttgataaaattagttctacaatgttgcatctcattgtatcaaattctgcttcaagtgaaaacatgctgcactctacatctgtaccagtttttgatgtgtcgcctacttctcatatgcactctgcttcacttcaaggtttgaccatttcctatgcaagtgagaaatatgaaccagttttgttaaaaagtgaaagttcccaccaagtggtaccttctttgtacagtaatgatgagttgttccaaacggccaatttggagattaaccaggcccatcccccaaaaggaaggcatgtatttgctacacctgttttatcaattgatgaaccattaaatacactaataaataagcttatacattccgatgaaattttaacctccaccaaaagttctgttactggtaaggtatttgctggtattccaacagttgcttctgatacatttgtatctactgatcattctgttcctataggaaatgggcatgttgccattacagctgtttctccccacagagatggttctgtaacctcaacaaagttgctgtttccttctaaggcaacttctgagctgagtcatagtgccaaatctgatgccggtttagtgggtggtggtgaagatggtgacactgatgatgatggtgatgatgatgatgatgacagaggtagtgatggcttatccattcataagtgtatgtcatgctcatcctatagagaatcacaggaaaaggtaatgaatgattcagacacccacgaaaacagtcttatggatcagaataatccaatctcatactcactatctgagaattctgaagaagataatagagtcacaagtgtatcctcagacagtcaaactggtatggacagaagtcctggtaaatcaccatcagcaaatgggctatcccaaaagcacaatgatggaaaagaggaaaatgacattcagactggtagtgctctgcttcctctcagccctgaatctaaagcatgggcagttctgacaagtgatgaagaaagtggatcagggcaaggtacctcagatagccttaatgagaatgagacttccacagatttcagttttgcagacactaatgaaaaagatgctgatgggatcctggcagcaggtgactcagaaataactcctggattcccacagtccccaacatcatctgttactagcgagaactcagaagtgttccacgtttcagaggcagaggccagtaatagtagccatgagtctcgtattggtctagctgaggggttggaatccgagaagaaggcagttataccccttgtgatcgtgtcagccctgacttttatctgtctagtggttcttgtgggtattctcatctactggaggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgagacactgaaagagttttaccaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaa

SEQ ID NO: 10854 - DNA, 4388 bp, synthetic construct
  misc_feature 1..4388: note = Synthetic polypeptide
  source 1..4388: mol_type = other DNA
ggccaggcgcagtggctcatgcctgtaatcccagcactttgggaggccgaggcgggcagatcatgaagtcaagagattgagaccatcctggccaacatgattgggctaatggatactacagacaacagagaaaacttgttgaagagattggctggtcctatacaggagcactgaatcaaaaaaattggggaaagaaatatccaacatgtaatagcccaaaacaatctcctatcaatattgatgaagatcttacacaagtaaatgtgaatcttaagaaacttaaatttcagggttgggataaaacatcattggaaaacacattcattcataacactgggaaaacagtggaaattaatctcactaatgactaccgtgtcagcggaggagtttcagaaatggtgtttaaagcaagcaagataacttttcactggggaaaatgcaatatgtcatctgatggatcagagcatagtttagaaggacaaaaatttccacttgagatgcaaatctactgctttgatgcggaccgattttcaagttttgaggaagcagtcaaaggaaaagggaagttaagagctttatccattttgtttgaggttgggacagaagaaaatttggatttcaaagcgattattgatggagtcgaaagtgttagtcgttttgggaagcaggctgctttagatccattcatactgttgaaccttctgccaaactcaactgacaagtattacatttacaatggctcattgacatctcctccctgcacagacacagttgactggattgtttttaaagatacagttagcatctctgaaagccagttggctgttttttgtgaagttcttacaatgcaacaatctggttatgtcatgctgatggactacttacaaaacaattttcgagagcaacagtacaagttctctagacaggtgttttcctcatacactggaaaggaagagattcatgaagcagtttgtagttcagaaccagaaaatgttcaggctgacccagagaattataccagccttcttgttacatgggaaagacctcgagtcgtttatgataccatgattgagaagtttgcagttttgtaccagcagttggatggagaggaccaaaccaagcatgaatttttgacagatggctatcaagacttgggtgctattctcaataatttgctacccaatatgagttatgttcttcagatagtagccatatgcactaatggcttatatggaaaatacagcgaccaactgattgtcgacatgcctactgataatcctgaacttgatcttttccctgaattaattggaactgaagaaataatcaaggaggaggaagagggaaaagacattgaagaaggcgctattgtgaatcctggtagagacagtgctacaaaccaaatcaggaaaaaggaaccccagatttctaccacaacacactacaatcgcatagggacgaaatacaatgaagccaagactaaccgatccccaacaagaggaagtgaattctctggaaagggtgatgttcccaatacatctttaaattccacttcccaaccagtcactaaattagccacagaaaaagatatttccttgacttctcagactgtgactgaactgccacctcacactgtggaaggtacttcagcctctttaaatgatggctctaaaactgttcttagatctccacatatgaacttgtcggggactgcagaatccttaaatacagtttctataacagaatatgaggaggagagtttattgaccagtttcaagcttgatactggagctgaagattcttcaggctccagtcccgcaacttctgctatcccattcatctctgagaacatatcccaagggtatatattttcctccgaaaacccagagacaataacatatgatgtccttataccagaatctgctagaaatgcttccgaagattcaacttcatcaggttcagaagaatcactaaaggatccttctatggagggaaatgtgtggtttcctagctctacagacataacagcacagcccgatgttggatcaggcagagagagctttctccagactaattacactgagatacgtgttgatgaatctgagaagacaaccaagtccttttctgcaggcccagtgatgtcacagggtccctcagttacagatctggaaatgccacattattctacctttgcctacttcccaactgaggtaacacctcatgcttttaccccatcctccagacaacaggatttggtctccacggtcaacgtggtatactcgcagacaacccaaccggtatacaatgaggccagtaatagtagccatgagtctcgtattggtctagctgaggggttggaatccgagaagaaggcagttataccccttgtgatcgtgtcagccctgacttttatctgtctagtggttcttgtgggtattctcatctactggaggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaa

SEQ ID NO: 10855 - DNA, 363 bp, synthetic construct; identical to SEQ ID NO: 7059
  misc_feature 1..363: note = Synthetic polypeptide
  source 1..363: mol_type = other DNA

SEQ ID NO: 10856 - DNA, 465 bp, synthetic construct; identical to SEQ ID NO: 7060
  misc_feature 1..465: note = Synthetic polypeptide
  source 1..465: mol_type = other DNA

SEQ ID NO: 10857 - DNA, 2326 bp, synthetic construct
  misc_feature 1..2326: note = Synthetic polypeptide
  source 1..2326: mol_type = other DNA
agtttggatatttgtcccccaaaatctcatgttgaaatttgattccctaatgttggaggtgagaccttaatgggaggtgtttgggtcatggggctggatccctcatgaatggcctggtgcttttgtcctcctagtaatgcctgctttttagtatcttgtagcaataagtaatgaagctagaagagttgtctactatagcctccctgagagttcccctgagagctacttgttgaaaagtgcataacacctttcccttctctcctgctttcctctctcaccgtatgatcgctccacacgcttgttccccttcgccttctgccaggggtggaagcagcctgaagccatcaacacaaacagatgctggtgccatgttccttgtagagcctgcagagccatgagccaaataaacttctttacaaatgacccagcttcagcaataggcgaatatgaagaccttagagcagagaaccagaaaacaaaggagaagtgtgacaaaattaggcaagaacgagatgaagccgttaaaaaactggaagaatttcagaaaatttctcacatggtcatagaggaagttaatttcatgcagaaccatcttgaaatagagaagacttgtcgagaaagtgctgaagctttggcaacaaagctaaataaagaaaataaaacgttgaaaagaatcagcatgttgtacatggccaagctgggaccagatgtaataactgaagagataaacattgatgatgaagattcgactacagacacagacggtgccgccgagacttgtgtctcagtacagtgtcagaagcaaattaaagaacttcgagatcaaattgtatctgttcaggaggaaaagaagattttagccattgagctggaaaatctcaagagcaaactcgtagaagtaattgaagaagtaaataaagttaaacaagaaaagactgttttaaattcagaagttcttgaacagagaaaagtcttagaaaaatgcaatagagtgtccatgttagctgtagaagagtatgaggagatgcaagtaaacctggagctggagaaggaccttcgaaagaaagcagagtcatttgcacaagagatgttcattgagcaaaacaagctaaagagacaaagccaccttctgctgcagagctccatccctgatcagcagcttttgaaagctttagacgaaaatgcaaaactcacccagcaacttgaagaagagagaattcagcatcaacaaaaggtcaaagaattagaagagcaactagaaaatgaaacactccacaaagaaatacacaacctcaaacagcaactggagcttctagaggaagataaaaaggaattggaattgaaatatcagaattctgaagagaaagccagaaatttaaagcactctgttgatgaactccagaaacgagtgaaccagtctgagaattcagtacctccaccacctcctcctccaccaccacttccccctccacctcccaatcctatccgatccctcatgtccatgatccggaaacgatcccaccccagtggcagtggtgctaagaaagaaaaggcaactcaaccagaaacaactgaagaagtcacagatctaaagaggcaagcagttgaagagatgatggatagaattaaaaagggagttcatcttagacccgttaatcagacagccagaccgaagacaaagccagaatcttcgaaaggctgcgaaagtgcagtggatgaactaaaaggaatactggggacacttaacaaatccactagttcaagaagcttaaaatcccttgaccctgaaaacagtgaaactgagttagaaaggattttgcgtcgcagaaaggtgacagcagaagcagatagcagtagtccaactgggatattagccacctcagagtccaaatccatgccagtgttgggttctgtatccagtgtaacaaaaacagccttgaacaagaaaactctggaggcagaattcaacagcccgtcccccccaacacctgagccaggtgaagggccccgtaaattggaaggatgcacaagttccaaggttacgtttcagcctcccagtagcattggatgcaggaaaaaatacattgacggtgaaaaacaagccgaaccagttgtagttttagatcctgtttctacacatgaaccccaaaccaaagaccaggttgctgaaaaagatccaactcaacacaaggaggatgaaggcgaaattcaaccagaaaacaaagaagacagcattgaaaactttttcccttttcactttggttttgagggggttttgcccctggctggggtgacactgtcaaccaaagcaagggatcccaaatag

SEQ ID NO: 10858 - DNA, 1747 bp, synthetic construct
  misc_feature 1..1747: note = Synthetic polypeptide
  source 1..1747: mol_type = other DNA
agtttggatatttgtcccccaaaatctcatgttgaaatttgattccctaatgttggaggtgagaccttaatgggaggtgtttgggtcatggggctggatccctcatgaatggcctggtgcttttgtcctcctagtaatgcctgctttttagtatcttgtagcaataagtaatgaagctagaagagttgtctactatagcctccctgagagttcccctgagagctacttgttgaaaagtgcataacacctttcccttctctcctgctttcctctctcaccgtatgatcgctccacacgcttgttccccttcgccttctgccaggggtggaagcagcctgaagccatcaacacaaacagatgctggtgccatgttccttgtagagcctgcagagccatgagccaaataaacttctttacaaatgacccagcttcagcaataggcgaatatgaagaccttagagcagagaaccagaaaacaaaggagaagtgtgacaaaattaggcaagaacgagatgaagccgttaaaaaactggaagaatttcagaaaatttctcacatggtcatagaggaagttaatttcatgcagaaccatcttgaaatagagaagacttgtcgagaaagtgctgaagctttggcaacaaagctaaataaagaaaataaaacgttgaaaagaatcagcatgttgtacatggccaagctgggaccagatgtaataactgaagagataaacattgatgatgaagattcgactacagacacagacggtgccgccgagacttgtgtctcagtacagtgtcagaagcaaattaaagaacttcgagatcaaattgtatctgttcaggaggaaaagaagattttagccattgagctggaaaatctcaagagcaaactcgtagaagtaattgaagaagtaaataaagttaaacaagaaaagactgttttaaattcagaagttcttgaacagagaaaagtcttagaaaaatgcaatagagtgtccatgttagctgtagaagagtatgaggagatgcaagtaaacctggagctggagaaggaccttcgaaagaaagcagagtcatttgcacaagagatgttcattgagcaaaacaagctaaagagacaaagccaccttctgctgcagagctccatccctgatcagcagcttttgaaagctttagacgaaaatgcaaaactcacccagcaacttgaagaagagagaattcagcatcaacaaaaggtcaaagaattagaagagcaactagaaaatgaaacactccacaaagaaatacacaacctcaaacagcaactggagcttctagaggaagataaaaaggaattggaattgaaatatcagaattctgaagagaaagccagaaatttaaagcactctgttgatgaactccagaaacgagtgaaccagtctgagaattcagtacctccaccacctcctcctccaccaccacttccccctccacctcccaatcctatccgatccctcatgtccatgatccggaaacgatcccaccccagtggcagtggtgctaagaaagaaaaggcaactcaaccagaaacaactgaagaagtcacagatctaaagaggcaagcagttgaagagatgatggatagaattaaaaagggagttcatcttagacccgttaatcagacagccagaccgaagacaaagccagaatcttcgaaaggctgcgaaagtgcagtggatgaactaaaaggaatactggcctcccagtag

SEQ ID NO: 10859 - DNA, 2272 bp, synthetic construct
  misc_feature 1..2272: note = Synthetic polypeptide
  source 1..2272: mol_type = other DNA
agtttggatatttgtcccccaaaatctcatgttgaaatttgattccctaatgttggaggtgagaccttaatgggaggtgtttgggtcatggggctggatccctcatgaatggcctggtgcttttgtcctcctagtaatgcctgctttttagtatcttgtagcaataagtaatgaagctagaagagttgtctactatagcctccctgagagttcccctgagagctacttgttgaaaagtgcataacacctttcccttctctcctgctttcctctctcaccgtatgatcgctccacacgcttgttccccttcgccttctgccaggggtggaagcagcctgaagccatcaacacaaacagatgctggtgccatgttccttgtagagcctgcagagccatgagccaaataaacttctttacaaatgacccagcttcagcaataggcgaatatgaagaccttagagcagagaaccagaaaacaaaggagaagtgtgacaaaattaggcaagaacgagatgaagccgttaaaaaactggaagaatttcagaaaatttctcacatggtcatagaggaagttaatttcatgcagaaccatcttgaaatagagaagacttgtcgagaaagtgctgaagctttggcaacaaagctaaataaagaaaataaaacgttgaaaagaatcagcatgttgtacatggccaagctgggaccagatgtaataactgaagagataaacattgatgatgaagattcgactacagacacagacggtgccgccgagacttgtgtctcagtacagtgtcagaagcaaattaaagaacttcgagatcaaattgtatctgttcaggaggaaaagaagattttagccattgagctggaaaatctcaagagcaaactcgtagaagtaattgaagaagtaaataaagttaaacaagaaaagactgttttaaattcagaagttcttgaacagagaaaagtcttagaaaaatgcaatagagtgtccatgttagctgtagaagagtatgaggagatgcaagtaaacctggagctggagaaggaccttcgaaagaaagcagagtcatttgcacaagagatgttcattgagcaaaacaagctaaagagacaaagccaccttctgctgcagagctccatccctgatcagcagcttttgaaagctttagacgaaaatgcaaaactcacccagcaacttgaagaagagagaattcagcatcaacaaaaggtcaaagaattagaagagcaactagaaaatgaaacactccacaaagaaatacacaacctcaaacagcaactggagcttctagaggaagataaaaaggaattggaattgaaatatcagaattctgaagagaaagccagaaatttaaagcactctgttgatgaactccagaaacgagtgaaccagtctgagaattcagtacctccaccacctcctcctccaccaccacttccccctccacctcccaatcctatccgatccctcatgtccatgatccggaaacgatcccaccccagtggcagtggtgctaagaaagaaaaggcaactcaaccagaaacaactgaagaagtcacagatctaaagaggcaagcagttgaagagatgatggatagaattaaaaagggagttcatcttagacccgttaatcagacagccagaccgaagacaaagccagaatcttcgaaaggctgcgaaagtgcagtggatgaactaaaaggaatactggggacacttaacaaatccactagttcaagaagcttaaaatcccttgaccctgaaaacagtgaaactgagttagaaaggattttgcgtcgcagaaaggtgacagcagaagcagatagcagtagtccaactgggatattagccacctcagagtccaaatccatgccagtgttgggttctgtatccagtgtaacaaaaacagccttgaacaagaaaactctggaggcagaattcaacagcccgtcccccccaacacctgagccaggtgaagggccccgtaaattggaaggatgcacaagttccaaggttacgtttcagcctcccagtagcattggatgcaggaaaaaatacattgacggtgaaaaacaagccgaaccagttgtagttttagatcctgtttctacacatgaaccccaaaccaaagaccaggttgctgaaaaagatccaactcaacacaaggaggatgaaggcgaaattcaaccagaaaacaaagaagacagcattgaaaacgtgagagagacagacagctccaactgctga

SEQ ID NO: 10860 - DNA, 1875 bp, synthetic construct; identical to SEQ ID NO: 9041
  misc_feature 1..1875: note = Synthetic polypeptide
  source 1..1875: mol_type = other DNA

SEQ ID NO: 10861 - DNA, 2701 bp, synthetic construct
  misc_feature 1..2701: note = Synthetic polypeptide
  source 1..2701: mol_type = other DNA
cagggcaatacaatggttaagagcaaggactttggagatatcatcctcattttggatcttgtgtgatctttataattgacttaacctctcaaagccttggtttttatttataaagtggcagtaatcatacactccttttacagttgtgcagattgaaggagatcaacttggaaagtgcttagcataaggcctggcatagatctgttcccagttctccaaaggagtctatgccatctttgggttttatgaacgtaggactgtcaacatgctgacctccttttgtggggccctccacgtctgcttcattacgccgagctttcccgttgatacatccaatcagtttgtccttcagctgcgccctgaactgcaggatgccctcatcagcatcattgaccattacaagtggcagaaatttgtctacatttatgatgccgaccggggcttatccgtcctgcagaaagtcctggatacagctgctgagaagaactggcaggtgacagcagtcaacattttgacaaccacagaggagggataccggatgctctttcaggacctggagaagaaaaaggagcggctggtggtggtggactgtgaatcagaacgcctcaatgctatcttgggccagattataaagctagagaagaatggcatcggctaccactacattcttgcaaatctgggcttcatggacattgacttaaacaaattcaaggagagtggcgccaatgtgacaggtttccagctggtgaactacacagacactattccggccaagatcatgcagcagtggaagaatagtgatgctcgagaccacacacgggtggactggaagagacccaagtacacctctgcgctcacctacgatggggtgaaggtgatggctgaggctttccagagcctgcggaggcagagaattgatatatctcgccgggggaatgctggggattgtctggctaacccagctgttccctggggccaagggatcgacatccagagagctctgcagcaggtgcgatttgaaggtttaacaggaaacgtgcagtttaatgagaaaggacgccggaccaactacacgctccacgtgattgaaatgaaacatgacggcatccgaaagattggttactggaatgaagatgataagtttgtccctgcagccaccgatgcccaagctgggggcgataattcaagtgttcagaacagaacatacatcgtcacaacaatcctagaagatccttatgtgatgctcaagaagaacgccaatcagtttgagggcaatgaccgttacgagggctactgtgtagagctggcggcagagattgccaagcacgtgggctactcctaccgtctggagattgtcagtgatggaaaatacggagcccgagaccctgacacgaaggcctggaatggcatggtgggagagctggtctatggaagagcagatgtggctgtggctcccttaactatcactttggtccgggaagaagttatagatttctccaaaccatttatgagtttggggatctccatcatgattaaaaaaccacagaaatccaagccgggtgtcttctccttccttgatcctttggcttatgagatttggatgtgcattgtttttgcctacattggagtgagtgttgtcctcttcctggtcagccgcttcagtccctatgaatggcacagtgaagagtttgaggaaggacgggaccagacaaccagtgaccagtccaatgagtttgggatattcaacagtttgtggttctccctgggagccttcatgcagcaaggatgtgacatttctcccaggtccctgtctggtcgcatcgttggtggcgtctggtggttcttcaccttaatcatcatctcctcatatacagccaatctggccgccttcctgaccgtggagaggatggtgtctcccattgagagtgcagaggacctagcgaagcagacagaaattgcctacgggacgctggaagcaggatctactaaggagttcttcaggaggtctaaaattgctgtgtttgagaagatgtggacatacatgaagtcagcagagccatcagtttttgtgcggaccacagaggaggggatgattcgagtgaggaaatccaaaggcaaatatgcctacctcctggagtccaccatgaatgagtacattgagcagcggaaaccctgtgacaccatgaaggtgggaggtaacttggattccaaaggctatggcattgcaacacccaaggggtctgccctgagaaatccagtaaacctggcagtgttaaaactgaacgagcaggggcttttggacaaattgaaaaacaaatggtggtacgacaagggcgagtgcggcagcgggggaggtgattccaaggacaagacaagcgctctgagcctcagcaatgtggcaggcgtgttctacatcctgatcggaggacttggactagccatgctggttgccttaatcgagttctgctacaaatcccgtagtgaatccaagcggatgaagggtttttgtttgatcccacagcaatccatcaacgaagccatacggacatcgaccctcccccgcaacagcggggcaggagccagcagcggcggcagtggagagaatggtcgggtggtcagccatgacttccccaagtccatgcaatcgattccttgcatgagccacagttcagggatgcccttgggagccacgggattgtaa

SEQ ID NO: 10862 - DNA, 2701 bp, synthetic construct
  misc_feature 1..2701: note = Synthetic polypeptide
  source 1..2701: mol_type = other DNA
cagggcaatacaatggttaagagcaaggactttggagatatcatcctcattttggatcttgtgtgatctttataattgacttaacctctcaaagccttggtttttatttataaagtggcagtaatcatacactccttttacagttgtgcagattgaaggagatcaacttggaaagtgcttagcataaggcctggcatagatctgttcccagttctccaaaggagtctatgccatctttgggttttatgaacgtaggactgtcaacatgctgacctccttttgtggggccctccacgtctgcttcattacgccgagctttcccgttgatacatccaatcagtttgtccttcagctgcgccctgaactgcaggatgccctcatcagcatcattgaccattacaagtggcagaaatttgtctacatttatgatgccgaccggggcttatccgtcctgcagaaagtcctggatacagctgctgagaagaactggcaggtgacagcagtcaacattttgacaaccacagaggagggataccggatgctctttcaggacctggagaagaaaaaggagcggctggtggtggtggactgtgaatcagaacgcctcaatgctatcttgggccagattataaagctagagaagaatggcatcggctaccactacattcttgcaaatctgggcttcatggacattgacttaaacaaattcaaggagagtggcgccaatgtgacaggtttccagctggtgaactacacagacactattccggccaagatcatgcagcagtggaagaatagtgatgctcgagaccacacacgggtggactggaagagacccaagtacacctctgcgctcacctacgatggggtgaaggtgatggctgaggctttccagagcctgcggaggcagagaattgatatatctcgccgggggaatgctggggattgtctggctaacccagctgttccctggggccaagggatcgacatccagagagctctgcagcaggtgcgatttgaaggtttaacaggaaacgtgcagtttaatgagaaaggacgccggaccaactacacgctccacgtgattgaaatgaaacatgacggcatccgaaagattggttactggaatgaagatgataagtttgtccctgcagccaccgatgcccaagctgggggcgataattcaagtgttcagaacagaacatacatcgtcacaacaatcctagaagatccttatgtgatgctcaagaagaacgccaatcagtttgagggcaatgaccgttacgagggctactgtgtagagctggcggcagagattgccaagcacgtgggctactcctaccgtctggagattgtcagtgatggaaaatacggagcccgagaccctgacacgaaggcctggaatggcatggtgggagagctggtctatggaagagcagatgtggctgtggctcccttaactatcactttggtccgggaagaagttatagatttctccaaaccatttatgagtttggggatctccatcatgattaaaaaaccacagaaatccaagccgggtgtcttctccttccttgatcctttggcttatgagatttggatgtgcattgtttttgcctacattggagtgagtgttgtcctcttcctggtcagccgcttcagtccctatgaatggcacagtgaagagtttgaggaaggacgggaccagacaaccagtgaccagtccaatgagtttgggatattcaacagtttgtggttctccctgggagccttcatgcagcaaggatgtgacatttctcccaggtccctgtctggtcgcatcgttggtggcgtctggtggttcttcaccttaatcatcatctcctcatatacagccaatctggccgccttcctgaccgtggagaggatggtgtctcccattgagagtgcagaggacctagcgaagcagacagaaattgcctacgggacgctggaagcaggatctactaaggagttcttcaggaggtctaaaattgctgtgtttgagaagatgtggacatacatgaagtcagcagagccatcagtttttgtgcggaccacagaggaggggatgattcgagtgaggaaatccaaaggcaaatatgcctacctcctggagtccaccatgaatgagtacattgagcagcggaaaccctgtgacaccatgaaggtgggaggtaacttggattccaaaggctatggcattgcaacacccaaggggtctgccctgagaggtcccgtaaacctagcggttttgaaactcagtgagcaaggcgtcttagacaagctgaaaagcaaatggtggtacgataaaggggaatgtggaagcaaggactccggaagtaaggacaagacaagcgctctgagcctcagcaatgtggcaggcgtgttctacatcctgatcggaggacttggactagccatgctggttgccttaatcgagttctgctacaaatcccgtagtgaatccaagcggatgaagggtttttgtttgatcccacagcaatccatcaacgaagccatacggacatcgaccctcccccgcaacagcggggcaggagccagcagcggcggcagtggagagaatggtcgggtggtcagccatgacttccccaagtccatgcaatcgattccttgcatgagccacagttcagggatgcccttgggagccacgggattgtaa

SEQ ID NO: 10863 - DNA, 6908 bp, synthetic construct
  misc_feature 1..6908: note = Synthetic polypeptide
  source 1..6908: mol_type = other DNA
ctggaaaacaatcaagatgtttatcagagcaggaagagtgaacaaattaaggcacatctcgactgtggagtactctgcagatgggagcactgaatcaaaaaaattggggaaagaaatatccaacatgtaatagcccaaaacaatctcctatcaatattgatgaagatcttacacaagtaaatgtgaatcttaagaaacttaaatttcagggttgggataaaacatcattggaaaacacattcattcataacactgggaaaacagtggaaattaatctcactaatgactaccgtgtcagcggaggagtttcagaaatggtgtttaaagcaagcaagataacttttcactggggaaaatgcaatatgtcatctgatggatcagagcatagtttagaaggacaaaaatttccacttgagatgcaaatctactgctttgatgcggaccgattttcaagttttgaggaagcagtcaaaggaaaagggaagttaagagctttatccattttgtttgaggttgggacagaagaaaatttggatttcaaagcgattattgatggagtcgaaagtgttagtcgttttgggaagcaggctgctttagatccattcatactgttgaaccttctgccaaactcaactgacaagtattacatttacaatggctcattgacatctcctccctgcacagacacagttgactggattgtttttaaagatacagttagcatctctgaaagccagttggctgttttttgtgaagttcttacaatgcaacaatctggttatgtcatgctgatggactacttacaaaacaattttcgagagcaacagtacaagttctctagacaggtgttttcctcatacactggaaaggaagagattcatgaagcagtttgtagttcagaaccagaaaatgttcaggctgacccagagaattataccagccttcttgttacatgggaaagacctcgagtcgtttatgataccatgattgagaagtttgcagttttgtaccagcagttggatggagaggaccaaaccaagcatgaatttttgacagatggctatcaagacttgggtgctattctcaataatttgctacccaatatgagttatgttcttcagatagtagccatatgcactaatggcttatatggaaaatacagcgaccaactgattgtcgacatgcctactgataatcctgaacttgatcttttccctgaattaattggaactgaagaaataatcaaggaggaggaagagggaaaagacattgaagaaggcgctattgtgaatcctggtagagacagtgctacaaaccaaatcaggaaaaaggaaccccagatttctaccacaacacactacaatcgcatagggacgaaatacaatgaagccaagactaaccgatccccaacaagaggaagtgaattctctggaaagggtgatgttcccaatacatctttaaattccacttcccaaccagtcactaaattagccacagaaaaagatatttccttgacttctcagactgtgactgaactgccacctcacactgtggaaggtacttcagcctctttaaatgatggctctaaaactgttcttagatctccacatatgaacttgtcggggactgcagaatccttaaatacagtttctataacagaatatgaggaggagagtttattgaccagtttcaagcttgatactggagctgaagattcttcaggctccagtcccgcaacttctgctatcccattcatctctgagaacatatcccaagggtatatattttcctccgaaaacccagagacaataacatatgatgtccttataccagaatctgctagaaatgcttccgaagattcaacttcatcaggttcagaagaatcactaaaggatccttctatggagggaaatgtgtggtttcctagctctacagacataacagcacagcccgatgttggatcaggcagagagagctttctccagactaattacactgagatacgtgttgatgaatctgagaagacaaccaagtccttttctgcaggcccagtgatgtcacagggtccctcagttacagatctggaaatgccacattattctacctttgcctacttcccaactgaggtaacacctcatgcttttaccccatcctccagacaacaggatttggtctccacggtcaacgtggtatactcgcagacaacccaaccggtatacaatggtgagacacctcttcaaccttcctacagtagtgaagtctttcctctagtcacccctttgttgcttgacaatcagatcctcaacactacccctgctgcttcaagtagtgattcggccttgcatgctacgcctgtatttcccagtgtcgatgtgtcatttgaatccatcctgtcttcctatgatggtgcacctttgcttccattttcctctgcttccttcagtagtgaattgtttcgccatctgcatacagtttctcaaatccttccacaagttacttcagctaccgagagtgataaggtgcccttgcatgcttctctgccagtggctgggggtgatttgctattagagcccagccttgctcagtattctgatgtgctgtccactactcatgctgcttcagagacgctggaatttggtagtgaatctggtgttctttataaaacgcttatgttttctcaagttgaaccacccagcagtgatgccatgatgcatgcacgttcttcagggcctgaaccttcttatgccttgtctgataatgagggctcccaacacatcttcactgtttcttacagttctgcaatacctgtgcatgattctgtgggtgtaacttatcagggttccttatttagcggccctagccatataccaatacctaagtcttcgttaataaccccaactgcatcattactgcagcctactcatgccctctctggtgatggggaatggtctggagcctcttctgatagtgaatttcttttacctgacacagatgggctgacagcccttaacatttcttcacctgtttctgtagctgaatttacatatacaacatctgtgtttggtgatgataataaggcgctttctaaaagtgaaataatatatggaaatgagactgaactgcaaattccttctttcaatgagatggtttacccttctgaaagcacagtcatgcccaacatgtatgataatgtaaataagttgaatgcgtctttacaagaaacctctgtttccatttctagcaccaagggcatgtttccagggtcccttgctcataccaccactaaggtttttgatcatgagattagtcaagttccagaaaataacttttcagttcaacctacacatactgtctctcaagcatctggtgacacttcgcttaaacctgtgcttagtgcaaactcagagccagcatcctctgaccctgcttctagtgaaatgttatctccttcaactcagctcttattttatgagacctcagcttcttttagtactgaagtattgctacaaccttcctttcaggcttctgatgttgacaccttgcttaaaactgttcttccagctgtgcccagtgatccaatattggttgaaacccccaaagttgataaaattagttctacaatgttgcatctcattgtatcaaattctgcttcaagtgaaaacatgctgcactctacatctgtaccagtttttgatgtgtcgcctacttctcatatgcactctgcttcacttcaaggtttgaccatttcctatgcaagtgagaaatatgaaccagttttgttaaaaagtgaaagttcccaccaagtggtaccttctttgtacagtaatgatgagttgttccaaacggccaatttggagattaaccaggcccatcccccaaaaggaaggcatgtatttgctacacctgttttatcaattgatgaaccattaaatacactaataaataagcttatacattccgatgaaattttaacctccaccaaaagttctgttactggtaaggtatttgctggtattccaacagttgcttctgatacatttgtatctactgatcattctgttcctataggaaatgggcatgttgccattacagctgtttctccccacagagatggttctgtaacctcaacaaagttgctgtttccttctaaggcaacttctgagctgagtcatagtgccaaatctgatgccggtttagtgggtggtggtgaagatggtgacactgatgatgatggtgatgatgatgatgatgacagaggtagtgatggcttatccattcataagtgtatgtcatgctcatcctatagagaatcacaggaaaaggtaatgaatgattcagacacccacgaaaacagtcttatggatcagaataatccaatctcatactcactatctgagaattctgaagaagataatagagtcacaagtgtatcctcagacagtcaaactggtatggacagaagtcctggtaaatcaccatcagcaaatgggctatcccaaaagcacaatgatggaaaagaggaaaatgacattcagactggtagtgctctgcttcctctcagccctgaatctaaagcatgggcagttctgacaagtgatgaagaaagtggatcagggcaaggtacctcagatagccttaatgagaatgagacttccacagatttcagttttgcagacactaatgaaaaagatgctgatgggatcctggcagcaggtgactcagaaataactcctggattcccacagtccccaacatcatctgttactagcgagaactcagaagtgttccacgtttcagaggcagaggccagtaatagtagccatgagtctcgtattggtctagctgaggggttggaatccgagaagaaggcagttataccccttgtgatcgtgtcagccctgacttttatctgtctagtggttcttgtgggtattctcatctactggaggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgagacactgaaagagttttaccaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaa

SEQ ID NO: 10864 - DNA, 4307 bp, synthetic construct
  misc_feature 1..4307: note = Synthetic polypeptide
  source 1..4307: mol_type = other DNA
ctggaaaacaatcaagatgtttatcagagcaggaagagtgaacaaattaaggcacatctcgactgtggagtactctgcagatgggagcactgaatcaaaaaaattggggaaagaaatatccaacatgtaatagcccaaaacaatctcctatcaatattgatgaagatcttacacaagtaaatgtgaatcttaagaaacttaaatttcagggttgggataaaacatcattggaaaacacattcattcataacactgggaaaacagtggaaattaatctcactaatgactaccgtgtcagcggaggagtttcagaaatggtgtttaaagcaagcaagataacttttcactggggaaaatgcaatatgtcatctgatggatcagagcatagtttagaaggacaaaaatttccacttgagatgcaaatctactgctttgatgcggaccgattttcaagttttgaggaagcagtcaaaggaaaagggaagttaagagctttatccattttgtttgaggttgggacagaagaaaatttggatttcaaagcgattattgatggagtcgaaagtgttagtcgttttgggaagcaggctgctttagatccattcatactgttgaaccttctgccaaactcaactgacaagtattacatttacaatggctcattgacatctcctccctgcacagacacagttgactggattgtttttaaagatacagttagcatctctgaaagccagttggctgttttttgtgaagttcttacaatgcaacaatctggttatgtcatgctgatggactacttacaaaacaattttcgagagcaacagtacaagttctctagacaggtgttttcctcatacactggaaaggaagagattcatgaagcagtttgtagttcagaaccagaaaatgttcaggctgacccagagaattataccagccttcttgttacatgggaaagacctcgagtcgtttatgataccatgattgagaagtttgcagttttgtaccagcagttggatggagaggaccaaaccaagcatgaatttttgacagatggctatcaagacttgggtgctattctcaataatttgctacccaatatgagttatgttcttcagatagtagccatatgcactaatggcttatatggaaaatacagcgaccaactgattgtcgacatgcctactgataatcctgaacttgatcttttccctgaattaattggaactgaagaaataatcaaggaggaggaagagggaaaagacattgaagaaggcgctattgtgaatcctggtagagacagtgctacaaaccaaatcaggaaaaaggaaccccagatttctaccacaacacactacaatcgcatagggacgaaatacaatgaagccaagactaaccgatccccaacaagaggaagtgaattctctggaaagggtgatgttcccaatacatctttaaattccacttcccaaccagtcactaaattagccacagaaaaagatatttccttgacttctcagactgtgactgaactgccacctcacactgtggaaggtacttcagcctctttaaatgatggctctaaaactgttcttagatctccacatatgaacttgtcggggactgcagaatccttaaatacagtttctataacagaatatgaggaggagagtttattgaccagtttcaagcttgatactggagctgaagattcttcaggctccagtcccgcaacttctgctatcccattcatctctgagaacatatcccaagggtatatattttcctccgaaaacccagagacaataacatatgatgtccttataccagaatctgctagaaatgcttccgaagattcaacttcatcaggttcagaagaatcactaaaggatccttctatggagggaaatgtgtggtttcctagctctacagacataacagcacagcccgatgttggatcaggcagagagagctttctccagactaattacactgagatacgtgttgatgaatctgagaagacaaccaagtccttttctgcaggcccagtgatgtcacagggtccctcagttacagatctggaaatgccacattattctacctttgcctacttcccaactgaggtaacacctcatgcttttaccccatcctccagacaacaggatttggtctccacggtcaacgtggtatactcgcagacaacccaaccggtatacaatgaggccagtaatagtagccatgagtctcgtattggtctagctgaggggttggaatccgagaagaaggcagttataccccttgtgatcgtgtcagccctgacttttatctgtctagtggttcttgtgggtattctcatctactggaggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaa

SEQ ID NO: 10865 - DNA, 3500 bp, synthetic construct
  misc_feature 1..3500: note = Synthetic polypeptide
  source 1..3500: mol_type = other DNA
tccaccccaacaagaggccagctggagagcaagcaaacatcgagtgcagcaggagactataagggacggtgccttcagagccccccagtgcctgtgcctcagacccgtgcgctccagggaccgagtgccaggctaccgagagtggtggctatacctgtgggcccatggagccccggggctgtgccacccagccatgccaccacggcgctctgtgtgtgccccagggtccagatcccaccggcttccgctgctactgcgtgccgggtttccagggcccacgctgcgagctggacatcgatgagtgtgcatcccggccgtgccaccatggggccacctgccgcaacctggccgatcgctacgagtgccattgcccccttggctatgcaggcgtgacctgcgagatggaggtggacgagtgcgcctcagcgccctgcctgcacgggggctcgtgcctggacggcgtgggctccttccgctgtgtgtgcgcgccaggctacgggggcacccgttgccagctggacctcgacgagtgccagagccagccgtgcgcacatgggggcacgtgccacgacctggtcaacgggttccggtgcgactgcgcgggcaccggctacgagggcacgcactgcgagcgggaggtgctggagtgcgcatcggcgccctgcgagcacaacgcgtcctgcctcgagggcctcgggagcttccgctgcctctgttggccaggctacagcggcgagctgtgcgaggtggacgaggacgagtgtgcatcgagcccctgccagcatgggggccgatgcctgcagcgctctgacccggccctctacgggggtgtccaggccgccttccctggcgccttcagcttccgccatgctgcgggtttcctgtgccactgccctcctggctttgagggagccgactgcggtgtggaggtggacgagtgtgcctcacggccatgcctcaacggaggccactgccaggacctgcccaatggcttccagtgtcactgcccagatggctacgcagggccgacatgtgaggaagatgtggatgaatgcctgtcggatccctgcctgcacggcggaacctgcagtgacactgtggcaggctatatctgcaggtgcccagagacctggggtgggcgcgactgttctgtgcagctcactggctgccagggccacacctgcccgctggctgccacctgcatccctatcttcgagtctggggtccacagttacgtctgccactgcccacctggtacccatggaccgttctgtggccagaataccaccttctctgtgatggctgggagccccattcaggcatcagtgccagctggtggccccctgggtctggcactgaggtttcgcaccacactgcccgctgggaccttggccactcgcaatgacaccaaggaaagcttggagctggcattggtggcagccacacttcaggccacactctggagctacagcaccactgtgcttgtcctgagactgccggacctggccctaaacgatggccattggcaccaggtggaggttgtgctccatctagcgaccctggagctacggctctggcatgagggctgccctgcccggctctgtgtggcctctggtcctgtggccctggcttccacggcttcggcaactccgctgcctgccgggatctcctctgcccagctgggggacgcgacctttgcaggctgcctccaggacgtgcgtgtggatggccacctcctgctgcctgaggatctcggtgagaacgtcctcctgggctgtgagcgccgagagcagtgccggcctctgccttgtgtccacggagggtcctgtgtggatctgtggactcatttccgttgcgactgtgcccggccccatagaggtcccacgtgcgctgatgagattcctgctgccacctttggcttgggaggcgccccaagctctgcctcctttctgctccaagagctgccaggtcccaacctcacagtgtctttccttctccgcactcgggagtccgctggcctgttgctccagtttgccaatgactccgcagctggcctaacagtattcctgagtgagggtcggatccgggctgaggtgccgggcagtcctgctgtagtgctccctgggcgctgggatgatgggctccgtcacctggtgatgctcagcttcgggcctgaccagctgcaggacctggggcagcacgtgcacgtgggtgggaggctccttgctgccgacagccagccctggggtgggcccttccgaggctgcctccaggacctgcgactcgatggctgccacctccccttctttcctctgccactggataactcaagccagcccagcgagctcggcggcaggcagtcctggaacctcactgcgggctgcgtctccgaggacatgtgcagtcctgacccctgtttcaatggtgggacttgcctcgtcacctggaatgacttccactgtacctgccctgccaatttcacggggcctacgtgtgcccagcagctgtggtgtcccggccagccctgtctcccacctgccacgtgtgaggaggtccctgatggctttgtgtgtgtggcggaggccacgttccgcgagggtccccccgccgcgttcagcgggcacaacgcgtcgtcagggcgcttgctcggcggcctgtcgctggcctttcgcacgcgcgactccgaggcctggctgctgcgtgccgcggcgggcgccctggaaggcgtgtggctggcggtgcgcaatggctcgctggcggggggcgtgcgcggaggccatggcctgcccggcgctgtgctgcccataccggggccgcgcgtggccgatggtgcctggcaccgcgtgcgtctggccatggagcgcccggcggccaccacctcgcgctggctgctgtggctggatggtgccgccaccccggtggcgctgcgcggcctggccagtgacctgggcttcctgcagggcccgggtgctgtgcgcatcctgctggctgagaacttcaccggctgcttgggccgcgtggcgctgggcggcctgcccctgcccttggcgcggccccggcccggcgcggcccctggcgcccgagagcacttcgcgtcttggcctgggacgccggccccgatcctcggctgccgcggcgcgcccgtgtgtgcgccctcgccctgtctgcacgacggtgcctgccgtgacctcttcgacgcctttgcctgcgcctgcggcccggggtgggaaggcccgcgctgcgaagcccacgtcgacccctgtcactccgccccctgcgcccgtggccgctgtcacacgcaccccgacggccgcttcgagtgccgctgcccgcctggcttcgggggcccgcgctgcaggtgggatggctgggcaggggggtgggctgcgaatgccccctggggctatggtggggcagagaagtctgccaggtctgtggatgagtcgcttcccttccctggtcctcatgtccttatctgtgacatgaggaggacagtttaa

SEQ ID NO: 10866 - DNA, 3827 bp, synthetic construct
  misc_feature 1..3827: note = Synthetic polypeptide
  source 1..3827: mol_type = other DNA
tccaccccaacaagaggccagctggagagcaagcaaacatcgagtgcagcaggagactataagggacggtgccttcagagccccccagtgcctgtgcctcagacccgtgcgctccagggaccgagtgccaggctaccgagagtggtggctatacctgtgggcccatggagccccggggctgtgccacccagccatgccaccacggcgctctgtgtgtgccccagggtccagatcccaccggcttccgctgctactgcgtgccgggtttccagggcccacgctgcgagctggacatcgatgagtgtgcatcccggccgtgccaccatggggccacctgccgcaacctggccgatcgctacgagtgccattgcccccttggctatgcaggcgtgacctgcgagatggaggtggacgagtgcgcctcagcgccctgcctgcacgggggctcgtgcctggacggcgtgggctccttccgctgtgtgtgcgcgccaggctacgggggcacccgttgccagctggacctcgacgagtgccagagccagccgtgcgcacatgggggcacgtgccacgacctggtcaacgggttccggtgcgactgcgcgggcaccggctacgagggcacgcactgcgagcgggaggtgctggagtgcgcatcggcgccctgcgagcacaacgcgtcctgcctcgagggcctcgggagcttccgctgcctctgttggccaggctacagcggcgagctgtgcgaggtggacgaggacgagtgtgcatcgagcccctgccagcatgggggccgatgcctgcagcgctctgacccggccctctacgggggtgtccaggccgccttccctggcgccttcagcttccgccatgctgcgggtttcctgtgccactgccctcctggctttgagggagccgactgcggtgtggaggtggacgagtgtgcctcacggccatgcctcaacggaggccactgccaggacctgcccaatggcttccagtgtcactgcccagatggctacgcagggccgacatgtgaggaagatgtggatgaatgcctgtcggatccctgcctgcacggcggaacctgcagtgacactgtggcaggctatatctgcaggtgcccagagacctggggtgggcgcgactgttctgtgcagctcactggctgccagggccacacctgcccgctggctgccacctgcatccctatcttcgagtctggggtccacagttacgtctgccactgcccacctggtacccatggaccgttctgtggccagaataccaccttctctgtgatggctgggagccccattcaggcatcagtgccagctggtggccccctgggtctggcactgaggtttcgcaccacactgcccgctgggaccttggccactcgcaatgacaccaaggaaagcttggagctggcattggtggcagccacacttcaggccacactctggagctacagcaccactgtgcttgtcctgagactgccggacctggccctaaacgatggccattggcaccaggtggaggttgtgctccatctagcgaccctggagctacggctctggcatgagggctgccctgcccggctctgtgtggcctctggtcctgtggccctggcttccacggcttcggcaactccgctgcctgccgggatctcctctgcccagctgggggacgcgacctttgcaggctgcctccaggacgtgcgtgtggatggccacctcctgctgcctgaggatctcggtgagaacgtcctcctgggctgtgagcgccgagagcagtgccggcctctgccttgtgtccacggagggtcctgtgtggatctgtggactcatttccgttgcgactgtgcccggccccatagaggtcccacgtgcgctgatgagattcctgctgccacctttggcttgggaggcgccccaagctctgcctcctttctgctccaagagctgccaggtcccaacctcacagtgtctttccttctccgcactcgggagtccgctggcctgttgctccagtttgccaatgactccgcagctggcctaacagtattcctgagtgagggtcggatccgggctgaggtgccgggcagtcctgctgtagtgctccctgggcgctgggatgatgggctccgtcacctggtgatgctcagcttcgggcctgaccagctgcaggacctggggcagcacgtgcacgtgggtgggaggctccttgctgccgacagccagccctggggtgggcccttccgaggctgcctccaggacctgcgactcgatggctgccacctccccttctttcctctgccactggataactcaagccagcccagcgagctcggcggcaggcagtcctggaacctcactgcgggctgcgtctccgaggacatgtgcagtcctgacccctgtttcaatggtgggacttgcctcgtcacctggaatgacttccactgtacctgccctgccaatttcacggggcctacgtgtgcccagcagctgtggtgtcccggccagccctgtctcccacctgccacgtgtgaggaggtccctgatggctttgtgtgtgtggcggaggccacgttccgcgagggtccccccgccgcgttcagcgggcacaacgcgtcgtcagggcgcttgctcggcggcctgtcgctggcctttcgcacgcgcgactccgaggcctggctgctgcgtgccgcggcgggcgccctggaaggcgtgtggctggcggtgcgcaatggctcgctggcggggggcgtgcgcggaggccatggcctgcccggcgctgtgctgcccataccggggccgcgcgtggccgatggtgcctggcaccgcgtgcgtctggccatggagcgcccggcggccaccacctcgcgctggctgctgtggctggatggtgccgccaccccggtggcgctgcgcggcctggccagtgacctgggcttcctgcagggcccgggtgctgtgcgcatcctgctggctgagaacttcaccggctgcttgggccgcgtggcgctgggcggcctgcccctgcccttggcgcggccccggcccggcgcggcccctggcgcccgagagcacttcgcgtcttggcctgggacgccggccccgatcctcggctgccgcggcgcgcccgtgtgtgcgccctcgccctgtctgcacgacggtgcctgccgtgacctcttcgacgcctttgcctgcgcctgcggcccggggtgggaaggcccgcgctgcgaagcccacgtcgacccctgtcactccgccccctgcgcccgtggccgctgtcacacgcaccccgacggccgcttcgagtgccgctgcccgcctggcttcgggggcccgcgctgcaggttgcctgtcccatccaaggagtgcagcctgaatgtcacctgcctcgatggcagcccatgtgagggtggctctcccgctgccaactgcagctgcctggagggtcttgctggccagaggtgtcaggtccccactctcccctgtgaagccaacccctgcttgaatgggggcacctgccgggcagctggaggggtgtctgaatgtatctgcaatgccagattctccggccagttctgtgaagtggcgaagggcctgcccctgccgctgccattcccactgctggaggtggccgtacctgcagcctgtgcctgcctcctcctcctcctcctgggcctcctttcagggatcctggcagcccgaaagcgccgccagtctgagggcacctacagcccaagccagcaggaggtggctggggcccggctggagatggacagtgtcctcaaggtgccaccggaggagagactcatctag

SEQ ID NO: 10867 - DNA, 977 bp, synthetic construct; identical to SEQ ID NO: 7082
  misc_feature 1..977: note = Synthetic polypeptide
  source 1..977: mol_type = other DNA

SEQ ID NO: 10868 - DNA, 1592 bp, synthetic construct; identical to SEQ ID NO: 7083
  misc_feature 1..1592: note = Synthetic polypeptide
  source 1..1592: mol_type = other DNA

SEQ ID NO: 10869 - DNA, 3052 bp, synthetic construct
  misc_feature 1..3052: note = Synthetic polypeptide
  source 1..3052: mol_type = other DNA
actgaaggaaaagtaccaagagcagaatgctgcatatccagccaaaggaaagctgatgtggcaaaaatgatgctgtcaaggccgaaaaaggcaagaaaaaaaaacaaagcggagaaagacagagaagtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacaggcaaaggccaggatggaattggtagcaaggcagagaagactctgggtgactttgcagcagagtatgccaagtccaacagaagtacgtgcaaggggtgtatggagaagatagaaaagggccaggtgcgcctgtccaagaagatggtggacccggagaagccacagctaggcatgattgaccgctggtaccatccaggctgctttgtcaagaacagggaggagctgggtttccggcccgagtacagtgcgagtcagctcaagggcttcagcctccttgctacagaggataaagaagccctgaagaagcagctcccaggagtcaagagtgaaggaaagagaaaaggcgatgaggtggatggagtggatgaagtggcgaagaagaaatctaaaaaagaaaaagacaaggatagtaagcttgaaaaagccctaaaggctcagaacgacctgatctggaacatcaaggacgagctaaagaaagtgtgttcaactaatgacctgaaggagctactcatcttcaacaagcagcaagtgccttctggggagtcggcgatcttggaccgagtagctgatggcatggtgttcggtgccctccttccctgcgaggaatgctcgggtcagctggtcttcaagagcgatgcctattactgcactggggacgtcactgcctggaccaagtgtatggtcaagacacagacacccaaccggaaggagtgggtaaccccaaaggaattccgagaaatctcttacctcaagaaattgaaggttaaaaaacaggaccgtatattccccccagaaaccagcgcctccgtggcggccacgcctccgccctccacagcctcggctcctgctgctgtgaactcctctgcttcagcagataagccattatccaacatgaagatcctgactctcgggaagctgtcccggaacaaggatgaagtgaaggccatgattgagaaactcggggggaagttgacggggacggccaacaaggcttccctgtgcatcagcaccaaaaaggaggtggaaaagatgaataagaagatggaggaagtaaaggaagccaacatccgagttgtgtctgaggacttcctccaggacgtctccgcctccaccaagagccttcaggagttgttcttagcgcacatcttgtccccttggggggcagaggtgaaggcagagcctgttgaagttgtggccccaagagggaagtcaggggctgcgctctccaaaaaaagcaagggccaggtcaaggaggaaggtatcaacaaatctgaaaagagaatgaaattaactcttaaaggaggagcagctgtggatcctgattctggactggaacactctgcgcatgtcctggagaaaggtgggaaggtcttcagtgccacccttggcctggtggacatcgttaaaggaaccaactcctactacaagctgcagcttctggaggacgacaaggaaaacaggtattggatattcaggtcctggggccgtgtgggtacggtgatcggtagcaacaaactggaacagatgccgtccaaggaggatgccattgagcacttcatgaaattatatgaagaaaaaaccgggaacgcttggcactccaaaaatttcacgaagtatcccaaaaagttctaccccctggagattgactatggccaggatgaagaggcagtgaagaagctgacagtaaatcctggcaccaagtccaagctccccaagccagttcaggacctcatcaagatgatctttgatgtggaaagtatgaagaaagccatggtggagtatgagatcgaccttcagaagatgcccttggggaagctgagcaaaaggcagatccaggccgcatactccatcctcagtgaggtccagcaggcggtgtctcagggcagcagcgactctcagatcctggatctctcaaatcgcttttacaccctgatcccccacgactttgggatgaagaagcctccgctcctgaacaatgcagacagtgtgcaggccaaggtggaaatgcttgacaacctgctggacatcgaggtggcctacagtctgctcaggggagggtctgatgatagcagcaaggatcccatcgatgtcaactatgagaagctcaaaactgacattaaggtggttgacagagattctgaagaagccgagatcatcaggaagtatgttaagaacactcatgcaaccacacacaatgcgtatgacttggaagtcatcgatatctttaagatagagcgtgaaggcgaatgccagcgttacaagccctttaagcagcttcataaccgaagattgctgtggcacgggtccaggaccaccaactttgctgggatcctgtcccagggtcttcggatagccccgcctgaagcgcccgtgacaggctacatgtttggtaaagggatctatttcgctgacatggtctccaagagtgccaactactgccatacgtctcagggagacccaataggcttaatcctgttgggagaagttgcccttggaaacatgtatgaactgaagcacgcttcacatatcagcaagttacccaagggcaagcacagtgtcaaaggtttgggcaaaactacccctgatccttcagctaacattagtctggatggtgtagacgttcctcttgggaccgggatttcatctggtgtgaatgacacctctctactatataacgagtacattgtctatgatattgctcaggtaaatctgaagtatctgctgaaactgaaattcaattttaagacctccctgtggtaa

SEQ ID NO: 10870 - DNA, 334 bp, synthetic construct
  misc_feature 1..334: note = Synthetic polypeptide
  source 1..334: mol_type = other DNA
actgaaggaaaagtaccaagagcagaatgctgcatatccagccaaaggaaagctgatgtggcaaaaatgatgctgtcaaggccgaaaaaggcaagaaaaaaaaacaaagcggagaaagacagagaagtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacagaacctccaataccatgtggaatagaagtgatgggaagatag

SEQ ID NO: 10871 - DNA, 475 bp, synthetic construct
  misc_feature 1..475: note = Synthetic polypeptide
  source 1..475: mol_type = other DNA
actgaaggaaaagtaccaagagcagaatgctgcatatccagccaaaggaaagctgatgtggcaaaaatgatgctgtcaaggccgaaaaaggcaagaaaaaaaaacaaagcggagaaagacagagaagtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacaggtgtgtacatactggggcagcatgggcattcagcccccaccctgaagctcccaggagggcctcgtctcagagagcaaagcaaacctcccccagcttgccctctcccacatgtgcagatcaagcgtatggtgcccatgttatttcagcaacacctcctggactcagcatcatctgttgcatga

SEQ ID NO: 10872 - DNA, 500 bp, synthetic construct
  misc_feature 1..500: note = Synthetic polypeptide
  source 1..500: mol_type = other DNA
agccagaaggtggaaacaacccagaagtccccggaagggtgaatggatgagcagaaagcaatccgcgcatacggtgccgtggatgtcgttcagcctaacggtggaaggtggaaggggattctgacgggggccgcagcacggggcgcctggagggcactgcggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctga

SEQ ID NO: 10873 - DNA, 530 bp, synthetic construct
  misc_feature 1..530: note = Synthetic polypeptide
  source 1..530: mol_type = other DNA
agccagaaggtggaaacaacccagaagtccccggaagggtgaatggatgagcagaaagcaatccgcgcatacggtgccgtggatgtcgttcagcctaacggtggaaggtggaaggggattctgacgggggccgcagcacggggcgcctggagggcactgcggactcacaccacccggcaagaactgctcactacggctccctgccccagaagtcacacggccggacccaagatgaaaaccccgtagtccacttcttcaagaacatttgcagcccacggttctctgtgtctttccaggtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctga

SEQ ID NO: 10874 - DNA, 467 bp, synthetic construct
  misc_feature 1..467: note = Synthetic polypeptide
  source 1..467: mol_type = other DNA
agccagaaggtggaaacaacccagaagtccccggaagggtgaatggatgagcagaaagcaatccgcgcatacggtgccgtggatgtcgttcagcctaacggtggaaggtggaaggggattctgacgggggccgcagcacggggcgcctggagggcactgcggactcacaccacccggcaagaactgctcactacggctccctgccccagaagtcacacggccggacccaagatgaaaaccccgtagtccacttcttcaagaacattgtgacgcctcgcacaccacccccgtcgcagggaaagggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctga

SEQ ID NO: 10875 - DNA, 311 bp, synthetic construct
  misc_feature 1..311: note = Synthetic polypeptide
  source 1..311: mol_type = other DNA
agccagaaggtggaaacaacccagaagtccccggaagggtgaatggatgagcagaaagcaatccgcgcatacggtgccgtggatgtcgttcagcctaacggtggaaggtggaaggggattctgacgggggccgcagcacggggcgcctggagggcactgcggactcacaccacccggcaagaactgctcactacggctccctgccccagaagcacacagctgcagagacagagaggacgtgggcggcagagaggactgttgacatccaagcttcctttgtttttttttcctgtccttctctcacctcctaa

SEQ ID NO: 10876 - DNA, 695 bp, synthetic construct
  misc_feature 1..695: note = Synthetic polypeptide
  source 1..695: mol_type = other DNA
agccagaaggtggaaacaacccagaagtccccggaagggtgaatggatgagcagaaagcaatccgcgcatacggtgccgtggatgtcgttcagcctaacggtggaaggtggaaggggattctgacgggggccgcagcacggggcgcctggagggcactgcggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctgggtaggtgacgaacgcacttccatcggcttcctcttccgtcccagtcctcacagccccgcaacttttgtgttctgctctgtttcggttgcttcctggcctccttttctctcctctcgagacctctctgcccacagctgggatcgggccgccttgtcttccactggggaaatgaaacgtggtcttcccttccggaagggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctga

SEQ ID NO: 10877 - DNA, 246 bp, synthetic construct
  misc_feature 1..246: note = Synthetic polypeptide
  source 1..246: mol_type = other DNA
agccagaaggtggaaacaacccagaagtccccggaagggtgaatggatgagcagaaagcaatccgcgcatacggtgccgtggatgtcgttcagcctaacggtggaaggtggaaggggattctgacgggggccgcagcacggggcgcctggagggcactgcggactcacaccacccggcaagaactgctcactacggctccctgccccagaagtcacacggccggacccaagatgaaaaccccgtag

SEQ ID NO: 10878 - DNA, 347 bp, synthetic construct
  misc_feature 1..347: note = Synthetic polypeptide
  source 1..347: mol_type = other DNA
agccagaaggtggaaacaacccagaagtccccggaagggtgaatggatgagcagaaagcaatccgcgcatacggtgccgtggatgtcgttcagcctaacggtggaaggtggaaggggattctgacgggggccgcagcacggggcgcctggagggcactgcggactcacaccacccggcaagaactgctcactacggctccctgccccagaagtcacacggccggacccaagatgaaaaccccgtagtccacttcttcaagaacattgtgacgcctcgcacaccacccccgtcgcagggaaagggaggaagagatagtcgctctggatcacccatggctagacgctga

SEQ ID NO: 10879 - DNA, 458 bp, synthetic construct
  misc_feature 1..458: note = Synthetic polypeptide
  source 1..458: mol_type = other DNA
agccagaaggtggaaacaacccagaagtccccggaagggtgaatggatgagcagaaagcaatccgcgcatacggtgccgtggatgtcgttcagcctaacggtggaaggtggaaggggattctgacgggggccgcagcacggggcgcctggagggcactgcggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgtag

SEQ ID NO: 10880 - DNA, 456 bp, synthetic construct
  misc_feature 1..456: note = Synthetic polypeptide
  source 1..456: mol_type = other DNA
agccagaaggtggaaacaacccagaagtccccggaagggtgaatggatgagcagaaagcaatccgcgcatacggtgccgtggatgtcgttcagcctaacggtggaaggtggaaggggattctgacgggggccgcagcacggggcgcctggagggcactgcggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgg

SEQ ID NO: 10881 - DNA, 281 bp, synthetic construct
  misc_feature 1..281: note = Synthetic polypeptide
  source 1..281: mol_type = other DNA
agccagaaggtggaaacaacccagaagtccccggaagggtgaatggatgagcagaaagcaatccgcgcatacggtgccgtggatgtcgttcagcctaacggtggaaggtggaaggggattctgacgggggccgcagcacggggcgcctggagggcactgcggactcacaccacccggcaagaactgctcactacggctccctgccccagaagtcacacggccggacccaagatgaaaaccccgtagtccacttcttcaagaacattgcaggagcccgttag

SEQ ID NO: 10882 - DNA, 311 bp, synthetic construct
  misc_feature 1..311: note = Synthetic polypeptide
  source 1..311: mol_type = other DNA
agccagaaggtggaaacaacccagaagtccccggaagggtgaatggatgagcagaaagcaatccgcgcatacggtgccgtggatgtcgttcagcctaacggtggaaggtggaaggggattctgacgggggccgcagcacggggcgcctggagggcactgcggactcacaccacccggcaagaactgctcactacggctccctgccccagaagtcacacggccggacccaagatgaaaaccccgtagtccacttcttcaagaacattgacagaagtggggaggctgggcacccgggtgcttctggcagctga

SEQ ID NO: 10883 - DNA, 420 bp, synthetic construct
  misc_feature 1..420: note = Synthetic polypeptide
  source 1..420: mol_type = other DNA
agccagaaggtggaaacaacccagaagtccccggaagggtgaatggatgagcagaaagcaatccgcgcatacggtgccgtggatgtcgttcagcctaacggtggaaggtggaaggggattctgacgggggccgcagcacggggcgcctggagggcactgcggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctgggtaggtgacgaacgcacttccatcggcttcctcttccgtcccagtcctcacagccccgcaacttttgtgttctgctctgtttcgg

SEQ ID NO: 10884 - DNA, 344 bp, synthetic construct
  misc_feature 1..344: note = Synthetic polypeptide
  source 1..344: mol_type = other DNA
agccagaaggtggaaacaacccagaagtccccggaagggtgaatggatgagcagaaagcaatccgcgcatacggtgccgtggatgtcgttcagcctaacggtggaaggtggaaggggattctgacgggggccgcagcacggggcgcctggagggcactgcggactcacaccacccggcaagaactgctcactacggctccctgccccagaagtcacacggccggacccaagatgaaaaccccgtagtccacttcttcaagaacattgtctatacttcttcaccaactaggacagaagtggggaggctgggcacccgggtgcttctggcagctgatggatgctag

SEQ ID NO: 10885 - DNA, 243 bp, synthetic construct
  misc_feature 1..243: note = Synthetic polypeptide
  source 1..243: mol_type = other DNA
agccagaaggtggaaacaacccagaagtccccggaagggtgaatggatgagcagaaagcaatccgcgcatacggtgccgtggatgtcgttcagcctaacggtggaaggtggaaggggattctgacgggggccgcagcacggggcgcctggagggcactgcggactcacaccacccggcaagaactgctcactacggctccctgccccagaagtcacacggccggacccaagatgaaaaccccg

SEQ ID NO: 10886 - DNA, 2641 bp, synthetic construct
  misc_feature 1..2641: note = Synthetic polypeptide
  source 1..2641: mol_type = other DNA
atggggattatttccaaaccagcagtcacaggaacatgctgcttttagatttgctttgtcgcaactcacagagcccccgaagctgctcccccagattgatattgtgaacatcagcgacagctttgagatgacctatagattctgttcccagttctccaaaggagtctatgccatctttgggttttatgaacgtaggactgtcaacatgctgacctccttttgtggggccctccacgtctgcttcattacgccgagctttcccgttgatacatccaatcagtttgtccttcagctgcgccctgaactgcaggatgccctcatcagcatcattgaccattacaagtggcagaaatttgtctacatttatgatgccgaccggggcttatccgtcctgcagaaagtcctggatacagctgctgagaagaactggcaggtgacagcagtcaacattttgacaaccacagaggagggataccggatgctctttcaggacctggagaagaaaaaggagcggctggtggtggtggactgtgaatcagaacgcctcaatgctatcttgggccagattataaagctagagaagaatggcatcggctaccactacattcttgcaaatctgggcttcatggacattgacttaaacaaattcaaggagagtggcgccaatgtgacaggtttccagctggtgaactacacagacactattccggccaagatcatgcagcagtggaagaatagtgatgctcgagaccacacacgggtggactggaagagacccaagtacacctctgcgctcacctacgatggggtgaaggtgatggctgaggctttccagagcctgcggaggcagagaattgatatatctcgccgggggaatgctggggattgtctggctaacccagctgttccctggggccaagggatcgacatccagagagctctgcagcaggtgcgatttgaaggtttaacaggaaacgtgcagtttaatgagaaaggacgccggaccaactacacgctccacgtgattgaaatgaaacatgacggcatccgaaagattggttactggaatgaagatgataagtttgtccctgcagccaccgatgcccaagctgggggcgataattcaagtgttcagaacagaacatacatcgtcacaacaatcctagaagatccttatgtgatgctcaagaagaacgccaatcagtttgagggcaatgaccgttacgagggctactgtgtagagctggcggcagagattgccaagcacgtgggctactcctaccgtctggagattgtcagtgatggaaaatacggagcccgagaccctgacacgaaggcctggaatggcatggtgggagagctggtctatggaagagcagatgtggctgtggctcccttaactatcactttggtccgggaagaagttatagatttctccaaaccatttatgagtttggggatctccatcatgattaaaaaaccacagaaatccaagccgggtgtcttctccttccttgatcctttggcttatgagatttggatgtgcattgtttttgcctacattggagtgagtgttgtcctcttcctggtcagccgcttcagtccctatgaatggcacagtgaagagtttgaggaaggacgggaccagacaaccagtgaccagtccaatgagtttgggatattcaacagtttgtggttctccctgggagccttcatgcagcaaggatgtgacatttctcccaggtccctgtctggtcgcatcgttggtggcgtctggtggttcttcaccttaatcatcatctcctcatatacagccaatctggccgccttcctgaccgtggagaggatggtgtctcccattgagagtgcagaggacctagcgaagcagacagaaattgcctacgggacgctggaagcaggatctactaaggagttcttcaggaggtctaaaattgctgtgtttgagaagatgtggacatacatgaagtcagcagagccatcagtttttgtgcggaccacagaggaggggatgattcgagtgaggaaatccaaaggcaaatatgcctacctcctggagtccaccatgaatgagtacattgagcagcggaaaccctgtgacaccatgaaggtgggaggtaacttggattccaaaggctatggcattgcaacacccaaggggtctgccctgagaaatccagtaaacctggcagtgttaaaactgaacgagcaggggcttttggacaaattgaaaaacaaatggtggtacgacaagggcgagtgcggcagcgggggaggtgattccaaggacaagacaagcgctctgagcctcagcaatgtggcaggcgtgttctacatcctgatcggaggacttggactagccatgctggttgccttaatcgagttctgctacaaatcccgtagtgaatccaagcggatgaagggtttttgtttgatcccacagcaatccatcaacgaagccatacggacatcgaccctcccccgcaacagcggggcaggagccagcagcggcggcagtggagagaatggtcgggtggtcagccatgacttccccaagtccatgcaatcgattccttgcatgagccacagttcagggatgcccttgggagccacgggattgtaa

SEQ ID NO: 10887 - DNA, 2401 bp, synthetic construct
  misc_feature 1..2401: note = Synthetic polypeptide
  source 1..2401: mol_type = other DNA
atggggattatttccaaaccagcagtcacaggaacatgctgcttttagatttgctttgtcgcaactcacagagcccccgaagctgctcccccagattgatattgtgaacatcagcgacagctttgagatgacctatagatgcttatccgtcctgcagaaagtcctggatacagctgctgagaagaactggcaggtgacagcagtcaacattttgacaaccacagaggagggataccggatgctctttcaggacctggagaagaaaaaggagcggctggtggtggtggactgtgaatcagaacgcctcaatgctatcttgggccagattataaagctagagaagaatggcatcggctaccactacattcttgcaaatctgggcttcatggacattgacttaaacaaattcaaggagagtggcgccaatgtgacaggtttccagctggtgaactacacagacactattccggccaagatcatgcagcagtggaagaatagtgatgctcgagaccacacacgggtggactggaagagacccaagtacacctctgcgctcacctacgatggggtgaaggtgatggctgaggctttccagagcctgcggaggcagagaattgatatatctcgccgggggaatgctggggattgtctggctaacccagctgttccctggggccaagggatcgacatccagagagctctgcagcaggtgcgatttgaaggtttaacaggaaacgtgcagtttaatgagaaaggacgccggaccaactacacgctccacgtgattgaaatgaaacatgacggcatccgaaagattggttactggaatgaagatgataagtttgtccctgcagccaccgatgcccaagctgggggcgataattcaagtgttcagaacagaacatacatcgtcacaacaatcctagaagatccttatgtgatgctcaagaagaacgccaatcagtttgagggcaatgaccgttacgagggctactgtgtagagctggcggcagagattgccaagcacgtgggctactcctaccgtctggagattgtcagtgatggaaaatacggagcccgagaccctgacacgaaggcctggaatggcatggtgggagagctggtctatggaagagcagatgtggctgtggctcccttaactatcactttggtccgggaagaagttatagatttctccaaaccatttatgagtttggggatctccatcatgattaaaaaaccacagaaatccaagccgggtgtcttctccttccttgatcctttggcttatgagatttggatgtgcattgtttttgcctacattggagtgagtgttgtcctcttcctggtcagccgcttcagtccctatgaatggcacagtgaagagtttgaggaaggacgggaccagacaaccagtgaccagtccaatgagtttgggatattcaacagtttgtggttctccctgggagccttcatgcagcaaggatgtgacatttctcccaggtccctgtctggtcgcatcgttggtggcgtctggtggttcttcaccttaatcatcatctcctcatatacagccaatctggccgccttcctgaccgtggagaggatggtgtctcccattgagagtgcagaggacctagcgaagcagacagaaattgcctacgggacgctggaagcaggatctactaaggagttcttcaggaggtctaaaattgctgtgtttgagaagatgtggacatacatgaagtcagcagagccatcagtttttgtgcggaccacagaggaggggatgattcgagtgaggaaatccaaaggcaaatatgcctacctcctggagtccaccatgaatgagtacattgagcagcggaaaccctgtgacaccatgaaggtgggaggtaacttggattccaaaggctatggcattgcaacacccaaggggtctgccctgagaaatccagtaaacctggcagtgttaaaactgaacgagcaggggcttttggacaaattgaaaaacaaatggtggtacgacaagggcgagtgcggcagcgggggaggtgattccaaggacaagacaagcgctctgagcctcagcaatgtggcaggcgtgttctacatcctgatcggaggacttggactagccatgctggttgccttaatcgagttctgctacaaatcccgtagtgaatccaagcggatgaagggtttttgtttgatcccacagcaatccatcaacgaagccatacggacatcgaccctcccccgcaacagcggggcaggagccagcagcggcggcagtggagagaatggtcgggtggtcagccatgacttccccaagtccatgcaatcgattccttgcatgagccacagttcagggatgcccttgggagccacgggattgtaa

SEQ ID NO: 10888 - DNA, 2641 bp, synthetic construct
  misc_feature 1..2641: note = Synthetic polypeptide
  source 1..2641: mol_type = other DNA
atggggattatttccaaaccagcagtcacaggaacatgctgcttttagatttgctttgtcgcaactcacagagcccccgaagctgctcccccagattgatattgtgaacatcagcgacagctttgagatgacctatagattctgttcccagttctccaaaggagtctatgccatctttgggttttatgaacgtaggactgtcaacatgctgacctccttttgtggggccctccacgtctgcttcattacgccgagctttcccgttgatacatccaatcagtttgtccttcagctgcgccctgaactgcaggatgccctcatcagcatcattgaccattacaagtggcagaaatttgtctacatttatgatgccgaccggggcttatccgtcctgcagaaagtcctggatacagctgctgagaagaactggcaggtgacagcagtcaacattttgacaaccacagaggagggataccggatgctctttcaggacctggagaagaaaaaggagcggctggtggtggtggactgtgaatcagaacgcctcaatgctatcttgggccagattataaagctagagaagaatggcatcggctaccactacattcttgcaaatctgggcttcatggacattgacttaaacaaattcaaggagagtggcgccaatgtgacaggtttccagctggtgaactacacagacactattccggccaagatcatgcagcagtggaagaatagtgatgctcgagaccacacacgggtggactggaagagacccaagtacacctctgcgctcacctacgatggggtgaaggtgatggctgaggctttccagagcctgcggaggcagagaattgatatatctcgccgggggaatgctggggattgtctggctaacccagctgttccctggggccaagggatcgacatccagagagctctgcagcaggtgcgatttgaaggtttaacaggaaacgtgcagtttaatgagaaaggacgccggaccaactacacgctccacgtgattgaaatgaaacatgacggcatccgaaagattggttactggaatgaagatgataagtttgtccctgcagccaccgatgcccaagctgggggcgataattcaagtgttcagaacagaacatacatcgtcacaacaatcctagaagatccttatgtgatgctcaagaagaacgccaatcagtttgagggcaatgaccgttacgagggctactgtgtagagctggcggcagagattgccaagcacgtgggctactcctaccgtctggagattgtcagtgatggaaaatacggagcccgagaccctgacacgaaggcctggaatggcatggtgggagagctggtctatggaagagcagatgtggctgtggctcccttaactatcactttggtccgggaagaagttatagatttctccaaaccatttatgagtttggggatctccatcatgattaaaaaaccacagaaatccaagccgggtgtcttctccttccttgatcctttggcttatgagatttggatgtgcattgtttttgcctacattggagtgagtgttgtcctcttcctggtcagccgcttcagtccctatgaatggcacagtgaagagtttgaggaaggacgggaccagacaaccagtgaccagtccaatgagtttgggatattcaacagtttgtggttctccctgggagccttcatgcagcaaggatgtgacatttctcccaggtccctgtctggtcgcatcgttggtggcgtctggtggttcttcaccttaatcatcatctcctcatatacagccaatctggccgccttcctgaccgtggagaggatggtgtctcccattgagagtgcagaggacctagcgaagcagacagaaattgcctacgggacgctggaagcaggatctactaaggagttcttcaggaggtctaaaattgctgtgtttgagaagatgtggacatacatgaagtcagcagagccatcagtttttgtgcggaccacagaggaggggatgattcgagtgaggaaatccaaaggcaaatatgcctacctcctggagtccaccatgaatgagtacattgagcagcggaaaccctgtgacaccatgaaggtgggaggtaacttggattccaaaggctatggcattgcaacacccaaggggtctgccctgagaggtcccgtaaacctagcggttttgaaactcagtgagcaaggcgtcttagacaagctgaaaagcaaatggtggtacgataaaggggaatgtggaagcaaggactccggaagtaaggacaagacaagcgctctgagcctcagcaatgtggcaggcgtgttctacatcctgatcggaggacttggactagccatgctggttgccttaatcgagttctgctacaaatcccgtagtgaatccaagcggatgaagggtttttgtttgatcccacagcaatccatcaacgaagccatacggacatcgaccctcccccgcaacagcggggcaggagccagcagcggcggcagtggagagaatggtcgggtggtcagccatgacttccccaagtccatgcaatcgattccttgcatgagccacagttcagggatgcccttgggagccacgggattgtaa

SEQ ID NO: 10889 - DNA, 3646 bp, synthetic construct
  misc_feature 1..3646: note = Synthetic polypeptide
  source 1..3646: mol_type = other DNA
tggttgagagttaagtccatggaatcagactgtcttggctgttttatttcctagctctgtgaccttgggaaaacctcacagcacgggtagctctgaacggattcagctctcaggaatgtataatgtccgtaaaggcaagatgcagttgccagtgaaccgatggacaagacgccaagtcatcctatgtgggacctgcctgatagtatcatctgtgaaagacagcttgaccggaaagatgcatgttctgccactaattggtggaaaagtagaagaagtgaaaaagcaccaacactgtttagcatttagctcctctggaccccaaagccagacttactacatttgctttgatactttcacagaatacttaaggtggctgcgacaagtctccaaggttgcatcccagcgcattagctcagtggacctctcgtgttgtagcctggaacatctgcctgccaacctcttctacagccaagacctcactcatctcaatttaaaacaaaacttcctaaggcagaaccctagccttccagctgccagggggcttaatgaactgcaaaggttcaccaagttgaagagtcttaacctttccaataatcatttaggggacttcccactggcagtctgcagtattccaaccctggcagagctgaacgtgtcctgcaatgccctgcgatcagtcccggcagccgttggagtgatgcacaacttacagacatttttgttggatggaaactttctccaatcccttcctgctgagttggagaacatgaagcagcttagttatctgggtctttctttcaatgaatttactgacattcccgaagtattggagaaattgactgctgtggataaactttgtatgtctggaaactgtgtggagacccttaggctacaggctttaagaaaaatgcctcacattaaacatgtggatctaaggttgaacgtaattaggaagctgatagcagatgaagtggactttctacagcatgttactcagcttgacctacgagacaataagcttggtgatctagatgctatgattttcaacaacattgaagttttacactgtgaaaggaatcaactggtcacattagacatctgtggctatttcctaaaagcgctctatgcctcttctaatgaacttgttcaacttgatgtttacccagttccaaattatctgtcctacatggatgtttcaaggaaccgcttagaaaatgtgcctgagtgggtatgtgaaagccgaaagctagaagttttggatattggccataatcaaatatgtgaacttcctgcccgcttattttgtaatagcagtctccggaaactactggcaggacacaaccagttggcaaggctgcctgaaaggctagaaagaacctcggtggaggtcttggatgtgcaacacaaccagctccttgagctcccacctaaccttctgatgaaggctgacagcctgagattcctgaacgcctctgcgaacaaactggaaagccttcctccagccacgctttccgaagagacaaacagtatcttacaagagttgtatttgacaaataacagcctcacagacaaatgtgtgcccttgttaacgggacacccccatttgaagatccttcacatggcctataaccgacttcagagttttccagcaagtaaaatggcgaaactggaggaacttgaagaaattgatctcagtgggaataagctgaaagccatcccaacaacgatcatgaattgcaggcgcatgcacaccgtgattgctcactccaactgcatcgaggtctttcccgaagttatgcagctcccagagatcaagtgtgtggacctgagctgtaatgagctaagtgaagtcacattaccagaaaacctgcctcccaaactgcaggagctagacctgactggaaacccgcgccttgtccttgatcacaaaaccctggaactactgaataatatccgctgtttcaagattgatcagccttctacaggagacgcttccggagccccagctgtatggagtcatggttacactgaagcttcgggggtaaaaaacaagttgtgtgtcgcagccctgtcggtgaataacttctgtgacaaccgcgaagccctgtatggtgtgtttgacggagaccggaatgtggaggtgccctaccttctccagtgcactatgagtgacattttggctgaagagctgcaaaaaacaaaaaacgaagaagaatacatggtcaatacattcattgtcatgcaaaggaaacttggaactgctgggcagaagcttggtggtgccgctgtcctttgtcatatcaagcatgaccctgtggatccaggaggatccttcaccttgacctctgctaatgtgggcaagtgccaaacagttctctgtcgaaatggaaagccgctgcctctgtccagatcttacatcatgagctgtgaagaagagctgaagaggattaaacagcacaaggccattatcactgaggatggcaaggtgaacggagtgactgagtccacgcgcatcctgggctacaccttcctccatcccagtgtggtgcctcgcccccacgtgcagtccgtgctcctgactccccaggatgagttcttcatcctaggcagtaaggggttgtgggacagcctgtccgtcgaggaggccgtggaagccgtgcgcaacgtgcccgatgccctggctgctgccaagaagctgtgtaccctggcccagagctacggctgccacgacagcatcagcgctgtggtggtgcagctcagtgtcactgaggacagcttctgctgctgcgagctcagcgccggtggggctgtgccaccacccagtcctggcatctttcctccctcagtgaacatggtgatcaaggatcggccctcagatgggctgggcgtgccgtcctccagcagcggcatggcttccgagattagcagtgagctctccacttctgagatgagcagcgaggtggggtcaacagcctccgatgagcccccgcccggagccctaagcgagaacagccctgcctaccccagtgagcagcgctgcatgctccaccccatctgtctgtccaactccttccagcgccagctatccagcgccacgttctctagcgccttctccgacaacggccttgacagtgacgatgaggagcccatcgagggcgtcttcaccaacggcagccgggtggaggtggaggtggacatccactgcagccgggccaaggagaaggagaaacagcagcacctgcttcaggtgccagcagaggccagtgatgagggcattgtcatcagcgccaacgaggatgagccaggtctgcccaggaaggcagacttctctgccgttgggaccattgggcgccggagggccaatggctctgttgcgccccaggaaaggagccacaatgtgatagaggtggctacagacgcacctcttcgaaagcctggaggctattttgctgccccggctcagccggatcctgatgatcagtttatcatacccccggagctggaagaggaggtcaaagaaatcatgaagcatcaccaggagcaacagcagcagcagcagccgccaccaccccctcagctccagccgcagctgccgcggcactaccagctggaccagctgccagattattacgacacgccactatga

SEQ ID NO: 10890 - DNA, 481 bp, synthetic construct
  misc_feature 1..481: note = Synthetic polypeptide
  source 1..481: mol_type = other DNA
ctccaacctcccttttctactatttccatgctttctatgctttagacaaagaactcattgttttaaacattccttcctcttcttgctcctgtgattctgctcttgtgcttgcttctgcctgggaagtgcctcctccgtcctcatctcaaatctcatctctctttacacagccactgcagatgccccttccttggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaa

SEQ ID NO: 10891 - DNA, 957 bp, synthetic construct
  misc_feature 1..957: note = Synthetic polypeptide
  source 1..957: mol_type = other DNA
atttcatccttcttttttcttagaccaacttcttagagtcattcttggcttttctttgtctctcacacctgacaatctgtaagtgagtcctgtcacatcaaaatgtattcagaatctggctagctctcaccatctacgctactaccaccctattcctagtgaccatcctctatcaccaggattattccagtagcctcctaactgatctccctgcttctcttgccctgcttctgtctattctcagcacaacaagcagtctattccaagcacaacaaccagcctattccacatcacaatttgaaatgtaaattagatcatattactccttggctcaaaacccccccccgtgacttctcatgcacttggaatcaaagctacagttattactgaaatcagcaaagtcctatatattctattcccacctcaccgtctatctaccactccttcctctgtccgtctgtcactctgttccaaacactctgggcttcttgtgagactctctgtgctccttgccagattaacaaaagcagtggcattgtggaggcatcacggatcatgaatttataccagtttattcaactttataaagatatcacaagtcaagcagcaggagtattggcacagagctccacctctgaagaacctgatgaaaactcatcctctgtaacatcttgtcaggctagtctttggatgggaagggtgaagcagctgaccgatgaggaggagtgttgtatctgtatggatgggcgggctgacctcatcctgccttgtgctcacagcttttgtcagaagtgtattgataaatggagtgatcgacacaggaattgccctatttgtcgcctacagatgactggagcaaatgaatcttgggtggtatcagatgcacccactgaagatgatatggctaactatattcttaacatggctgatgaggcaggccagccccacaggccatga

SEQ ID NO: 10892 - DNA, 810 bp, synthetic construct
  misc_feature 1..810: note = Synthetic polypeptide
  source 1..810: mol_type = other DNA
atttcatccttcttttttcttagaccaacttcttagagtcattcttggcttttctttgtctctcacacctgacaatctgtaagtgagtcctgtcacatcaaaatgtattcagaatctggctagctctcaccatctacgctactaccaccctattcctagtgaccatcctctatcaccaggattattccagtagcctcctaactgatctccctgcttctcttgccctgcttctgtctattctcagcacaacaagcagtctattccaagcacaacaaccagcctattccacatcacaatttgaaatgtaaattagatcatattactccttggctcaaaacccccccccgtgacttctcatgcacttggaatcaaagctacagttattactgaaatcagcaaagtcctatatattctattcccacctcaccgtctatctaccactccttcctctgtccgtctgtcactctgttccaaacactctgggcttcttgtgagactctctgtgctccttgccagattaacaaaagcagtggcattgtggaggcatcacggatcatgaatttataccagtttattcaactttataaagatatcacaagtcaagcagcaggagtattggcacagagctccacctctgaagaacctgatgaaaactcatcctctgtaacatcttgtcaggctagtctttggatgggaagggtgaagcagctgaccgatgaggaggagtgttgtatctgtatggatgggcgggctgacctcatcctgccttgtgctcacagcttttgtcagaagtgtattgataaatggtaa

SEQ ID NO: 10893 - DNA, 806 bp, synthetic construct
  misc_feature 1..806: note = Synthetic polypeptide
  source 1..806: mol_type = other DNA
atttcatccttcttttttcttagaccaacttcttagagtcattcttggcttttctttgtctctcacacctgacaatctgtaagtgagtcctgtcacatcaaaatgtattcagaatctggctagctctcaccatctacgctactaccaccctattcctagtgaccatcctctatcaccaggattattccagtagcctcctaactgatctccctgcttctcttgccctgcttctgtctattctcagcacaacaagcagtctattccaagcacaacaaccagcctattccacatcacaatttgaaatgtaaattagatcatattactccttggctcaaaacccccccccgtgacttctcatgcacttggaatcaaagctacagttattactgaaatcagcaaagtcctatatattctattcccacctcaccgtctatctaccactccttcctctgtccgtctgtcactctgttccaaacactctgggcttcttgtgagactctctgtgctccttgccagattaacaaaagcagtggcattgtggaggcatcacggatcatgaatttataccagtttattcaactttataaagatatcacaagtcaagcagcaggagtattggcacagagctccacctctgaagaacctgatgaaaactcatcctctgtaacatcttgtcaggctagtctttggatgggaagggtgaagcagctgaccgatgaggaggagtgttgtatctgtatggatgggcgggctgacctcatcctgccttgtgctcacagcttttgtcagaagtgtattgataaatg

SEQ ID NO: 10894 - DNA, 246 bp, synthetic construct; identical to SEQ ID NO: 10745
  misc_feature 1..246: note = Synthetic polypeptide
  source 1..246: mol_type = other DNA

SEQ ID NO: 10895 - DNA, 424 bp, synthetic construct; identical to SEQ ID NO: 10746
  misc_feature 1..424: note = Synthetic polypeptide
  source 1..424: mol_type = other DNA

SEQ ID NO: 10896 - DNA, 173 bp, synthetic construct
  misc_feature 1..173: note = Synthetic polypeptide
  source 1..173: mol_type = other DNA
gaacctgctaagccgattgtcaaatggatgagaaactcagagccaaggatcgggaaaacacccttaaagaacgagtgcaaacttctgctcctggaggctcccgttcactggactttgcaggagacacacaggctccccagaccccgtggtggtgcctgatgaccttcagctga

SEQ ID NO: 10897 - DNA, 159 bp, synthetic construct
  misc_feature 1..159: note = Synthetic polypeptide
  source 1..159: mol_type = other DNA
gaacctgctaagccgattgtcaaatggatgagaaactcagagccaaggatcgggaaaacacccttaaagaacgagtgcaaacttctgctcctggaggctcccgttcactggactttgcaggagacacacaggctccccagaccccgtggtggtgcctga

SEQ ID NO: 10898 - DNA, 921 bp, synthetic construct; identical to SEQ ID NO: 8811
  misc_feature 1..921: note = Synthetic polypeptide
  source 1..921: mol_type = other DNA

SEQ ID NO: 10899 - DNA, 861 bp, synthetic construct
  misc_feature 1..861: note = Synthetic polypeptide
  source 1..861: mol_type = other DNA
aaatatgagtaaagattggttttaaagactaacacagattagaggcatagccaaatgtaacgtatggaccttgattggatcgtggtttagaggaaaaagcttgtgaaagatattcttgggatgtctgaaaaattttgtatgcagattatcatatgatattgttaatttgtttacatgtgattacaatattgtgattccatagaattttctcaggagatcaatatgcatttaaagtgtcaagatgtctgaagttttatcttgtttagcaaagcaaacaaaagtacatgtggagatgaattaaatatggcaaaatggaaacaaccagtatagccaggtggaaaaacagataagctccgaagaagtatgcctaacctagcccggatgccaagtacaactgccattagtagcaacattagttctccggtcaccgtgcgaaatagtcagagttttgactcaagcttgcatggagctggaaatggaatttcaagaatacaatcttgtattccatcaccgggacagcttcaacacagggtccacagcgtggggcatttcccagtgtctatccgacagcctcttaaagccacagcctatgtgagtccaaccgttcaaggcagcagtaacatgcctttatcaaacggcttacagctgtattccaacacaggaatccccacaccgaacaaagctgcagcttctgggataatgggtcgcagtgcactcccaagaccttcgttggcaataaatgggagtaacctgcctcgaagcaaaattgcacaacctgttagaagttttcttcagcctccaaagcctctgtcttcactcagcactctgagggatggaaattggagagatggttgctactaa

SEQ ID NO: 10900 - DNA, 426 bp, synthetic construct
  misc_feature 1..426: note = Synthetic polypeptide
  source 1..426: mol_type = other DNA
aaatatgagtaaagattggttttaaagactaacacagattagaggcatagccaaatgtaacgtatggaccttgattggatcgtggtttagaggaaaaagcttgtgaaagatattcttgggatgtctgaaaaattttgtatgcagattatcatatgatattgttaatttgtttacatgtgattacaatattgtgattccatagaattttctcaggagatcaatatgcatttaaagtgtcaagatgtctgaagttttatcttgtttagcaaagcaaacaaaagtacatgtggagatgaattaaatatggcaaaatggaaacaaccagtatagccaggtggaaaaacagataagctccgaagaagtatgcctaacctagcccggatgccaagtacaactgccattagtagcaacattagttctccggtc

SEQ ID NO: 10901 - DNA, 665 bp, synthetic construct
  misc_feature 1..665: note = Synthetic polypeptide
  source 1..665: mol_type = other DNA
aaatatgagtaaagattggttttaaagactaacacagattagaggcatagccaaatgtaacgtatggaccttgattggatcgtggtttagaggaaaaagcttgtgaaagatattcttgggatgtctgaaaaattttgtatgcagattatcatatgatattgttaatttgtttacatgtgattacaatattgtgattccatagaattttctcaggagatcaatatgcatttaaagtgtcaagatgtctgaagttttatcttgtttagcaaagcaaacaaaagtacatgtggagatgaattaaatatggcaaaatggaaacaaccagtatagccaggtggaaaaacagataagctccgaagaagtatgcctaacctagcccggatgccaagtacaactgccattagtagcaacattagttctccggtcaccgtgcgaaatagtcagagttttgactcaagcttgcatggagctggaaatggaatttcaagaatacaatcttgtattccatcaccgggacagcttcaacacagggtccacagcgtggggcatttcccagtgtctatccgacagcctcttaaagccacagcctatgtgagtccaaccgttcaaggcagcagtaacatgcctttatcaaacggcttacagctgtattccaacacaggaat

SEQ ID NO: 10902 - DNA, 385 bp, synthetic construct
  misc_feature 1..385: note = Synthetic polypeptide
  source 1..385: mol_type = other DNA
aaatatgagtaaagattggttttaaagactaacacagattagaggcatagccaaatgtaacgtatggaccttgattggatcgtggtttagaggaaaaagcttgtgaaagatattcttgggatgtctgaaaaattttgtatgcagattatcatatgatattgttaatttgtttacatgtgattacaatattgtgattccatagaattttctcaggagatcaatatgcatttaaagtgtcaagatgtctgaagttttatcttgtttagcaaagcaaacaaaagtacatgtggagatgaattaaatatggcaaaatggaaacaaccagtatagccaggtggaaaaacagataagctccgaagaagtatgcctaacctagcccggatgc

SEQ ID NO: 10903 - DNA, 2086 bp, synthetic construct; identical to SEQ ID NO: 9039
  misc_feature 1..2086: note = Synthetic polypeptide
  source 1..2086: mol_type = other DNA

SEQ ID NO: 10904 - DNA, 2065 bp, synthetic construct; identical to SEQ ID NO: 9040
  misc_feature 1..2065: note = Synthetic polypeptide
  source 1..2065: mol_type = other DNA

SEQ ID NO: 10905 - DNA, 1457 bp, synthetic construct
  misc_feature 1..1457: note = Synthetic polypeptide
  source 1..1457: mol_type = other DNA
tgcagccgaagttgcttcagggctaccagggcggtggaggtttgggggtggggcgaattttgcagaaacctctttgctcctctgctaggcatttgaaaacgtggcttgggtcaggcacaggcgcccccaccccccgggtcccaggtgttcttagattttccttggcattgatggaaaggtcactcgttccccacttccgccggcacatgcctggacaccaccatttgtttcgccgtcgccccgtatgcctccggtgacacacattcacaccatctgctgtgggatacgccagtgccacgcgtggtcacatggtctgcacctggcattcgccactgttcctgtttgcacgagccctgtaaagcgcggtcggctttccggagccccagggcttttagaagaggggtaggccactgctctttcaaaggaggagggaggcagagggttgaaggatcagtgaatttgcagctgacactaggcctcgagacctatgggatcattctttgctgcagcgaggccctgcctgcctcagcagatgtggcgagcccatcctatctcactcggtgggggccaaaatgggatctgaaggggtgtcctgagaacacagcaggcgtcctgaagctccccctccctccctcggtggaagtcagctcaaggagttcctgaggacaggactcctgggggtttggccctgggacaggacaagacacccgcggtcccctctcccacgctgccccaaactggaggccggatccagccgccgccgcgcctgcagctggagcctcgctgccgccgcgctgcggtggcgttctttaaaggggacccagcctgactgccaggagcagagttcgagtcgggccagccaatgcgcatgcgcgaggcgggagcggcttctcccgtcacagtggttcccacggttgtcttagaaagcagtcctcgaggcatggcaaagtaggagccctccatggcagtgcttgagtgtcggggctctgagtctccggcctgacctctccacgtggtcgacgggaacgtccccagatgccaggattcgcaaagggctgaccaggatggcgaaaccttaggcagagtccggggaaagcagcacggcatcccagcctcaggcctgcccggacggtgttggttgggtttcttttgatttctcctgcttagaaatggtgcgagaactttggatgtggaacgtggaggaggaggaacacgaagtggggatctgcacttggggtggtcagcactgcggatgcccagcaaagtcactgcctggtccacatcccggaggggtctctgcgcctcagtcggcatcgcagctgatggtgaaacttttggtgtggcagaagagtgtccacaaacttcggaaggtatccgctacatcctccatagccgtgtatccctgcccagggcaatcttctgggggagcggaaagtcctgctcccgggccagggctg

SEQ ID NO: 10906 - DNA, 613 bp, synthetic construct
  misc_feature 1..613: note = Synthetic polypeptide
  source 1..613: mol_type = other DNA
cctggaactctcctccctggatctttgcccaagtttgtcatcctcaaggtctcagcacagattccccctccttcaagaggcctttcctgacccctcagccccagtcatatttcttcatggcatttcctctacagtgcagattgctgtctgaagctcccttgtttatctactcttgctcaagatctgtgtctcccaccgttaatgtgagctctgagagggcagagagcagacctaccttgttcatggctgtatccctgcatatggcatggtgcttggcacatatagtagcttcgcagtgtgggggggcctgttctccaccattgactgtggcctggtgcggcttcggggcaaggaggatccctggaactctatcaccagtggagcattgaccggggctgtgctggctgcccgcagtggcccactggccatggtgggctcagcaatgatggggggcatcctgttggccctcattgagggcgttggcatcctcctcactcgctacacagcccagcagttccgaaatgcgcccccattcctggaggaccccagccagctgccccctaaggatggcaccccggccccaggctaccccagctatcagcagtaccactga

SEQ ID NO: 10907 - DNA, 424 bp, synthetic construct
  misc_feature 1..424: note = Synthetic polypeptide
  source 1..424: mol_type = other DNA
cctggaactctcctccctggatctttgcccaagtttgtcatcctcaaggtctcagcacagattccccctccttcaagaggcctttcctgacccctcagccccagtcatatttcttcatggcatttcctctacagtgcagattgctgtctgaagctcccttgtttatctactcttgctcaagatctgtgtctcccaccgttaatgtgagctctgagagggcagagagcagacctaccttgttcatggctgtatccctgcatatggcatggtgcttggcacatatagtagcttcgcagtgtgggggggcctgttctccaccattgactgtggcctggtgcggcttcggggcaaggaggatccctggaactctatcaccagtggagcattgaccggggctgtgctggctgcccgcagtggcccactg

SEQ ID NO: 10908 - DNA, 2165 bp, synthetic construct
  misc_feature 1..2165: note = Synthetic polypeptide
  source 1..2165: mol_type = other DNA
caaagctgcagaatacacatggtgcatctttctcacaggccaggtttgctcagagacatggagacgaaaaggggaatgatgtgcggatcatccttggccagtttgaccagaatatggcagcaaaagtgttctgttgtgcatacgaggagaacatgtatggtagtaaatatcagtggatcattccgggctggtacgagccttcttggtgggagcaggtgcacacggaagccaactcatcccgctgcctccggaagaatctgcttgctgccatggagggctacattggcgtggatttcgagcccctgagctccaagcagatcaagaccatctcaggaaagactccacagcagtatgagagagagtacaacaacaagcggtcaggcgtggggcccagcaagttccacgggtacgcctacgatggcatctgggtcatcgccaagacactgcagagggccatggagacactgcatgccagcagccggcaccagcggatccaggacttcaactacacggaccacacgctgggcaggatcatcctcaatgccatgaacgagaccaacttcttcggggtcacgggtcaagttgtattccggaatggggagagaatggggaccattaaatttactcaatttcaagacagcagggaggtgaaggtgggagagtacaacgctgtggccgacacactggagatcatcaatgacaccatcaggttccaaggatccgaaccaccaaaagacaagaccatcatcctggagcagctgcggaagatctccctacctctctacagcatcctctctgccctcaccatcctcgggatgatcatggccagtgcttttctcttcttcaacatcaagaaccggaatcagaagctcataaagatgtcgagtccatacatgaacaaccttatcatccttggagggatgctctcctatgcttccatatttctctttggccttgatggatcctttgtctctgaaaagacctttgaaacactttgcaccgtcaggacctggattctcaccgtgggctacacgaccgcttttggggccatgtttgcaaagacctggagagtccacgccatcttcaaaaatgtgaaaatgaagaagaagatcatcaaggaccagaaactgcttgtgatcgtggggggcatgctgctgatcgacctgtgtatcctgatctgctggcaggctgtggaccccctgcgaaggacagtggagaagtacagcatggagccggacccagcaggacgggatatctccatccgccctctcctggagcactgtgagaacacccatatgaccatctggcttggcatcgtctatgcctacaagggacttctcatgttgttcggttgtttcttagcttgggagacccgcaacgtcagcatccccgcactcaacgacagcaagtacatcgggatgagtgtctacaacgtggggatcatgtgcatcatcggggccgctgtctccttcctgacccgggaccagcccaatgtgcagttctgcatcgtggctctggtcatcatcttctgcagcaccatcaccctctgcctggtattcgtgccgaagctcatcaccctgagaacaaacccagatgcagcaacgcagaacaggcgattccagttcactcagaatcagaagaaagaagattctaaaacgtccacctcggtcaccagtgtgaaccaagccagcacatcccgcctggagggcctacagtcagaaaaccatcgcctgcgaatgaagatcacagagctggataaagacttggaagaggtcaccatgcagctgcaggacacaccagaaaagaccacctacattaaacagaaccactaccaagagctcaatgacatcctcaacctgggaaacttcactgagagcacagatggaggaaaggccattttaaaaaatcacctcgatcaaaatccccagctacagtggaacacaacagagccctctcgaacatgcaaagatcctatagaagatataaactctccagaacacatccagcgtcggctgtccctccagctccccatcctccaccacgcctacctcccatccatcggaggcgtggacgccagctgtgtcagcccctgcgtcagccccaccgccagcccccgccacagacatgtgccaccctccttccgagtcatggtctcgggcctgtaa

SEQ ID NO: 10909 - DNA, 1354 bp, synthetic construct
  misc_feature 1..1354: note = Synthetic polypeptide
  source 1..1354: mol_type = other DNA
tgtggatcatggaatacttcttgattcagaacgtaggaagtctgatgccagctcactcatgcctcccctgaggatctccctgattcaggatatgaggcacatccagaacatcggggaaatcaagactgatgtgggaaaggccagagcatgggtgcgactgtccatggaaaaaaagttactttccagacacctgaagcagctcctctcagaccatgagctcaccaaaaagttatataagcgctatgccttcctgcgctgtgatgacgagaaggagcagttcctctatcacctcctgtctttcaatgccgtcgattacttttgcttcaccaatgtcttcacaactatcctgatcccgtaccacattctgatcgtaccaagcaagaagctggggggctccatgttcactgccaacccatggatctgtatatcaggagaattgggtgagacacagatcatgcagattcccaggaatgtgctagagatgaccttcgagtgccagaacttggggaagcttactactgtccagattggccatgataactctgggctgtatgccaaatggctggtggagtatgtgatggtcaggaatgagatcacaggacatacctacaagttcccgtgtggccggtggttagggaagggcatggatgatggaagcctggagcggatcctagttggggagctgctcacatcccagcctgaggtggatgagaggccatgccggaccccgccgctgcagcagtcccccagtgtcatccggaggcttgttaccatctcacccaacaacaagcccaagctgaacactgggcagatccaggagtccatcggggaggcagtcaatggcattgtgaagcacttccataagcctgagaaagagcgaggcagtctgacgctgttgctctgtggagagtgtggccttgtctcggccttggaacaggctttccagcatggatttaaatcgccccggctcttcaaaaatgtcttcatttgggatttcctggaaaaagcacaaacctattatgagacattagagaagaatgaagtagtccctgaggaaaactggcatacaagagcccggaacttctgccgatttgtcactgcaatcaacaatactccccggaacatcggcaaggatggcaagtttcagatgctggtgtgcttgggagccagagatcacctcctacaccactggattgccctgctggctgactgccccatcactgcacacatgtatgaggatgtggcactgatcaaagaccatacacttgtcaattccttgattcgtgtgctgcagacattgcaggagttcaacatcacgctggagacgtcccttgtcaagggcatcgacatctga

SEQ ID NO: 10910 - DNA, 1216 bp, synthetic construct
  misc_feature 1..1216: note = Synthetic polypeptide
  source 1..1216: mol_type = other DNA
tgtggatcatggaatacttcttgattcagaacgtaggaagtctgatgccagctcactcatgcctcccctgaggatctccctgattcaggatatgaggcacatccagaacatcggggaaatcaagactgatgtgggaaaggccagagcatgggtgcgactgtccatggaaaaaaagttactttccagacacctgaagcagctcctctcagaccatgagctcaccaaaaagttatataagcgctatgccttcctgcgctgtgatgacgagaaggagcagttcctctatcacctcctgtctttcaatgccgtcgattacttttgcttcaccaatgtcttcacaactatcctgatcccgtaccacattctgatcgtaccaagcaagaagctggggggctccatgttcactgccaacccatggatctgtatatcaggagaattgggtgagacacagatcatgcagattcccaggaatgtgctagagatgaccttcgagtgccagaacttggggaagcttactactgtccagattggccatgataactctgggctgtatgccaaatggctggtggagtatgtgatggtcaggaatgagatcacaggacatacctacaagttcccgtgtggccggtggttagggaagggcatggatgatggaagcctggagcggatcctagttggggagctgctcacatcccagcctgaggtggatgagaggccatgccggaccccgccgctgcagcagtcccccagtgtcatccggaggcttgttaccatctcacccaacaacaagcccaagctgaacactgggcagatccaggagtccatcggggaggcagtcaatggcattgtgaagcacttccataagcctgagaaagagcgaggcagtctgacgctgttgctctgtggagagtgtggccttgtctcggccttggaacaggctttccagcatggatttaaatcgccccggctcttcaaaaatgtcttcatttgggatttcctggaaaaagcacaaacctattatgagacattagagaagaatgaagtagtccctgaggaaaactggcatacaagagcccggaacttctgccgatttgtcactgcaatcaacaatactccccggaacatcggcaaggatgagatcacctcctacaccactggattgccctgctggctgactgccccatcactgcacacatgtatgaggatgtggcactga

SEQ ID NO: 10911 - DNA, 71 bp, synthetic construct
  misc_feature 1..71: note = Synthetic polypeptide
  source 1..71: mol_type = other DNA
tgtggatcatggaatacttcttgattcagaacgtaggaagtctgatgccagctcactcatgcctcccctga

SEQ ID NO: 10912 - DNA, 1838 bp, synthetic construct
  misc_feature 1..1838: note = Synthetic polypeptide
  source 1..1838: mol_type = other DNA
atggactgaatatctgtgtccccctaaacccacatattgaaatccttcccccagtgtgatgctgtttggaagtggggcctttgggaggtgattgggtcataggggtgcagccctcatggatggatgaatgcccttctaagcccaggccagagggctagcttgctgtttctcctccaggtgaggatacaactagaagccagcagtctacaggctggaagaaggccctcaccagaacccaacccttggacttcagcctccagaactgtgagcacctccgggtctgtccccaggagtacacctgctgttccagtgagacagagcagaggctgatcagggagactgaggccaccttccgaggcctggtggaggacagcggctcctttctggttcacacactggctgccaggcacagaaaatttgatgagttttttctggagatgctctcagtagcccagcactctctgacccagctcttctcccactcctacggccgcctgtatgcccagcacgccctcatattcaatggcctgttctctcggctgcgagacttctatggggaatctggtgaggggttggatgacaccctggcggatttctgggcacagctcctggagagagtgttcccgctgctgcacccacagtacagcttcccccctgactacctgctctgcctctcacgcttggcctcatctaccgatggctctctgcagccctttggggactcaccccgccgcctccgcctgcagataacccggaccctggtggctgcccgagcctttgtgcagggcctggagactggaagaaatgtggtcagcgaagcgcttaaggtgccggtgtctgaaggctgcagccaggctctgatgcgtctcatcggctgtcccctgtgccggggggtcccctcacttatgccctgccagggcttctgcctcaacgtggttcgtggctgtctcagcagcaggggactggagcctgactggggcaactatctggatggtctcctgatcctggctgataagctccagggccccttttcctttgagctgacggccgagtccattggggtgaagatctcggagggtttgatgtacctgcaggaaaacagtgcgaaggtgtccgcccaggtgtttcaggagtgcggcccccccgacccggtgcctgcccgcaaccgtcgagccccgccgccccgggaagaggcgggccggctgtggtcgatggtgaccgaggaggagcggcccacgacggccgcaggcaccaacctgcaccggctggtgtgggagctccgcgagcgtctggcccggatgcggggcttctgggcccggctgtccctgacggtgtgcggagactctcgcatggcagcggacgcctcgctggaggcggcgccctgctggaccggagccgggcggggccggtacttgccgccagtggtcgggggctccccggccgagcaggtcaacaaccccgagctcaaggtggacgcctcgggccccgatgtcccgacacggcggcgtcggctacagctccgggcggccacggccagaatgaaaacggccgcactgggacacgacctggacgggcaggacgcggatgaggatgccagcggctctggagggggacagcagtatgcagatgactggatggctggggctgtggctcccccagcccggcctcctcggcctccataccctcctagaagggatggttctgggggcaaaggaggaggtggcagtgcccgctacaaccagggccggagcaggagtgggggggcatctattggttttcacacccaaaccatcctcattctctccctctcagccctggccctgcttggacctcgataa

SEQ ID NO: 10913 - DNA, 182 bp, synthetic construct
  misc_feature 1..182: note = Synthetic polypeptide
  source 1..182: mol_type = other DNA
gagcatggacttggaagccggacagtcccctgttcgaatctcagcaactctacttacctgctcagtgtgtcattctttcgcgctgcacacaccttcctccacgtggtgaagatacatcgctcctgacagatccaaagggagatatcgatccatggaagatggttgctctcggaaaatgctga

SEQ ID NO: 10914 - DNA, 827 bp, synthetic construct
  misc_feature 1..827: note = Synthetic polypeptide
  source 1..827: mol_type = other DNA
gctgggcgctgtggctcacgcctgtaatcccagcactttgggaggccgaggcaagcggattacgagcctacttctgcttcctcctggccgctctgggtgtgacagctggtgcccatcgcttgtggagccacaggtcctaccgggccaagctgcctctgaggatatttctggctgtcgccaactccatggctttccagaatgacatcttcgagtggtccagggaccaccgagcccaccacaagtactcagagacggatgctgacccccacaatgcccgccggggcttcttcttctcccatattgggtggctgtttgttcgcaagcatcgagatgttattgagaaggggagaaagcttgacgtcactgacctgcttgctgatcctgtggtccggatccagagaaagtactataagatctccgtggtgctcatgtgctttgtggtccccacgctggtgccctggtacatctggggagagagtctgtggaattcctacttcttggcctctattctccgctataccatctcactcaacatcagctggctggtcaacagcgccgcccacatgtatggaaaccggccctatgacaagcacatcagccctcggcagaacccactcgtcgctctgggtgccattggtgaaggcttccataattaccatcacacctttccctttgactactctgcgagtgaatttggcttaaattttaacccaaccacctggttcattgatttcatgtgctggctggggctggccactgaccgcaaacgggcaaccaagccgatgatcgaggcccggaaggccaggactggagacagcagtgcttga

SEQ ID NO: 10915 - DNA, 605 bp, synthetic construct
  misc_feature 1..605: note = Synthetic polypeptide
  source 1..605: mol_type = other DNA
gctgggcgctgtggctcacgcctgtaatcccagcactttgggaggccgaggcaagcggattacgagcctacttctgcttcctcctggccgctctgggtgtgacagctggtgcccatcgcttgtggagccacaggtcctaccgggccaagctgcctctgaggatatttctggctgtcgccaactccatggctttccagaatgacatcttcgagtggtccagggaccaccgagcccaccacaagtactcagagacggatgctgacccccacaatgcccgccggggcttcttcttctcccatattgggtggctgtttgttcgcaagcatcgagatgttattgagaaggggagaaagcttgacgtcactgacctgcttgctgatcctgtggtccggatccagagaaatacacagcacatccagaaagaaggaagagctctcaatcaagaggcagcgtgtgagatgcttcgtgaatggcatcaagggcatatattgaaagtcacccttcccggattacacattttagctttgttacatactcattgtaaccactccgaaaagtgctgcttgatgctgcgtgctctttctgtgtccctggaggtattctga

SEQ ID NO: 10916 - DNA, 233 bp, synthetic construct
  misc_feature 1..233: note = Synthetic polypeptide
  source 1..233: mol_type = other DNA
gctgggcgctgtggctcacgcctgtaatcccagcactttgggaggccgaggcaagcggattacgagcctacttctgcttcctcctggccgctctgggtgtgacagctggtgcccatcgcttgtggagccacaggtcctaccgggccaagctgcctctgaggatatttctggctgtcgccaactccatggctttccaggcagcagcagaagtggtcctgacccagatgccctga

SEQ ID NO: 10917 - DNA, 1335 bp, synthetic construct; identical to SEQ ID NO: 8839
  misc_feature 1..1335: note = Synthetic polypeptide
  source 1..1335: mol_type = other DNA

SEQ ID NO: 10918 - DNA, 1106 bp, synthetic construct
  misc_feature 1..1106: note = Synthetic polypeptide
  source 1..1106: mol_type = other DNA
ggcagcagagaatagcaaaaagagaactgagctgaggtcagattctgtttctggcgtctgcatacgcaagtccccaactcgctgaggagagctgttcagctatggctgctgtcacacattacctgtatctttgccagtttagctggatgctcattcagtctgtgaatttctggtacgtgctggtgatgaatgatgagcacacagagaggcgatatctgctgtttttccttctgagttggggactaccagcttttgtggtgattctcctcatagttattttgaaaggaatctatcatcagagcatgtcacagatctatggactcattcatggtgacctgtgttttattccaaacgtctatgctgctttgttcactgcagctcttgttcctttgacgtgcctcgtggtggtgttcgtggtgttcatccatgcctaccaggtgaagccacagtggaaagcatatgatgatgtcttcagaggaaggacaaatgctgcagaaattccactgattttatatctctttgctctgatttccgtgacatggctttggggaggactacacatggcctacagacacttctggatgttggttctctttgtcattttcaacagtctgcagggactttatgttttcatggtttatttcattttacacaaccaaatgtgttgccctatgaaggccagttacactgtggaaatgaatgggcatcctggacccagcacagcctttttcacgcccgggagtggaatgcctcctgctggaggggaaatcagcaagtccacccagaatctcatcggtgctatggaggaggtgccacctgactgggagagagcatccttccaacagggcagtcaggccagccctgatttaaagccaagtccacaaaatggagccacgttcccgtcctctggaggatatggccaggggtcactgatagccgatgaggagtcccaggagtttgatgatttaatatttgcattaaaaactggtgctggtctcagtgtcagtgataatgaatctggtcaaggcagccaggaggggggcaccttgactgactcccagatcgtggagctcaggaggatacccatcgccgacactcacctgtag

SEQ ID NO: 10919 - DNA, 2219 bp, synthetic construct
  misc_feature 1..2219: note = Synthetic polypeptide
  source 1..2219: mol_type = other DNA
gagtagcagacccagagtctggagacccagattctaggcctggcttggccaacgacaagcagggtgaccttgggttaaaaaaaaaaaaaggcatcattctctgagtctcactccctcttctcaaaaagatggcaattcctcccccgctggttttccatagttgagggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgtctgaaggatggtgctggggatgtggcctttgtcaagcactcgactatatttgagaacttggcaaacaaggctgacagggaccagtatgagctgctttgcctggacaacacccggaagccggtagatgaatacaaggactgccacttggcccaggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaaggactctgcccacgggtttttaaaagtcccccccaggatggatgccaagatgtacctgggctatgagtatgtcactgccatccggaatctacgggaaggcacatgcccagaagccccaacagatgaatgcaagcctgtgaagtggtgtgcgctgagccaccacgagaggctcaagtgtgatgagtggagtgttaacagtgtagggaaaatagagtgtgtatcagcagagaccaccgaagactgcatcgccaagatcatgaatggagaagctgatgccatgagcttggatggagggtttgtctacatagcgggcaagtgtggtctggtgcctgtcttggcagaaaactacaataagagcgataattgtgaggatacaccagaggcagggtattttgctatagcagtggtgaagaaatcagcttctgacctcacctgggacaatctgaaaggcaagaagtcctgccatacggcagttggcagaaccgctggctggaacatccccatgggcctgctctacaataagatcaaccactgcagatttgatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaa

SEQ ID NO: 10920 - DNA, 470 bp, synthetic construct
  misc_feature 1..470: note = Synthetic polypeptide
  source 1..470: mol_type = other DNA
gagtagcagacccagagtctggagacccagattctaggcctggcttggccaacgacaagcagggtgaccttgggttaaaaaaaaaaaaaggcatcattctctgagtctcactccctcttctcaaaaagatggcaattcctcccccgctggttttccatagttgagggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggtaagtcgctgctgcctaaaagagagtggaagaaagccatactttctctgtttccagtcactttggaacaattctttactcacaggcaaacgaagcggatgctgtgacactggatgcaggtttggtgtatga

SEQ ID NO: 10921 - DNA, 485 bp, synthetic construct
  misc_feature 1..485: note = Synthetic polypeptide
  source 1..485: mol_type = other DNA
gagtagcagacccagagtctggagacccagattctaggcctggcttggccaacgacaagcagggtgaccttgggttaaaaaaaaaaaaaggcatcattctctgagtctcactccctcttctcaaaaagatggcaattcctcccccgctggttttccatagttgagggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggactttctattatgctgttgctgtggtgaagaaggatag

SEQ ID NO: 10922 - DNA, 431 bp, synthetic construct
  misc_feature 1..431: note = Synthetic polypeptide
  source 1..431: mol_type = other DNA
gagtagcagacccagagtctggagacccagattctaggcctggcttggccaacgacaagcagggtgaccttgggttaaaaaaaaaaaaaggcatcattctctgagtctcactccctcttctcaaaaagatggcaattcctcccccgctggttttccatagttgagggctgtgtctggctgtccctgataaaactgtgagatggtgtgcagtgtcggagcatgaggccactaagtgccagagtttccgcgaccatatgaaaagcgtcattccatccgatggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaa

SEQ ID NO: 10923 - DNA, 470 bp, synthetic construct; identical to SEQ ID NO: 9114
  misc_feature 1..470: note = Synthetic polypeptide
  source 1..470: mol_type = other DNA

SEQ ID NO: 10924 - DNA, 134 bp, synthetic construct; identical to SEQ ID NO: 9115
  misc_feature 1..134: note = Synthetic polypeptide
  source 1..134: mol_type = other DNA

SEQ ID NO: 10925 - DNA, 83 bp, synthetic construct
  misc_feature 1..83: note = Synthetic polypeptide
  source 1..83: mol_type = other DNA
cgcccttctcgctctccgtttccttgcctgtggaataaggactggcattgcggactgacctccagggagaggcccagatctga

SEQ ID NO: 10926 - DNA, 555 bp, synthetic construct
  misc_feature 1..555: note = Synthetic polypeptide
  source 1..555: mol_type = other DNA
cgcccttctcgctctccgtttccttgcctgtggaataaggactggcattgcggactgacctccagggagaggcccagatctgatctgcagagatctcccttccggctatcgtggctgctgttcaggtggtggagaagaagatggaaccccaggctgcctggctacagagcctggagggatgcatgtggacagccaagaagaagctggctgactgcgagaaggtggctgtggagttcgggaaccagctggagggccctggttaatggtggagccagcctggtgtgtggcagccaggtcgggctggtgtcttcagagtggctgtgtcagaagggcctcgtgtatgacagaaacgcaggccagctggaacgtccccaggcgttctgtcctggatcaagcaagaggaaggggcaagtgggaggagccagcagggcccacaggagaccactgtggcacacctgtgctcaggtaaggcatgctgggccatgtctcctcaggcctgtatccctgggccttaggagacatggcgtcccctggggggcctcacagcgcctctag

SEQ ID NO: 10927 - DNA, 1084 bp, synthetic construct; identical to SEQ ID NO: 580
  misc_feature 1..1084: note = Synthetic polypeptide
  source 1..1084: mol_type = other DNA

SEQ ID NO: 10928 - DNA, 4725 bp, synthetic construct
  misc_feature 1..4725: note = Synthetic polypeptide
  source 1..4725: mol_type = other DNA
aagatggccaactagctggatctgggatgcacctcttctacagagaggaaccaaaatattgagtaaaccctcacactttcaacagatcttttgagagaaaacactgaaatttaatatataggccatgacagacatgattgaagaagtaggaagcaacactgctggctcagtattgccagacaccttaggaccagaatggacccaaggaaggtgtgagtgaagaaacccgggaacaccactttcccactgtcaacctctgaaattctagaggagttcccacaacccctgaatacgtttggattggtaggaggagctgcctggagaccatacagaggcactacttgaagccacaaggagcccaaaagccttcagtgtgctaggcagctgcagcaaaacgtgactctgggcacccacccccgagtgccctgcatccgagcggctacatctgctgtctgccacaccaggatagagtggggcccatgcatgttcacatgaccaattcaggatccaccaccattcctgcaggactgaggtgaatctaaaccacacacgaccatgcctgccagtccctcctaagattgcctgcctggccattgctgtggagtgggacccacagcatagcctccattgccccacctgagtggtttattggctacctgggaacactttactcctcctatcactgccagtggttgatcctaaggagccagaggacaaatccactggcctggtctcagtttgccaggactcaagcataccacccaggaatatggggatgagatctgtggcctgatctcaagcaggggaggaacccccactgtcagaacacagggaagagtgtggtgtgggtttttcaggtggtacagaagctgggcacccctcccttcatgagaatagactaggaagggtatagcctcatagccttgctttctgctgcagggagtcttgcattctggaatgcctgggatggcatggcagtctgggcacaggtggtttgggatttgcataactaattgggccggctgccagggtggacactggagggagacccaccagtcaggggtgtagaagctgagtgggcctcatggccatctgctggaatgaaatcccagggctagccctcttaccctgaaccagctcttgtggcacagaagaggtgcctgcacccctccctagagtgttgttccagctgcctgagaactgcccctacagccctaccaaggtcacgtctgcctcagagagcctgatcacgggctcaccagacccagtcccacccagctttgccccctctagccagccttgggagcagagcatgggatgggaccactgagagctccacaccccccacccatcaccaagaacactcttgtattccttatcaacaaaggccaagtaaaaatcccactgtcatcactgcagctgcctctcacctgccagcatcacctactggccaggaggtcaaaactgcatgtcctgtcgcagcaactgttgatatcattgcacagcactcagacagctcttacctgcaggcatcacctgctggcctgtagggtgaactgcacaacccaatataattcctgctgacaagtacacagctctaaggaatgaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaa

SEQ ID NO: 10929 - DNA, 2215 bp, synthetic construct
  misc_feature 1..2215: note = Synthetic polypeptide
  source 1..2215: mol_type = other DNA
aagatggccaactagctggatctgggatgcacctcttctacagagaggaaccaaaatattgagtaaaccctcacactttcaacagatcttttgagagaaaacactgaaatttaatatataggccatgacagacatgattgaagaagtaggaagcaacactgctggctcagtattgccagacaccttaggaccagaatggacccaaggaaggtgtgagtgaagaaacccgggaacaccactttcccactgtcaacctctgaaattctagaggagttcccacaacccctgaatacgtttggattggtaggaggagctgcctggagaccatacagaggcactacttgaagccacaaggagcccaaaagccttcagtgtgctaggcagctgcagcaaaacgtgactctgggcacccacccccgagtgccctgcatccgagcggctacatctgctgtctgccacaccaggatagagtggggcccatgcatgttcacatgaccaattcaggatccaccaccattcctgcaggactgaggtgaatctaaaccacacacgaccatgcctgccagtccctcctaagattgcctgcctggccattgctgtggagtgggacccacagcatagcctccattgccccacctgagtggtttattggctacctgggaacactttactcctcctatcactgccagtggttgatcctaaggagccagaggacaaatccactggcctggtctcagtttgccaggactcaagcataccacccaggaatatggggatgagatctgtggcctgatctcaagcaggggaggaacccccactgtcagaacacagggaagagtgtggtgtgggtttttcaggtggtacagaagctgggcacccctcccttcatgagaatagactaggaagggtatagcctcatagccttgctttctgctgcagggagtcttgcattctggaatgcctgggatggcatggcagtctgggcacaggtggtttgggatttgcataactaattgggccggctgccagggtggacactggagggagacccaccagtcaggggtgtagaagctgagtgggcctcatggccatctgctggaatgaaatcccagggctagccctcttaccctgaaccagctcttgtggcacagaagaggtgcctgcacccctccctagagtgttgttccagctgcctgagaactgcccctacagccctaccaaggtcacgtctgcctcagagagcctgatcacgggctcaccagacccagtcccacccagctttgccccctctagccagccttgggagcagagcatgggatgggaccactgagagctccacaccccccacccatcaccaagaacactcttgtattccttatcaacaaaggccaagtaaaaatcccactgtcatcactgcagctgcctctcacctgccagcatcacctactggccaggaggtcaaaactgcatgtcctgtcgcagcaactgttgatatcattgcacagcactcagacagctcttacctgcaggcatcacctgctggcctgtagggtgaactgcacaacccaatataattcctgctgacaagtacacagctctaaggaatgaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagca

SEQ ID NO: 10930 - DNA, 2826 bp, synthetic construct
  misc_feature 1..2826: note = Synthetic polypeptide
  source 1..2826: mol_type = other DNA
aagatggccaactagctggatctgggatgcacctcttctacagagaggaaccaaaatattgagtaaaccctcacactttcaacagatcttttgagagaaaacactgaaatttaatatataggccatgacagacatgattgaagaagtaggaagcaacactgctggctcagtattgccagacaccttaggaccagaatggacccaaggaaggtgtgagtgaagaaacccgggaacaccactttcccactgtcaacctctgaaattctagaggagttcccacaacccctgaatacgtttggattggtaggaggagctgcctggagaccatacagaggcactacttgaagccacaaggagcccaaaagccttcagtgtgctaggcagctgcagcaaaacgtgactctgggcacccacccccgagtgccctgcatccgagcggctacatctgctgtctgccacaccaggatagagtggggcccatgcatgttcacatgaccaattcaggatccaccaccattcctgcaggactgaggtgaatctaaaccacacacgaccatgcctgccagtccctcctaagattgcctgcctggccattgctgtggagtgggacccacagcatagcctccattgccccacctgagtggtttattggctacctgggaacactttactcctcctatcactgccagtggttgatcctaaggagccagaggacaaatccactggcctggtctcagtttgccaggactcaagcataccacccaggaatatggggatgagatctgtggcctgatctcaagcaggggaggaacccccactgtcagaacacagggaagagtgtggtgtgggtttttcaggtggtacagaagctgggcacccctcccttcatgagaatagactaggaagggtatagcctcatagccttgctttctgctgcagggagtcttgcattctggaatgcctgggatggcatggcagtctgggcacaggtggtttgggatttgcataactaattgggccggctgccagggtggacactggagggagacccaccagtcaggggtgtagaagctgagtgggcctcatggccatctgctggaatgaaatcccagggctagccctcttaccctgaaccagctcttgtggcacagaagaggtgcctgcacccctccctagagtgttgttccagctgcctgagaactgcccctacagccctaccaaggtcacgtctgcctcagagagcctgatcacgggctcaccagacccagtcccacccagctttgccccctctagccagccttgggagcagagcatgggatgggaccactgagagctccacaccccccacccatcaccaagaacactcttgtattccttatcaacaaaggccaagtaaaaatcccactgtcatcactgcagctgcctctcacctgccagcatcacctactggccaggaggtcaaaactgcatgtcctgtcgcagcaactgttgatatcattgcacagcactcagacagctcttacctgcaggcatcacctgctggcctgtagggtgaactgcacaacccaatataattcctgctgacaagtacacagctctaaggaatgaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaattta

SEQ ID NO: 10931 - DNA, 2229 bp, synthetic construct
  misc_feature 1..2229: note = Synthetic polypeptide
  source 1..2229: mol_type = other DNA
aagatggccaactagctggatctgggatgcacctcttctacagagaggaaccaaaatattgagtaaaccctcacactttcaacagatcttttgagagaaaacactgaaatttaatatataggccatgacagacatgattgaagaagtaggaagcaacactgctggctcagtattgccagacaccttaggaccagaatggacccaaggaaggtgtgagtgaagaaacccgggaacaccactttcccactgtcaacctctgaaattctagaggagttcccacaacccctgaatacgtttggattggtaggaggagctgcctggagaccatacagaggcactacttgaagccacaaggagcccaaaagccttcagtgtgctaggcagctgcagcaaaacgtgactctgggcacccacccccgagtgccctgcatccgagcggctacatctgctgtctgccacaccaggatagagtggggcccatgcatgttcacatgaccaattcaggatccaccaccattcctgcaggactgaggtgaatctaaaccacacacgaccatgcctgccagtccctcctaagattgcctgcctggccattgctgtggagtgggacccacagcatagcctccattgccccacctgagtggtttattggctacctgggaacactttactcctcctatcactgccagtggttgatcctaaggagccagaggacaaatccactggcctggtctcagtttgccaggactcaagcataccacccaggaatatggggatgagatctgtggcctgatctcaagcaggggaggaacccccactgtcagaacacagggaagagtgtggtgtgggtttttcaggtggtacagaagctgggcacccctcccttcatgagaatagactaggaagggtatagcctcatagccttgctttctgctgcagggagtcttgcattctggaatgcctgggatggcatggcagtctgggcacaggtggtttgggatttgcataactaattgggccggctgccagggtggacactggagggagacccaccagtcaggggtgtagaagctgagtgggcctcatggccatctgctggaatgaaatcccagggctagccctcttaccctgaaccagctcttgtggcacagaagaggtgcctgcacccctccctagagtgttgttccagctgcctgagaactgcccctacagccctaccaaggtcacgtctgcctcagagagcctgatcacgggctcaccagacccagtcccacccagctttgccccctctagccagccttgggagcagagcatgggatgggaccactgagagctccacaccccccacccatcaccaagaacactcttgtattccttatcaacaaaggccaagtaaaaatcccactgtcatcactgcagctgcctctcacctgccagcatcacctactggccaggaggtcaaaactgcatgtcctgtcgcagcaactgttgatatcattgcacagcactcagacagctcttacctgcaggcatcacctgctggcctgtagggtgaactgcacaacccaatataattcctgctgacaagtacacagctctaaggaatgaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatc

SEQ ID NO: 10932 - DNA, 96 bp, synthetic construct
  misc_feature 1..96: note = Synthetic polypeptide
  source 1..96: mol_type = other DNA
tgatggctcagagcatgattctggaggcagctagctaggtcggaatttgctttgccgcatggaagctgtgccatcctggtaggacgcctcgtctaa

SEQ ID NO: 10933 - DNA, 294 bp, synthetic construct
  misc_feature 1..294: note = Synthetic polypeptide
  source 1..294: mol_type = other DNA
agtctaatcctttccaccttcccatcctcccttatatcactcctcttctatatttccctcagctatgctgattttctcttattttcagtgccaagctactttctggtctttacatttctgttctctccctcaaaggttttctactctcatgaatccccactctgtcttgatgtacctgtgtggtctaagctggaatctggtcaccttccatccatgcaacaacttgttcaaattcttgacaatgaaatgaagctcaatgtgcatatggattcaatcccacaccatcgatcatag

SEQ ID NO: 10934 - DNA, 792 bp, synthetic construct; identical to SEQ ID NO: 9094
  misc_feature 1..792: note = Synthetic polypeptide
  source 1..792: mol_type = other DNA

SEQ ID NO: 10935 - DNA, 699 bp, synthetic construct; identical to SEQ ID NO: 9095
  misc_feature 1..699: note = Synthetic polypeptide
  source 1..699: mol_type = other DNA

SEQ ID NO: 10936 - DNA, 1506 bp, synthetic construct
  misc_feature 1..1506: note = Synthetic polypeptide
  source 1..1506: mol_type = other DNA
tgacgtaatttgcacatctgtccttacctaaatctcatgttgaattgtaatcccctatgctggaggtttggcctggtgaaagatcacaggggtggatccatcatgaatggcttgggccatctccttggtggtaactgagctcttgctctatgttcacacatgatatggtcatttgcaagtttgtcccaccaccccctccactctttctctcttgctcctgctctgaccatgtgctgtgcctgctcccacttctccttccgccatgattgtaagcttcctgaggcctcccagaagccaagcagatgccagtcccatgcttcctgtaaaggctgcagaactgtgagccaatgaaacctcttttctttataaattacccagaatcaggacatagttgacggcaaggaaaaagaaggacaagaacttggaactgcggattgctctgtccctggggacccagaaggactggagactgcaaaggacgattcccaggcagcagctatagcagagaataataattccatcatgagtttctttaaaactctggtttcacctaacaaagctgaaacaaaaaaggacccagaagacacggcatcgaaagcagaaagtgtctgtgatggacaagctggtcagaagacatccgagatccaggctagaggcaccaagaaaaagcacctggatagccccaggctaggactcgcctttagaaaattctttaggcataagggtgctgaaaagtcacccaccacttcagctgaccttaagtcagacaaagccaactttacatcccaggagacccaaggggctggcaagaattccaaaggatgcaacccatcggggcacacacagtccgtgacaacccctgaacctgcgaaggaaggcaccaaggagaaatcaggacccacctctctgcctctgggcaaactgttttggaaaaaggtggtgtgtgagtcaccagtagagattataaagtccaaggaagtagaatcagccttacaaacagtggacctcaacgaaggagatgctgcacctgaacccacagaagcgaaactcaaaagagaagaaagcaaaccaagaacctctctgatggcgtttctcagacaaatgacatcagactccacagaaaagactatcacaccgccagagcctgaaccaacaggagcaccacagaagggtaaagagggctcctcgaaggacaagaagtcagcagccgagatgaacaagcagaagagcaacaagcaggaagccaaagaaccagcccagtgcacagagcaggccacggtggacacgaactcactgcagaatggggacaagctccaaaagagacctgagaagcggcagcagtcccttgggggcttctttaaaggcctgggaccaaagcggatgttggatgctcaagtgcaaacagacccagtatccatcggaccagttggcaaatccaagtacacagggaagtgtgtcttctcccatgtcaagaagaagtggcctttccaggaatggagctattga

SEQ ID NO: 10937 - DNA, 1182 bp, synthetic construct
  misc_feature 1..1182: note = Synthetic polypeptide
  source 1..1182: mol_type = other DNA
tgacgtaatttgcacatctgtccttacctaaatctcatgttgaattgtaatcccctatgctggaggtttggcctggtgaaagatcacaggggtggatccatcatgaatggcttgggccatctccttggtggtaactgagctcttgctctatgttcacacatgatatggtcatttgcaagtttgtcccaccaccccctccactctttctctcttgctcctgctctgaccatgtgctgtgcctgctcccacttctccttccgccatgattgtaagcttcctgaggcctcccagaagccaagcagatgccagtcccatgcttcctgtaaaggctgcagaactgtgagccaatgaaacctcttttctttataaattacccagaatcaggacatagttgacggcaaggaaaaagaaggacaagaacttggaactgcggattgctctgtccctggggacccagaaggactggagactgcaaaggacgattcccaggcagcagctatagcagagaataataattccatcatgagtttctttaaaactctggtttcacctaacaaagctgaaacaaaaaaggacccagaagacacgggtgctgaaaagtcacccaccacttcagctgaccttaagtcagacaaagccaactttacatcccaggagacccaaggggctggcaagaattccaaaggatgcaacccatcggggcacacacagtccgtgacaacccctgaacctgcgaaggaaggcaccaaggagaaatcaggacccacctctctgcctctgggcaaactgttttggaaaaagtcagttaaagaggactcagtccccacaggtgcggaggagaatacatcagactccacagaaaagactatcacaccgccagagcctgaaccaacaggagcaccacagaagggtaaagagggctcctcgaaggacaagaagtcagcagccgagatgaacaagcagaagagcaacaagcaggaagccaaagaaccagcccagtgcacagagcaggccacggtggacacgaactcactgcagaatggggacaagctccaaaagagacctgagaagcggcagcagtcccttgggggcttctttaaaggcctgggaccaaagcggatgttggatgctcaagtgcaaacagacccagtatccatcggaccagttggcaaatccaagtaa

SEQ ID NO: 10938 - DNA, 1416 bp, synthetic construct
  misc_feature 1..1416: note = Synthetic polypeptide
  source 1..1416: mol_type = other DNA
tgacgtaatttgcacatctgtccttacctaaatctcatgttgaattgtaatcccctatgctggaggtttggcctggtgaaagatcacaggggtggatccatcatgaatggcttgggccatctccttggtggtaactgagctcttgctctatgttcacacatgatatggtcatttgcaagtttgtcccaccaccccctccactctttctctcttgctcctgctctgaccatgtgctgtgcctgctcccacttctccttccgccatgattgtaagcttcctgaggcctcccagaagccaagcagatgccagtcccatgcttcctgtaaaggctgcagaactgtgagccaatgaaacctcttttctttataaattacccagaatcaggacatagttgacggcaaggaaaaagaaggacaagaacttggaactgcggattgctctgtccctggggacccagaaggactggagactgcaaaggacgattcccaggcagcagctatagcagagaataataattccatcatgagtttctttaaaactctggtttcacctaacaaagctgaaacaaaaaaggacccagaagacacgggtgctgaaaagtcacccaccacttcagctgaccttaagtcagacaaagccaactttacatcccaggagacccaaggggctggcaagaattccaaaggatgcaacccatcggggcacacacagtccgtgacaacccctgaacctgcgaaggaaggcaccaaggagaaatcaggacccacctctctgcctctgggcaaactgttttggaaaaagtcagttaaagaggactcagtccccacaggtgcggaggagaatgtggtgtgtgagtcaccagtagagattataaagtccaaggaagtagaatcagccttacaaacagtggacctcaacgaaggagatgctgcacctgaacccacagaagcgaaactcaaaagagaagaaagcaaaccaagaacctctctgatggcgtttctcagacaaatgtcagtgaaaggggatggagggatcacccactcagaagaaataaatgggaaagactccagctgccaaacatcagactccacagaaaagactatcacaccgccagagcctgaaccaacaggagcaccacagaagggtaaagagggctcctcgaaggacaagaagtcagcagccgagatgaacaagcagaagagcaacaagcaggaagccaaagaaccagcccagtgcacagagcaggccacggtggacacgaactcactgcagaatggggacaagctccaaaagagacctgagaagcggcagcagtcccttgggggcttctttaaaggcctgggaccaaagcggatgttggatgctcaagtgcaaacagacccagtatccatcggaccagttggcaaatccaagtaa

SEQ ID NO: 10939 - DNA, 166 bp, synthetic construct
  misc_feature 1..166: note = Synthetic polypeptide
  source 1..166: mol_type = other DNA
tggttctcaaagtgtggttcccagaacagcagcttcagcatcacctgagtttttaaaattgcatatccatccttggactcctccccagacctactgaatcagaaactctggagacgttttctttggaccaaagatctctttcgtgattccttgcaacaatcaatga

SEQ ID NO: 10940 - DNA, 213 bp, synthetic construct; identical to SEQ ID NO: 9051
  misc_feature 1..213: note = Synthetic polypeptide
  source 1..213: mol_type = other DNA

SEQ ID NO: 10941 - DNA, 291 bp, synthetic construct
  misc_feature 1..291: note = Synthetic polypeptide
  source 1..291: mol_type = other DNA
tgcagtggagagagcatagcacagcagtcaagtcccatggagcatttcaaacctactcttccacttcctgtcattggcccttgggatagtgttgagtttagaaacatctgcagtcatttggctctacagattgaaggacagcagtttgacagagacttgaatgctgcccaccagtgtttgaagacaatagtcaagaagctgattcagtcacttgctaattttccttcagatgcccacatggtagcctgtgcttccttgagacagatcttacagaatctcccagacatatga

SEQ ID NO: 10942 - DNA, 646 bp, synthetic construct; identical to SEQ ID NO: 7772
  misc_feature 1..646: note = Synthetic polypeptide
  source 1..646: mol_type = other DNA

SEQ ID NO: 10943 - DNA, 304 bp, synthetic construct; identical to SEQ ID NO: 7773
  misc_feature 1..304: note = Synthetic polypeptide
  source 1..304: mol_type = other DNA

SEQ ID NO: 10944 - DNA, 619 bp, synthetic construct; identical to SEQ ID NO: 7774
  misc_feature 1..619: note = Synthetic polypeptide
  source 1..619: mol_type = other DNA

SEQ ID NO: 10945 - DNA, 523 bp, synthetic construct; identical to SEQ ID NO: 7775
  misc_feature 1..523: note = Synthetic polypeptide
  source 1..523: mol_type = other DNA

SEQ ID NO: 10946 - DNA, 441 bp, synthetic construct; identical to SEQ ID NO: 7776
  misc_feature 1..441: note = Synthetic polypeptide
  source 1..441: mol_type = other DNA

SEQ ID NO: 10947 - DNA, 167 bp, synthetic construct; identical to SEQ ID NO: 7777
  misc_feature 1..167: note = Synthetic polypeptide
  source 1..167: mol_type = other DNA

SEQ ID NO: 10948 - DNA, 1040 bp, synthetic construct
  misc_feature 1..1040: note = Synthetic polypeptide
  source 1..1040: mol_type = other DNA
ctatgcagccataaaaaatgatgagttcatgtcctttgtagggacatggatgaagctggaaaccatcattctcagcaaactatcgccaggacgaaaaaccaaacaccacatgttctcactcatagcttgtcatcatggctgggacagtgctgcttgcctactacttcgaatgcactgacacttttcaggtgcatatccaaggattcttctgtcaggacggagacttaatgaagccttacccagggacagaggaagaaagcttcatcacccctctggtgctctattgtgtgctggctgccaccccaactgctattatttttattggtgagatatccatgtatttcataaaatcaacaagagaatccctgattgctcaggagaaaacaattctgaccggagaatgctgttacctgaaccccttacttcgaaggatcataagattcacaggggtgtttgcatttggactttttgctactgacatttttgtaaacgccggacaagtggtcactgggcacttaacgccatacttcctgactgtgtgcaagccaaactacaccagtgcagactgccaagcgcaccaccagtttataaacaatgggaacatttgtactggggacctggaagtgatagaaaaggctcggagatcctttccctccaaacacgctgctctgagcatttactccgccttatatgccacgatgtatattacaagcacaatcaagacgaagagcagtcgactggccaagccggtgctgtgcctcggaactctctgcacagccttcctgacaggcctcaaccgggtctctgagtatcggaaccactgctcggacgtgattgctggtttcatcctgggcactgcagtggccctgtttctgggaatgtgtgtggttcataactttaaaggaacgcaaggatctccttccaaacccaagcctgaggatccccgtggagtacccctaatggctttcccaaggatagaaagccctctggaaaccttaagtgcacagaatcactctgcgtccatgaccgaagttacctga

SEQ ID NO: 10949 - DNA, 371 bp, synthetic construct
  misc_feature 1..371: note = Synthetic polypeptide
  source 1..371: mol_type = other DNA
ctatgcagccataaaaaatgatgagttcatgtcctttgtagggacatggatgaagctggaaaccatcattctcagcaaactatcgccaggacgaaaaaccaaacaccacatgttctcactcatagcttgtcatcatggctgggacagtgctgcttgcctactacttcgaatgcactgacacttttcaggtgcatatccaaggattcttctgtcaggacggagacttaatgaagccttacccagggacagaggaagaaagcttcatcacccctctggtgctctattgtgtgctggctgccaccccaactgctattatttttattggtgagatatccatgtatttcataaaatcaacaagagaatccctgatt

SEQ ID NO: 10950 - DNA, 233 bp, synthetic construct
  misc_feature 1..233: note = Synthetic polypeptide
  source 1..233: mol_type = other DNA
aatgtggcgccgtgagaaaagccggggacctggagtctgggagacatgagcgcatgattgcaaatacggccagaacagtgagatactacaggagccaacccttcaatcctgatgcagctcaagctaataagaaccatcaggatgtccggagttatgtacggcaattaaatgtgattgacaaccagagaactttatcacagatgtcacacagattagagcctcgtcgaccatag

SEQ ID NO: 10951 - DNA, 517 bp, synthetic construct
  misc_feature 1..517: note = Synthetic polypeptide
  source 1..517: mol_type = other DNA
gcttcttcctctacctcctccctctggcctctggcctctggcccagaggcagcctactctgcagctggccgagatctttcccacctcacactgttccccctgcctggaatgttctcccgcccacgcttcgagcggctgacgactcatccttggggcctcgacttacatggactcctccaccaggcctttgctgacctcctcatctaaatttggttcctgggcctgctcccctgggcactctatccatcctttccttcccagcgcctgtgagtgtatcgggctcctgacaaccatggccatcctcctgcatgagatcccccatgaggtgggcgactttgccatcctgctccgggccggctttgaccgatggagcgcagccaagctgcaactctcaacagcgctggggggcctactgggcgctggcttcgccatctgtacccagtcccccaagggaaggagacggcagcctgggtcctgcccttcacctctggcggctttctctacatcgccttggtga

SEQ ID NO: 10952 - DNA, 423 bp, synthetic construct
  misc_feature 1..423: note = Synthetic polypeptide
  source 1..423: mol_type = other DNA
gcttcttcctctacctcctccctctggcctctggcctctggcccagaggcagcctactctgcagctggccgagatctttcccacctcacactgttccccctgcctggaatgttctcccgcccacgcttcgagcggctgacgactcatccttggggcctcgacttacatggactcctccaccaggcctttgctgacctcctcatctaaatttggttcctgggcctgctcccctgggcactctatccatcctttccttcccagcgcctgtgagtgtatcgggctcctgacaaccatggccatcctcctgcatgagatcccccatgaggtgggcgactttgccatcctgctccgggccggctttgaccgatggagcgcagccaagctgcaactctcaacagcgctggggggcctactgggcgctgg

SEQ ID NO: 10953 - DNA, 655 bp, synthetic construct
  misc_feature 1..655: note = Synthetic polypeptide
  source 1..655: mol_type = other DNA
gcttcttcctctacctcctccctctggcctctggcctctggcccagaggcagcctactctgcagctggccgagatctttcccacctcacactgttccccctgcctggaatgttctcccgcccacgcttcgagcggctgacgactcatccttggggcctcgacttacatggactcctccaccaggcctttgctgacctcctcatctaaatttggttcctgggcctgctcccctgggcactctatccatcctttccttcccagcgcctgtgagtgtatcgggctcctgacaaccatggccatcctcctgcatgagatcccccatgaggtgggcgactttgccatcctgctccgggccggctttgaccgatggagcgcagccaagctgcaactctcaacagcgctggggggcctactgggcgctggcttcgccatctgtacccagtcccccaagggagtagttgggtgttctcccgctgcagaggagacggcagcctgggtcctgcccttcacctctggcggctttctctacatcgccttggtgaacgtgctccctgacctcttggaagaagaggacccgtggcgctccctgcagcagctgcttctgctctgtgcgggcatcgtggtaatggtgctgttctcgctcttcgtggattaa

SEQ ID NO: 10954 - DNA, 634 bp, synthetic construct
  misc_feature 1..634: note = Synthetic polypeptide
  source 1..634: mol_type = other DNA
gcttcttcctctacctcctccctctggcctctggcctctggcccagaggcagcctactctgcagctggccgagatctttcccacctcacactgttccccctgcctggaatgttctcccgcccacgcttcgagcggctgacgactcatccttggggcctcgacttacatggactcctccaccaggcctttgctgacctcctcatctaaatttggttcctgggcctgctcccctgggcactctatccatcctttccttcccagcgcctgtgagtgtatcgggctcctgacaaccatggccatcctcctgcatgagatcccccatgaggtgggcgactttgccatcctgctccgggccggctttgaccgatggagcgcagccaagctgcaactctcaacagcgctggggggcctactgggcgctggcttcgccatctgtacccagtcccccaagggagtagaggagacggcagcctgggtcctgcccttcacctctggcggctttctctacatcgccttggtgaacgtgctccctgacctcttggaagaagaggacccgtggcgctccctgcagcagctgcttctgctctgtgcgggcatcgtggtaatggtgctgttctcgctcttcgtggattaa

SEQ ID NO: 10955 - DNA, 355 bp, synthetic construct
  misc_feature 1..355: note = Synthetic polypeptide
  source 1..355: mol_type = other DNA
tggagtcagatccaactgtgctgaatctggaacctactactttctagctgtgtgaactggggcagttccttaatgtctctggtcccttccataaaatgggaacaataacgcctgcttctcagctctctgcgcccttgttgccaccatctggttccctgtgtgcgcccaccgtgagaccaccatcgtgagctttggctactccctgtatgcaggctggattggtgctgtgctgtgcctcgtgggtggctgtgtcatcctctgctgcgctggagatgcccaggcctttggtgaaaaccgtttctactacactgcgggctctagctccccgactcatgcgaagagtgcccacgtataa

SEQ ID NO: 10956 - DNA, 3786 bp, synthetic construct
  misc_feature 1..3786: note = Synthetic polypeptide
  source 1..3786: mol_type = other DNA
tatttttgaaaaaacaaaggaaaaggaagactttctcaaatttacaaaagctgaaagactatcaacagcagacctgtgtcgtaagaaatgtcaagccattgaggtcaaaggaaaaagataacaggtggaaatctggatctacataaaggaatgaagaacaatggaaataataaatataaaagacttattttaaaaattctcttccaaggaaaacctcacagcacgggtagctctgaacggattcagctctcaggaatgtataatgtccgtaaaggcaagatgcagttgccagtgaaccgatggacaagacgccaagtcatcctatgtgggacctgcctgatagtatcatctgtgaaagacagcttgaccggaaagatgcatgttctgccactaattggtggaaaagtagaagaagtgaaaaagcaccaacactgtttagcatttagctcctctggaccccaaagccagacttactacatttgctttgatactttcacagaatacttaaggtggctgcgacaagtctccaaggttgcatcccagcgcattagctcagtggacctctcgtgttgtagcctggaacatctgcctgccaacctcttctacagccaagacctcactcatctcaatttaaaacaaaacttcctaaggcagaaccctagccttccagctgccagggggcttaatgaactgcaaaggttcaccaagttgaagagtcttaacctttccaataatcatttaggggacttcccactggcagtctgcagtattccaaccctggcagagctgaacgtgtcctgcaatgccctgcgatcagtcccggcagccgttggagtgatgcacaacttacagacatttttgttggatggaaactttctccaatcccttcctgctgagttggagaacatgaagcagcttagttatctgggtctttctttcaatgaatttactgacattcccgaagtattggagaaattgactgctgtggataaactttgtatgtctggaaactgtgtggagacccttaggctacaggctttaagaaaaatgcctcacattaaacatgtggatctaaggttgaacgtaattaggaagctgatagcagatgaagtggactttctacagcatgttactcagcttgacctacgagacaataagcttggtgatctagatgctatgattttcaacaacattgaagttttacactgtgaaaggaatcaactggtcacattagacatctgtggctatttcctaaaagcgctctatgcctcttctaatgaacttgttcaacttgatgtttacccagttccaaattatctgtcctacatggatgtttcaaggaaccgcttagaaaatgtgcctgagtgggtatgtgaaagccgaaagctagaagttttggatattggccataatcaaatatgtgaacttcctgcccgcttattttgtaatagcagtctccggaaactactggcaggacacaaccagttggcaaggctgcctgaaaggctagaaagaacctcggtggaggtcttggatgtgcaacacaaccagctccttgagctcccacctaaccttctgatgaaggctgacagcctgagattcctgaacgcctctgcgaacaaactggaaagccttcctccagccacgctttccgaagagacaaacagtatcttacaagagttgtatttgacaaataacagcctcacagacaaatgtgtgcccttgttaacgggacacccccatttgaagatccttcacatggcctataaccgacttcagagttttccagcaagtaaaatggcgaaactggaggaacttgaagaaattgatctcagtgggaataagctgaaagccatcccaacaacgatcatgaattgcaggcgcatgcacaccgtgattgctcactccaactgcatcgaggtctttcccgaagttatgcagctcccagagatcaagtgtgtggacctgagctgtaatgagctaagtgaagtcacattaccagaaaacctgcctcccaaactgcaggagctagacctgactggaaacccgcgccttgtccttgatcacaaaaccctggaactactgaataatatccgctgtttcaagattgatcagccttctacaggagacgcttccggagccccagctgtatggagtcatggttacactgaagcttcgggggtaaaaaacaagttgtgtgtcgcagccctgtcggtgaataacttctgtgacaaccgcgaagccctgtatggtgtgtttgacggagaccggaatgtggaggtgccctaccttctccagtgcactatgagtgacattttggctgaagagctgcaaaaaacaaaaaacgaagaagaatacatggtcaatacattcattgtcatgcaaaggaaacttggaactgctgggcagaagcttggtggtgccgctgtcctttgtcatatcaagcatgaccctgtggatccaggaggatccttcaccttgacctctgctaatgtgggcaagtgccaaacagttctctgtcgaaatggaaagccgctgcctctgtccagatcttacatcatgagctgtgaagaagagctgaagaggattaaacagcacaaggccattatcactgaggatggcaaggtgaacggagtgactgagtccacgcgcatcctgggctacaccttcctccatcccagtgtggtgcctcgcccccacgtgcagtccgtgctcctgactccccaggatgagttcttcatcctaggcagtaaggggttgtgggacagcctgtccgtcgaggaggccgtggaagccgtgcgcaacgtgcccgatgccctggctgctgccaagaagctgtgtaccctggcccagagctacggctgccacgacagcatcagcgctgtggtggtgcagctcagtgtcactgaggacagcttctgctgctgcgagctcagcgccggtggggctgtgccaccacccagtcctggcatctttcctccctcagtgaacatggtgatcaaggatcggccctcagatgggctgggcgtgccgtcctccagcagcggcatggcttccgagattagcagtgagctctccacttctgagatgagcagcgaggtggggtcaacagcctccgatgagcccccgcccggagccctaagcgagaacagccctgcctaccccagtgagcagcgctgcatgctccaccccatctgtctgtccaactccttccagcgccagctatccagcgccacgttctctagcgccttctccgacaacggccttgacagtgacgatgaggagcccatcgagggcgtcttcaccaacggcagccgggtggaggtggaggtggacatccactgcagccgggccaaggagaaggagaaacagcagcacctgcttcaggtgccagcagaggccagtgatgagggcattgtcatcagcgccaacgaggatgagccaggtctgcccaggaaggcagacttctctgccgttgggaccattgggcgccggagggccaatggctctgttgcgccccaggaaaggagccacaatgtgatagaggtggctacagacgcacctcttcgaaagcctggaggctattttgctgccccggctcagccggatcctgatgatcagtttatcatacccccggagctggaagaggaggtcaaagaaatcatgaagcatcaccaggagcaacagcagcagcagcagccgccaccaccccctcagctccagccgcagctgccgcggcactaccagctggaccagctgccagattattacgacacgccactatga

SEQ ID NO: 10957 - DNA, 1083 bp, synthetic construct; identical to SEQ ID NO: 7080
  misc_feature 1..1083: note = Synthetic polypeptide
  source 1..1083: mol_type = other DNA

SEQ ID NO: 10958 - DNA, 321 bp, synthetic construct
  misc_feature 1..321: note = Synthetic polypeptide
  source 1..321: mol_type = other DNA
ttcataagatggaataatatgcagcttttcaaagaatggatagatttatatgctgataggacaagattgccaagatgtgttactgagtgaaaaaggcaagggtggatccggattggtgccaatgtctccaacttcacttttgctcctagcacgattatatttcacctgggacatgctgctatgctgggactcatgtatgtctactggactcagctcaacatgttccagaccttgaagtacctggccatcctgggcagtgtgacgtttctggctggcaatcggatgctggcccagcaggcagtcaagagaacagcacattag

SEQ ID NO: 10959 - DNA, 369 bp, synthetic construct
  misc_feature 1..369: note = Synthetic polypeptide
  source 1..369: mol_type = other DNA
ttcataagatggaataatatgcagcttttcaaagaatggatagatttatatgctgataggacaagattgccaagatgtgttactgagtgaaaaaggcaagggtggatccggattggtgccaatgtctccaacttcacttttgctcctagcacgattatatttcacctgggacatgctgctatgctgggactcatgtatgtctactggactcagctcaacatgttccagaccttgaagtacctggccatcctgggcagtgtgacgtttctggctggcaatcggatgctggcccagcaggcagtcaagaggatcgctgcagagcagagcagtagattggcaaaatataggacactacgaacagcacattag

SEQ ID NO: 10960 - DNA, 294 bp, synthetic construct
  misc_feature 1..294: note = Synthetic polypeptide
  source 1..294: mol_type = other DNA
ttcataagatggaataatatgcagcttttcaaagaatggatagatttatatgctgataggacaagattgccaagatgtgttactgagtgaaaaaggcaagggtggatccggattggtgccaatgtctccaacttcacttttgctcctagcacgattatatttcacctgggacatgctgaacagcacattagttccagaagaaagatggaaattctgaaaactgaatgtcaagaaaaggagtcaagaacaattcacagtatgagaagaaaaatggaaaaaaaaaactttatttaa

SEQ ID NO: 10961 - DNA, 6676 bp, synthetic construct
  misc_feature 1..6676: note = Synthetic polypeptide
  source 1..6676: mol_type = other DNA
ccaggcatggtggctcaaactgtcatcccagcactttaggaggctgaggctggaggatcacttaagcccaggagtttgagactagtctgggcaacatagtgagatcccatttctacaaaaaataagagaaaatagctgaagacggtggcatgcacctgttgtcccaactactccagaggctgagatgcaaatctactgctttgatgcggaccgattttcaagttttgaggaagcagtcaaaggaaaagggaagttaagagctttatccattttgtttgaggttgggacagaagaaaatttggatttcaaagcgattattgatggagtcgaaagtgttagtcgttttgggaagcaggctgctttagatccattcatactgttgaaccttctgccaaactcaactgacaagtattacatttacaatggctcattgacatctcctccctgcacagacacagttgactggattgtttttaaagatacagttagcatctctgaaagccagttggctgttttttgtgaagttcttacaatgcaacaatctggttatgtcatgctgatggactacttacaaaacaattttcgagagcaacagtacaagttctctagacaggtgttttcctcatacactggaaaggaagagattcatgaagcagtttgtagttcagaaccagaaaatgttcaggctgacccagagaattataccagccttcttgttacatgggaaagacctcgagtcgtttatgataccatgattgagaagtttgcagttttgtaccagcagttggatggagaggaccaaaccaagcatgaatttttgacagatggctatcaagacttgggtgctattctcaataatttgctacccaatatgagttatgttcttcagatagtagccatatgcactaatggcttatatggaaaatacagcgaccaactgattgtcgacatgcctactgataatcctgaacttgatcttttccctgaattaattggaactgaagaaataatcaaggaggaggaagagggaaaagacattgaagaaggcgctattgtgaatcctggtagagacagtgctacaaaccaaatcaggaaaaaggaaccccagatttctaccacaacacactacaatcgcatagggacgaaatacaatgaagccaagactaaccgatccccaacaagaggaagtgaattctctggaaagggtgatgttcccaatacatctttaaattccacttcccaaccagtcactaaattagccacagaaaaagatatttccttgacttctcagactgtgactgaactgccacctcacactgtggaaggtacttcagcctctttaaatgatggctctaaaactgttcttagatctccacatatgaacttgtcggggactgcagaatccttaaatacagtttctataacagaatatgaggaggagagtttattgaccagtttcaagcttgatactggagctgaagattcttcaggctccagtcccgcaacttctgctatcccattcatctctgagaacatatcccaagggtatatattttcctccgaaaacccagagacaataacatatgatgtccttataccagaatctgctagaaatgcttccgaagattcaacttcatcaggttcagaagaatcactaaaggatccttctatggagggaaatgtgtggtttcctagctctacagacataacagcacagcccgatgttggatcaggcagagagagctttctccagactaattacactgagatacgtgttgatgaatctgagaagacaaccaagtccttttctgcaggcccagtgatgtcacagggtccctcagttacagatctggaaatgccacattattctacctttgcctacttcccaactgaggtaacacctcatgcttttaccccatcctccagacaacaggatttggtctccacggtcaacgtggtatactcgcagacaacccaaccggtatacaatggtgagacacctcttcaaccttcctacagtagtgaagtctttcctctagtcacccctttgttgcttgacaatcagatcctcaacactacccctgctgcttcaagtagtgattcggccttgcatgctacgcctgtatttcccagtgtcgatgtgtcatttgaatccatcctgtcttcctatgatggtgcacctttgcttccattttcctctgcttccttcagtagtgaattgtttcgccatctgcatacagtttctcaaatccttccacaagttacttcagctaccgagagtgataaggtgcccttgcatgcttctctgccagtggctgggggtgatttgctattagagcccagccttgctcagtattctgatgtgctgtccactactcatgctgcttcagagacgctggaatttggtagtgaatctggtgttctttataaaacgcttatgttttctcaagttgaaccacccagcagtgatgccatgatgcatgcacgttcttcagggcctgaaccttcttatgccttgtctgataatgagggctcccaacacatcttcactgtttcttacagttctgcaatacctgtgcatgattctgtgggtgtaacttatcagggttccttatttagcggccctagccatataccaatacctaagtcttcgttaataaccccaactgcatcattactgcagcctactcatgccctctctggtgatggggaatggtctggagcctcttctgatagtgaatttcttttacctgacacagatgggctgacagcccttaacatttcttcacctgtttctgtagctgaatttacatatacaacatctgtgtttggtgatgataataaggcgctttctaaaagtgaaataatatatggaaatgagactgaactgcaaattccttctttcaatgagatggtttacccttctgaaagcacagtcatgcccaacatgtatgataatgtaaataagttgaatgcgtctttacaagaaacctctgtttccatttctagcaccaagggcatgtttccagggtcccttgctcataccaccactaaggtttttgatcatgagattagtcaagttccagaaaataacttttcagttcaacctacacatactgtctctcaagcatctggtgacacttcgcttaaacctgtgcttagtgcaaactcagagccagcatcctctgaccctgcttctagtgaaatgttatctccttcaactcagctcttattttatgagacctcagcttcttttagtactgaagtattgctacaaccttcctttcaggcttctgatgttgacaccttgcttaaaactgttcttccagctgtgcccagtgatccaatattggttgaaacccccaaagttgataaaattagttctacaatgttgcatctcattgtatcaaattctgcttcaagtgaaaacatgctgcactctacatctgtaccagtttttgatgtgtcgcctacttctcatatgcactctgcttcacttcaaggtttgaccatttcctatgcaagtgagaaatatgaaccagttttgttaaaaagtgaaagttcccaccaagtggtaccttctttgtacagtaatgatgagttgttccaaacggccaatttggagattaaccaggcccatcccccaaaaggaaggcatgtatttgctacacctgttttatcaattgatgaaccattaaatacactaataaataagcttatacattccgatgaaattttaacctccaccaaaagttctgttactggtaaggtatttgctggtattccaacagttgcttctgatacatttgtatctactgatcattctgttcctataggaaatgggcatgttgccattacagctgtttctccccacagagatggttctgtaacctcaacaaagttgctgtttccttctaaggcaacttctgagctgagtcatagtgccaaatctgatgccggtttagtgggtggtggtgaagatggtgacactgatgatgatggtgatgatgatgatgatgacagaggtagtgatggcttatccattcataagtgtatgtcatgctcatcctatagagaatcacaggaaaaggtaatgaatgattcagacacccacgaaaacagtcttatggatcagaataatccaatctcatactcactatctgagaattctgaagaagataatagagtcacaagtgtatcctcagacagtcaaactggtatggacagaagtcctggtaaatcaccatcagcaaatgggctatcccaaaagcacaatgatggaaaagaggaaaatgacattcagactggtagtgctctgcttcctctcagccctgaatctaaagcatgggcagttctgacaagtgatgaagaaagtggatcagggcaaggtacctcagatagccttaatgagaatgagacttccacagatttcagttttgcagacactaatgaaaaagatgctgatgggatcctggcagcaggtgactcagaaataactcctggattcccacagtccccaacatcatctgttactagcgagaactcagaagtgttccacgtttcagaggcagaggccagtaatagtagccatgagtctcgtattggtctagctgaggggttggaatccgagaagaaggcagttataccccttgtgatcgtgtcagccctgacttttatctgtctagtggttcttgtgggtattctcatctactggaggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgagacactgaaagagttttaccaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaa

SEQ ID NO: 10962 - DNA, 4075 bp, synthetic construct
  misc_feature 1..4075: note = Synthetic polypeptide
  source 1..4075: mol_type = other DNA
ccaggcatggtggctcaaactgtcatcccagcactttaggaggctgaggctggaggatcacttaagcccaggagtttgagactagtctgggcaacatagtgagatcccatttctacaaaaaataagagaaaatagctgaagacggtggcatgcacctgttgtcccaactactccagaggctgagatgcaaatctactgctttgatgcggaccgattttcaagttttgaggaagcagtcaaaggaaaagggaagttaagagctttatccattttgtttgaggttgggacagaagaaaatttggatttcaaagcgattattgatggagtcgaaagtgttagtcgttttgggaagcaggctgctttagatccattcatactgttgaaccttctgccaaactcaactgacaagtattacatttacaatggctcattgacatctcctccctgcacagacacagttgactggattgtttttaaagatacagttagcatctctgaaagccagttggctgttttttgtgaagttcttacaatgcaacaatctggttatgtcatgctgatggactacttacaaaacaattttcgagagcaacagtacaagttctctagacaggtgttttcctcatacactggaaaggaagagattcatgaagcagtttgtagttcagaaccagaaaatgttcaggctgacccagagaattataccagccttcttgttacatgggaaagacctcgagtcgtttatgataccatgattgagaagtttgcagttttgtaccagcagttggatggagaggaccaaaccaagcatgaatttttgacagatggctatcaagacttgggtgctattctcaataatttgctacccaatatgagttatgttcttcagatagtagccatatgcactaatggcttatatggaaaatacagcgaccaactgattgtcgacatgcctactgataatcctgaacttgatcttttccctgaattaattggaactgaagaaataatcaaggaggaggaagagggaaaagacattgaagaaggcgctattgtgaatcctggtagagacagtgctacaaaccaaatcaggaaaaaggaaccccagatttctaccacaacacactacaatcgcatagggacgaaatacaatgaagccaagactaaccgatccccaacaagaggaagtgaattctctggaaagggtgatgttcccaatacatctttaaattccacttcccaaccagtcactaaattagccacagaaaaagatatttccttgacttctcagactgtgactgaactgccacctcacactgtggaaggtacttcagcctctttaaatgatggctctaaaactgttcttagatctccacatatgaacttgtcggggactgcagaatccttaaatacagtttctataacagaatatgaggaggagagtttattgaccagtttcaagcttgatactggagctgaagattcttcaggctccagtcccgcaacttctgctatcccattcatctctgagaacatatcccaagggtatatattttcctccgaaaacccagagacaataacatatgatgtccttataccagaatctgctagaaatgcttccgaagattcaacttcatcaggttcagaagaatcactaaaggatccttctatggagggaaatgtgtggtttcctagctctacagacataacagcacagcccgatgttggatcaggcagagagagctttctccagactaattacactgagatacgtgttgatgaatctgagaagacaaccaagtccttttctgcaggcccagtgatgtcacagggtccctcagttacagatctggaaatgccacattattctacctttgcctacttcccaactgaggtaacacctcatgcttttaccccatcctccagacaacaggatttggtctccacggtcaacgtggtatactcgcagacaacccaaccggtatacaatgaggccagtaatagtagccatgagtctcgtattggtctagctgaggggttggaatccgagaagaaggcagttataccccttgtgatcgtgtcagccctgacttttatctgtctagtggttcttgtgggtattctcatctactggaggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaa

SEQ ID NO: 10963 - DNA, 463 bp, synthetic construct; identical to SEQ ID NO: 8758
  misc_feature 1..463: note = Synthetic polypeptide
  source 1..463: mol_type = other DNA

SEQ ID NO: 10964 - DNA, 484 bp, synthetic construct
  misc_feature 1..484: note = Synthetic polypeptide
  source 1..484: mol_type = other DNA
ttccccacacagcagcgagaataacctttttataactgaatcagccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcagcagaggctgaaccagctggaaaaaccaccagagaaggaagaggatcacgcccccgagtttattaaagtcagggaaaacctgcggagaattgccacactgaccagcgaagagagagagctgtag

SEQ ID NO: 10965 - DNA, 471 bp, synthetic construct
  misc_feature 1..471: note = Synthetic polypeptide
  source 1..471: mol_type = other DNA
aaaatgaatgagagccaaatgcaagagctaaagctataaacctctccgaagaaagcagaggtggtgagatctgctgaggaagcggcatcagtgttggccacttcaattagtccagagcagtgcatcaaagtgctttgtcctatcattcaaactgcagactacccaattaatctggctgcaatcaaaatgcaaacaaaagtgatagagagagtgtccaaggaaaccctaaacctgcttttgccagagattatgccaggtctaatacagggttatgataattcagagagcagtgttcggaaagcttgtgtcttctgcctggtggctgttcatgcggtaattggtgatgaactaaaaccacatctcagtcaacttactggcagtaaaatgaagctactgaatctttacatcaaacgtgcacaaacaggttctggaggagctgatcccactactgatgtttctggacaaagttag

SEQ ID NO: 10966 - DNA, 952 bp, synthetic construct; identical to SEQ ID NO: 8583
  misc_feature 1..952: note = Synthetic polypeptide
  source 1..952: mol_type = other DNA

SEQ ID NO: 10967 - DNA, 87 bp, synthetic construct; identical to SEQ ID NO: 8584
  misc_feature 1..87: note = Synthetic polypeptide
  source 1..87: mol_type = other DNA

SEQ ID NO: 10968 - DNA, 690 bp, synthetic construct
  misc_feature 1..690: note = Synthetic polypeptide
  source 1..690: mol_type = other DNA
ggctgggcgcggtggctcatgcctgtaatcccagcacttttggaggccaagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtttgcaggacatggtgacaaagtatcagaaaagaaagaataaacttgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatag

SEQ ID NO: 10969 - DNA, 645 bp, synthetic construct
  misc_feature 1..645: note = Synthetic polypeptide
  source 1..645: mol_type = other DNA
ggctgggcgcggtggctcatgcctgtaatcccagcacttttggaggccaagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatag

SEQ ID NO: 10970 - DNA, 406 bp, synthetic construct
  misc_feature 1..406: note = Synthetic polypeptide
  source 1..406: mol_type = other DNA
gcatagcatcatggctgagtccaagctcttacattagcctgcctgtagctgaattttaactgccacaaattaactgcatgacctttgtcaaggaattcagggctgggaaaatttagccgagtcatcacatttggctactacccgggaaagcagccctcccgagtcaggaacgggctccggttcatcacgtggcagccgcctgcaggagccgcagttccatggaccaaagacagaggagaatcctgggccagcccctttccatccctacttcccagcccaagcagaaaaggacatcaatgatatctttcttttccaaggtctcttggaaactgaggttccagaagcgggagcctctgaagaatgtgtttttcatcttggcagaaagagctcgggaccccagtgctaa

SEQ ID NO: 10971 - DNA, 706 bp, synthetic construct
  misc_feature 1..706: note = Synthetic polypeptide
  source 1..706: mol_type = other DNA
gcatagcatcatggctgagtccaagctcttacattagcctgcctgtagctgaattttaactgccacaaattaactgcatgacctttgtcaaggaattcagggctgggaaaatttagccgagtcatcacatttggctactacccgggaaagcagccctcccgagtcaggaacgggctccggttcatcacgtggcagccgcctgcaggagccgcaggtctcttggaaactgaggttccagaagcgggagcctctgaagaatgtgtttttcatcttggcagaaagagctcgggaccccagtgctaaaaagcgtcacatggcaatgagaaacttgggaaccatggcctatgaagcccctgacaaggtgagaaagtataagaaaattgtcctcgacctgctggtgtatggactgtatgaccctgtgaatttggaagtcatccatgagagtatgaagactctgaccgtcgttctgggcaagatccaggggaaaggtttgggttccttcttcatagatatcacccttcagaccaggactttattagatgacgcttgcaaaacaacatttcaagcctgttctccatatctgaaactaaaggaggaatacagcttccagagtgaagaagatcaaaggaacactaagctctaccagcagctgagccactatcatccagagatcctgcagttcttctacgcaaataaaattctgtaa

SEQ ID NO: 10972 - DNA, 862 bp, synthetic construct
  misc_feature 1..862: note = Synthetic polypeptide
  source 1..862: mol_type = other DNA
gcatagcatcatggctgagtccaagctcttacattagcctgcctgtagctgaattttaactgccacaaattaactgcatgacctttgtcaaggaattcagggctgggaaaatttagccgagtcatcacatttggctactacccgggaaagcagccctcccgagtcaggaacgggctccggttcatcacgtggcagccgcctgcaggagccgcaggtctcttggaaactgaggttccagaagcgggagcctctgaagaatgtgtttttcatcttggcagaaagagctcgggaccccagtgctaaaaagcgtcacatggcaatgagaaacttgggaaccatggcctatgaagcccctgacaaggtgagaaagtataagaaaattgtcctcgacctgctggtgtatggactgtatgaccctgtgaatttggaagtcatccatgagagtatgaagactctgaccgtcgttctgggcaagatccaggggaaaggtttgggttccttcttcatagatatcacccttcagaccaggactttattagatgacgagaacgacagtctgagatactcggcctttgttttgtttgggcaattggctgcctttgccgggaggaaatggaaaaaatttttcaccagtcaggttaagcagacacgagattccctcctgatccatttacaggacagaaatccccaggttgccaaggcttgcaaaacaacatttcaagcctgttctccatatctgaaactaaaggaggaatacagcttccagagtgaagaagatcaaaggaacactaagctctaccagcagctgagccactatcatccagagatcctgcagttcttctacgcaaataaaattctgtaa

SEQ ID NO: 10973 - DNA, 1511 bp, synthetic construct
  misc_feature 1..1511: note = Synthetic polypeptide
  source 1..1511: mol_type = other DNA
ggggttatcatgaactcttccttctctctcagcctccagagctaatcagcaccagttttgccaccccgaaggttcaattgtccttgaaatctaacccttacccctacccccttctcttttcagcacaatcctggttcaggtttctttcattcttccacacaaggactcctaggatagcctctacctgttccccagcttctggcctctgctgtcagaatgaataatccaacacatgggcctgaccctgctcaaaatccttcagtggctcccatggctccctactgcttcagagatgggacgaggagctggccgccttcgccaaggcctacgcacggcagtgcgtgtggggccacaacaaggagcgcgggcgccgcggcgagaatctgttcgccatcacagacgagggcatggacgtgccgctggccatggaggagtggcaccacgagcgtgagcactacaacctcagcgccgccacctgcagcccaggccagatgtgcggccactacacgcaggtggtatgggccaagacagagaggatcggctgtggttcccacttctgtgagaagctccagggtgttgaggagaccaacatcgaattactggtgtgcaactatgagcctccggggaacgtgaaggggaaacggccctaccaggaggggactccgtgctcccaatgtccctctggctaccactgcaagaactccctctgtgaacccatcggaagcccggaagatgctcaggatttgccttacctggtaactgaggccccatccttccgggcgactgaagcatcagactctaggaaaatgggtactccttcttccctagcaacggggattccggctttcttggtaacagaggtctcaggctccctggcaaccaaggctctgcctgctgtggaaacccaggccccaacttccttagcaacgaaagacccgccctccatggcaacagaggctccaccttgcgtaacaactgaggtcccttccattttggcagctcacagcctgccctccttggatgaggagccagttaccttccccaaatcgacccatgttcctatcccaaaatcagcagacaaagtgacagacaaaacaaaagtgccctctaggagcccagagaactctctggaccccaagatgtccctgacaggggcaagggaactcctaccccatgcccaggaggaggctgaggctgaggctgagttgcctccttccagtgaggtcttggcctcagtttttccagcccaggacaagccaggtgagctgcaggccacactggaccacacggggcacacctcctccaagtccctgcccaatttccccaatacctctgccaccgctaatgccacgggtgggcgtgccctggctctgcagtcgtccttgccaggtgcagagggccctgacaagcctagcgtcgtgtcagggctgaactcgggccctggtcatgtgtggggccctctcctgggactactgctcctgcctcctctggtgttggctggaatcttctga

SEQ ID NO: 10974 - DNA, 231 bp, synthetic construct
  misc_feature 1..231: note = Synthetic polypeptide
  source 1..231: mol_type = other DNA
ttagaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaa

SEQ ID NO: 10975 - DNA, 1672 bp, synthetic construct; identical to SEQ ID NO: 9065
  misc_feature 1..1672: note = Synthetic polypeptide
  source 1..1672: mol_type = other DNA

SEQ ID NO: 10976 - DNA, 2799 bp, synthetic construct
  misc_feature 1..2799: note = Synthetic polypeptide
  source 1..2799: mol_type = other DNA
tgaggttcaactttgatgaccatgagcaactttctctactgttttatactgcagttccctcatttataaacgggagggagcatgacttcggcaacttcacctatcattctgaaatgggaccccaaaagtttggaaatccggacgctaacagtggaaaggctgttggagccacttgttacacaggtgactacacttgtcaacacaagcaacaaaggcccatctggtaaaaagaaagggaggtcaaagaaagcccatgtactagctgcctctgtagagcaagccactcagaatttcctggaaaagggtgaacagatcgctaaggagagtcaagatctcaaagaagagttggtggctgctgtagaggatgtgcgcaaacaaggtgagacgatgcggatcgcctcctccgagtttgcagatgacccttgctcgtcggtaaagcgcggcaccatggtacgggcggcaagggctttgctctccgcggtgacacgcttactcatcctggcggacatggcagatgtcatgagacttttatcccatctgaaaattgtggaagaggccctggaagctgtcaaaaatgctacaaatgagcaagaccttgcaaaccgttttaaagagtttgggaaagagatggtgaaacttaactatgtagcagcaagaagacaacaggagctgaaggatcctcactgtcgggatgagatggcagccgcccgaggggctctgaagaagaatgccacaatgctgtacacggcctctcaagcatttctccgccacccagatgtcgccgctacgagagccaaccgagattatgtgttcaaacaagtccaggaggccatcgccggcatctccaatgctgctcaagctacctcgcccactgacgaagccaagggccacacgggcatcggcgagctggctgcggctcttaatgagtttgacaataagattatcctggaccccatgacgttcagcgaggccaggttccggccgtccctggaggagaggctggagagcatcatcagcggcgcagcgctgatggccgactcctcctgcacgcgagacgaccggcgcgagaggatcgtggcggagtgcaacgccgtgcggcaggcgctccaggacctgctcagcgagtacatgaataatactggaaggaaagaaaaaggagatcctctcaacattgcgattgataagatgactaagaaaacaagagatctaaggagacagcttcggaaagcagtgatggatcacatatctgactctttcctggaaaccaatgttcctttgctagttctcattgaggctgcaaagagcggaaatgaaaaggaagtgaaagaatatgcccaagttttccgtgagcatgccaacaaactggtagaggttgccaatttggcctgttccatctccaacaatgaagaaggggtgaaattagttcggatggcagccacccagattgacagcctgtgtccccaggtcatcaatgccgctctgacactggctgcccggccacagagcaaagttgctcaggataacatggacgtcttcaaagaccagtgggagaagcaggtccgagtgttgacagaggccgtggatgacatcacctcagtggatgacttcctctctgtctcagaaaatcacatcttggaggatgtgaacaagtgtgtgatagccctccaagagggcgatgtggacactctggaccggactgcaggggccatcaggggccgggcagctcgagtcatacacatcatcaatgctgagatggagaactatgaagctggggtttatactgagaaggtgttggaagctacaaaattgctttctgaaacagtgatgccacgcttcgctgaacaagtagaggttgccattgaagccctgagtgccaacgttcctcaaccgtttgaggagaatgagttcatcgatgcctctcgcctggtgtatgatggcgttcgggacatcagaaaggctgtgctgatgatcaggaccccagaagaactagaggatgattctgactttgagcaggaagattatgatgtgcgtagcaggacaagtgttcagactgaggatgaccagctcattgcagggcagagcgcacgggccatcatggcgcaactaccgcaggaggagaaggcaaaaatagctgagcaggtggagatattccatcaagagaaaagcaagctggatgcagaagtggccaaatgggacgacagcggcaatgatatcattgtactggccaagcagatgtgtatgatcatgatggaaatgacagacttcacaagaggcaaaggcccattgaaaaatacatctgatgtcattaatgctgccaagaaaattgccgaagcaggttctcgaatggacaaattagctcgtgctgtggctgatcagtgtcctgattcagcatgtaagcaggatttattagcctaccttcaacgaattgccttgtattgccatcagcttaatatctgcagcaaggtgaaggcagaagtgcagaatctgggaggagagctcattgtgtcagggctggacagtgccacatcgcttatccaggcagctaaaaacctgatgaatgctgttgtcctcacggtgaaagcatcctatgtggcctcaaccaaataccagaaggtctatgggacagcagctgtcaactcacctgttgtgtcttggaagatgaaggctccagagaagaagccccttgtgaagagagaaaagcctgaagaattccagacacgagttcgacgaggttctcagaagaaacacatttcgcctgtacaggctttaagtgaattcaaagcaatggattccttctag

SEQ ID NO: 10977 - DNA, 1082 bp, synthetic construct
  misc_feature 1..1082: note = Synthetic polypeptide
  source 1..1082: mol_type = other DNA
aggaaatttgacggaatgggaaagagaatgggtttgggagtggctcagacctgagcctgaatccaatcttttcctgttagtaactatgagagctcggataggctttccaggctctctgaggttccatatcctttctttatagatgcagcccatccctctttctgcaaataggagtaattgaaccaaacccacagagttgtgaagattaagcttccagagctaagctcagcatgatcaacaccatgtcaaaaatccgtggccaggagaaggggccaggctatcctcaggcagaggcgctgctggcagaggccatgctcaaatttggaagagagcttggagatgattgcaactttggcccagcacttggtgaggtcggggaggccatgcgggaactgtcggaggtcaaagactctttggacatagaagtgaagcagaacttcattgaccctcttcagaatcttcatgacaaagatcttagggaaattcaacatcatctaaagaagttggagggtcgacgcctggattttgattataagaagaaacgacaaggcaagattccggatgaagagcttcgtcaagctctagagaaatttgatgagtctaaggaaattgctgagtcaagcatgttcaatctcttggagatggatattgaacaagtgagccagctctctgcacttgtgcaagctcagctggagtaccacaagcaggcagtccagatcctgcagcaagtcacggtcagactggaagaaagaataagacaggcttcatctcagcctagaagggaatatcaacctaaaccacgaatgagcctggagtttccaactggagacagtactcagcccaatgggggtctctcccacacaggcactcccaaaccttcaggtgtccaaatggatcagccctgctgccgagctctgtacgactttgaacctgaaaatgaaggggagttgggatttaaagagggcgatatcatcacactcactaaccaaattgatgagaactggtatgaggggatgctgcatggccattcaggcttcttccccatcaattatgtggaaattctggttgccctgccccattag

SEQ ID NO: 10978 - DNA, 1013 bp, synthetic construct
  misc_feature 1..1013: note = Synthetic polypeptide
  source 1..1013: mol_type = other DNA
ggttcgcgctctccaactccgcggccatccgggccgagatccagcgcttcgagtccgtgcatcccaatatctacgccatctacgacctgatcgagcgcatcgaggatttggcgctgcagaaccagatccgggagcacgtcatctccatcgaggactcgtttgtgaacagccaggagtggacgctgagccgctccgtaccggagcttaaagtgggcatagtggggaacctgtctagcgggaagtcagccctggtgcaccgctatctgacggggacctatgtccaggaggagtcccctgaaggggggcggtttaagaaggagattgtggtggatggccagagttacctgctgctgatccgagatgaaggaggcccccctgagctccagtttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcaggatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtggcccagaaggtagtggccttgcgaaagaagcagcaactggccatcgggccctgcaagtcactgcccaactcgcccagccactcggccgtgtccgccgcctccatcccggccgtgcacatcaaccaggccacgaatggcggcggcagcgccttcagcgactactcgtcctcagtcccctccacccccagcatcagccagcgggagctgcgcatcgagaccatcgctgcctcctccacccccacacccatccgaaagcagtccaagcggcgctccaacatcttcacgatatgtgccactgtttccaacttttcatcaacaaaaaggcctttccaactccttccaaattag

SEQ ID NO: 10979 - DNA, 854 bp, synthetic construct
  misc_feature 1..854: note = Synthetic polypeptide
  source 1..854: mol_type = other DNA
ggttcgcgctctccaactccgcggccatccgggccgagatccagcgcttcgagtccgtgcatcccaatatctacgccatctacgacctgatcgagcgcatcgaggatttggcgctgcagaaccagatccgggagcacgtcatctccatcgaggactcgtttgtgaacagccaggagtggacgctgagccgctccgtaccggagcttaaagtgggcatagtggggaacctgtctagcgggaagtcagccctggtgcaccgctatctgacggggacctatgtccaggaggagtcccctgaaggggggcggtttaagaaggagattgtggtggatggccagagttacctgctgctgatccgagatgaaggaggcccccctgagctccagtttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcaggatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtggcccagaaggtagtggccttgcgaaagaagcagcaactggccatcgggccctgcaagtcactgcccaactcgcccagccactcggccgtgtccgccgcctccatcccggccgtgcacatcaaccagatatgtgccactgtttccaacttttcatcaacaaaaaggcctttccaactccttccaaattag

SEQ ID NO: 10980 - DNA, 2558 bp, synthetic construct
  misc_feature 1..2558: note = Synthetic polypeptide
  source 1..2558: mol_type = other DNA
ggttcgcgctctccaactccgcggccatccgggccgagatccagcgcttcgagtccgtgcatcccaatatctacgccatctacgacctgatcgagcgcatcgaggatttggcgctgcagaaccagatccgggagcacgtcatctccatcgaggactcgtttgtgaacagccaggagtggacgctgagccgctccgtaccggagcttaaagtgggcatagtggggaacctgtctagcgggaagtcagccctggtgcaccgctatctgacggggacctatgtccaggaggagtcccctgaaggggggcggtttaagaaggagattgtggtggatggccagagttacctgctgctgatccgagatgaaggaggcccccctgagctccagtttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcaggatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtggcccagaaggtagtggccttgcgaaagaagcagcaactggccatcgggccctgcaagtcactgcccaactcgcccagccactcggccgtgtccgccgcctccatcccggccgtgcacatcaaccaggccacgaatggcggcggcagcgccttcagcgactactcgtcctcagtcccctccacccccagcatcagccagcgggagctgcgcatcgagaccatcgctgcctcctccacccccacacccatccgaaagcagtccaagcggcgctccaacatcttcacgtctcggaagggtgctgacctggaccgggagaagaaggctgccgagtgcaaggtggacagcatcgggagcggccgcgccatccccatcaagcaggggatcctgctaaagcggagcggcaagtccctgaacaaggagtggaagaagaagtatgtgacgctctgtgacaacgggctgctcacctatcaccccagcctgcatgattacatgcagaacatccacggcaaggagattgacctgctgcggacaacggtgaaagtgccagggaagcgcctgccccgagccacacctgccacagccccgggcaccagcccccgtgccaacgggctgtccgtggagcggagtaacacacagctgggtgggggcacaggtgccccccactcggccagcagcgcatccctgcactctgagcgccccctcagcagctcggcctgggctggcccgcgccctgaggggctgcaccagcgctcctgctccgtttccagcgccgaccagtggagtgaggccaccacttccctgcccccaggcatgcagcaccctgccagtggcccagctgaggtactcagttccagccccaagctggatcctcccccatctccccactccaaccggaagaagcaccggaggaaaaagagcaccgggaccccccgaccagacggccccagcagtgctactgaagaggcagaggagtcgtttgaatttgtggtggtgtccctcactgggcagacgtggcacttcgaggcttcaacggcggaggagcgggagctgtgggttcagagtgtgcaggcccagatccttgccagcctgcaaggctgccgcagtgccaaggacaagactcgactggggaaccagaacgcagctctggctgtgcaggccgtccgcaccgtccgcggcaacagcttttgtatcgactgcgatgcacccaatccagactgggccagcctgaacctgggtgccctgatgtgcattgagtgctcaggcatccaccgacacctgggggctcacctgtcccgggtgcgctcccttgacctcgatgactggccgcctgagctgctggctgtcatgactgccatgggcaatgccctcgccaacagcgtctgggagggggccttgggtggctactccaagccagggcctgatgcctgcagagaggagaaggaacgctggatacgggccaagtatgaacagaagctcttcctggccccactgccaagctcagatgtgccactggggcagcagctgctccgggccgtggtggaagatgacctgcggctgttggtgatgctcctggcacatggctccaaagaggaggtgaatgagacctatggggacggggacgggcggacggctctacatctctccagtgccatggccaacgttgtcttcacgcagctgctcatctggtacggggtggacgtgaggagccgggacgcccggggcctgactccactggcatatgctcgccgggccggcagccaggagtgtgcagacatcttgatccagcatggctgccctggggagggctgtggcttagcgcctacccccaacagagagcctgccaatggcaccaacccctctgctgagctgcaccgtagtcctagcctcctataa

SEQ ID NO: 10981 - DNA, 1149 bp, synthetic construct
  misc_feature 1..1149: note = Synthetic polypeptide
  source 1..1149: mol_type = other DNA
ggagggaggctagcctgggagccagacagatggggttaggctcttgcttttgccactcgccagctctgaggcttagggcaacatgatttaattctctgatccttgtttttttcatctttctgtagactggtgatgagatgcaccctgcaggcttgcaggcttgcaggagtaattaaagggcaggaagatcccaacagtttgcgccataaatataactttatcgcggacgtggtggagaagatcgcccctgccgtggttcatatcgaattgtttcgcaagcttccgttttctaaacgagaggtgccggtggctagtgggtctgggtttattgtgtcggaagatggactgatcgtgacaaatgcccacgtggtgaccaacaagcaccgggtcaaagttgagctgaagaacggtgccacttacgaagccaaaatcaaggatgtggatgagaaagcagacatcgcactcatcaaaattgaccaccagggcaagctgcctgtcctgctgcttggccgctcctcagagctgcggccgggagagttcgtggtcgccatcggaagcccgttttcccttcaaaacacagtcaccaccgggatcgtgagcaccacccagcgaggcggcaaagagctggggctccgcaactcagacatggactacatccagaccgacgccatcatcaactatggaaactcgggaggcccgttagtaaacctggacggtgaagtgattggaattaacactttgaaagtgacagctggaatctcctttgcaatcccatctgataagattaaaaagttcctcacggagtcccatgaccgacaggccaaaggaaaagccatcaccaagaagaagtatattggtatccgaatgatgtcactcacgtccagcaaagccaaagagctgaaggaccggcaccgggacttcccagacgtgatctcaggagcgtatataattgaagtaattcctgataccccagcagaagctggtggtctcaaggaaaacgacgtcataatcagcatcaatggacagtccgtggtctccgccaatgatgtcagcgacgtcattaaaagggaaagcaccctgaacatggtggtccgcaggggtaatgaagatatcatgatcacagtgattcccgaagaaattgacccatag

SEQ ID NO: 10982 - DNA, 1050 bp, synthetic construct
  misc_feature 1..1050: note = Synthetic polypeptide
  source 1..1050: mol_type = other DNA
ggggtgggcaggaaaggggaagggtgatgagacctcagtgagaggaaaggagaggaagagctggagggggtctatactcgctatgggaagtgttacaccttcaacgcggacccgcggagctcgctgcccagccgggcagggggcatgggcagtggcctggagatcatgctggacatccagcaggaggagtacctgcccatctggagggagacaaatgagacgtcgtttgaggcaggtattcgggtgcagatccacagccaggaggagccgccctacatccaccagctggggttcggggtgtccccaggcttccagacctttgtgtcctgccaggaacagcggctgacctacctgccccagccctggggcaactgccgcgcagagagtgagctcagggagcctgagcttcagggctactcggcctacagtgtgtctgcctgccggctgcgctgtgaaaaggaggccgtgcttcagcgctgccactgccggatggtgcacatgccagactccctgggtgggggccctgagggcccgtgcttctgccccaccccctgcaacctgacacgctatgggaaagagatctccatggtcaggatccccaacaggggctcagcccggtacctggcgaggaagtacaaccgcaacgagacctacatacgggagaacttcctggtcctagatgtcttctttgaggccctgacctctgaagccatggagcagcgagcagcctatggcctgtcagccctgctgggagacctcgggggacagatgggcctgttcattggggccagcatcctcacgttgctggagatcctcgactacatctatgaggtgtcctgggatcgactgaagcgggtatggaggcgtcccaagacccccctgcggacctccactgggggcatctccactttggggcttcaggagctgaaggaacagagtccctgcccgagccggggccgagtggagggtgggggggtcagcagtctgctccccaatcaccaccacccccacggtcccccaggaggtctctttgaagattttgcttgctag

SEQ ID NO: 10983 - DNA, 1107 bp, synthetic construct
  misc_feature 1..1107: note = Synthetic polypeptide
  source 1..1107: mol_type = other DNA
ggggtgggcaggaaaggggaagggtgatgagacctcagtgagaggaaaggagaggaagagctggagggggtctatactcgctatgggaagtgttacaccttcaacgcggacccgcggagctcgctgcccagccgggcagggggcatgggcagtggcctggagatcatgctggacatccagcaggaggagtacctgcccatctggagggagacaaatgagacgtcgtttgaggcaggtattcgggtgcagatccacagccaggaggagccgccctacatccaccagctggggttcggggtgtccccaggcttccagacctttgtgtcctgccaggaacagcggctgacctacctgccccagccctggggcaactgccgcgcagagagtgagctcagggagcctgagcttcagggctactcggcctacagtgtgtctgcctgccggctgcgctgtgaaaaggaggccgtgcttcagcgctgccactgccggatggtgcacatgccaggcaatgagaccatctgcccaccaaatatctacatcgagtgtgcagaccacacactggactccctgggtgggggccctgagggcccgtgcttctgccccaccccctgcaacctgacacgctatgggaaagagatctccatggtcaggatccccaacaggggctcagcccggtacctggcgaggaagtacaaccgcaacgagacctacatacgggagaacttcctggtcctagatgtcttctttgaggccctgacctctgaagccatggagcagcgagcagcctatggcctgtcagccctgctgggagacctcgggggacagatgggcctgttcattggggccagcatcctcacgttgctggagatcctcgactacatctatgaggtgtcctgggatcgactgaagcgggtatggaggcgtcccaagacccccctgcggacctccactgggggcatctccactttggggcttcaggagctgaaggaacagagtccctgcccgagccggggccgagtggagggtgggggggtcagcagtctgctccccaatcaccaccacccccacggtcccccaggaggtctctttgaagattttgcttgctag

SEQ ID NO: 10984 - DNA, 7042 bp, synthetic construct
  misc_feature 1..7042: note = Synthetic polypeptide
  source 1..7042: mol_type = other DNA
ggggcggttccaagatggccgaataagaacagctccagtccacagctcccagcatgagcgacgcagaagacggatgatttctgcatttccaactgaggtaccgggttcatctcactggggactgtcggacagtgggttcaggacagtgggtgcagcgcaccgagcgtgagccgaagcagggcgaggcatcacctcacctgggaagcacaaggggtcagggaattcccttttctagccaaggaaaggggtgacagacagcatctgaaaaattgggtcattcccaccctaatactacacttttccgatggtcttagcaaacggcacaccaggagattatatcccgcgcatggctcagagggtcctacgcccacggagcctcgctcattgctagcacagcagtctgagatcaaactgcaaggcggcagcaaggctgggggaggggcgcccgccattgctgagacttcagtaggtaaacaaagcagccaggaagctcgaactgggtggagcccaccacagctcaaggaggcctgcctgcctcttgtagactccacctctggcagcagggcatagccaaacaaaaggcagcagaaacctctgcagacttaaatgtccctgtctgacagattggaagacagcagtggttctcccagcatgcagcttgagatccgagaacggacagactgcctcctcaagtgggtccctgacccccgagtagcctaactgggaggcaccccccagtaggggcagactgacacctcacacggccaggtacccctctgagacaaaatttccagaggaacgatcagacagcagcatttgctgttcaccaatattcgctgttctgcagcctccgctgctgatacccaggcaaacagggtctggagttgagctctggcaaactccgacagacctgcagctgagggtcctgactgttagaaggaaaactaacaaacagaaagaacatccacaccaaaaccccatctgcatgtcaccatcatcaaagaccaaaggtagataaaaccacaaagatggggaaaaaacagaacagaaaaactgaaaattctaaaaatcagagaacctcttcttctccaaaggaacgcagctcctcaccagcagcggaacaaagctggatggagaatgactttgatgagttgagagaagaaggcttcagacgatcaaacttctccgagctaaaggaggaagttcgaacccatggcaaagaagtcaaaaaccttgaaaaaagattagacaaatggctaactagaataactaatacacagaagtccttaaaggacctgatggagctgaaaaccacggcacgagaactacatgatgaatgcacaagcctcactaaccaattcgatcaactggaagaaagggtatcttgatggaagatcaaatgaatgaaatgaagtgagaagagaagtttagagaaaaaagaataaaaagaaacaaacaaaccctccaagaaatatgggactatgtgaaaagaccaaatctacatctgattggtgtacctgaaagtgacggggagaatggaaccaagttggaaaacactctgcaggaaattatgcaggagaacttccccaatccagcaaggcaggctaacattcaaattcaggaaatacagagaagtccacaaagatactccttgagaaggacaactccaagacacttaattgtcagattcaccaaagtggaaatgaaggaaaaaatgttaagggcagccagagacaaaggtcgggttacccacaaagggaagcccatcagactaatagctgatcgctcggcagaaattctacaagccagaagagagtgggggccaatattcaacattcttaaagaaaagaattttcaacacagaatttcatatccagccaaactaagcctcataagtgaaggagaaataaaatcctttacagacaagcaaatgctgagagattttgtcaccaccaggcctgccctacaagagctcctgaaggaagcactaaacatggaaaggaacaactggtaccagccactgcaaaaacatgccaaatcgtaaagaccatcaaggttaggaagaaactgcatcaactaacgagcaaaataaccagctaacatctcaatgacaggatcaaattcacacataacaatataaaccttaaatgtaaatgggctaaatactccaattaaaagacacagactggcaagttggataaagagtcaagacccatcagtgtgctgtattcaggaaacccttctcacgtgcagagacacacaggctcaaaataaagggatggaggaagatctaccaagcaaatggaaaacaaaacaaggcaggggttgcaaccctagtctctgataaaacagactttaaaccaacaaagatcaaaagagacaaagaaggccattacataatggtaaagggatcaattcaacaagaagagctaactaacctaaatatatatgcacccagtacaggagcacccggattcataaaggaagtccttagaggcctacgaagaggcttagactcccacacaataataatgggagactttaacacccactgtcaacattagacagatccacaagacagaaagttaacaaagatatctaggaattgaactcagccctgcaccaagtggagctaatagacatctacagaactctccaccccaattcaacaaaatatacattcttctcagcaccacaccgcacttgttccaaaattgaccacatagttggaagtaaagcactcctcagcaaatgtaaaagaacagaaatgataacaaactgtctctcagaccacagtgcgatcaaactagaactcaagattaagaaactcactcaaaaccgctcaactacatggaaactgaacaacctgctcctgaatgactactgggtacataacgaaatgaaggcagaaataaagaagttctttgaaaccaatgagaacaaagatacaacataccagaatctctgggagacatttaaagcagtgtgtagagggaaatttatagcactaaatgcccacaagagaaagcaggaaagatctaaaattgacaccctaacaccacaattaaaagaactagagaagcaagagcaaacacattcaaaagctagcagaaggcaagaaataactaagatcagagcagaactgaaggagacagagacacaaaaaacccttcaaaaaatcaatgaatccaggagctggttttttttaaaagatcaacaacattgacagaccactagcaagactaataaagaagaaaagagagaagaatcaaatagatgcaataaaaaatgataaaggggatatcaccactgatcccacagaaatacaaactaccatcagagaatactataaacacctctatgcaaataaactagaaaatctagaagaaatggataaattcctggacacatacaccctcccaagactaaaccaggaagaagttgaatctctgaatagaccaataacaggctctgaaattgaggcaataattaatagcttaccaaccaaaaaaagtccaggaccagacagattcacagccaaattctaccagaggtacaaggaggagctggtaccattccttctgaaactattccaatcaatagaaaaagagggaatcttctctaactcattttatgaggccagcatcatcctgataccaaagcctggcagagacacaacagaaaaagagaattttagaccaatatccctgatgaacatcgatgcaaaaatcatcaataaaatactggcaaaccgaatccagcaaacacatcaaaaagcttatccaccatgatcaagtgggcttcatccctgggatgcaaggctggttcaacatatgcaaatcaataaacataatccagcatataaacagaaccaaagacaaaaaccacatgattatctcaacagatgcagaaaaggcctttgataaaatccaacaacccttcatgctaaaaactctcaataaattggtactgatgggacatatctcaaaataatgggagctatttatgacaaacccacagccaatatcatactgaatgggcaaaaactggaagcattccctttgaaaactggcataagacagggatgccctctctcactactcctattcaacatagtgttggaagttctggccagggcaatcaggcaagagaaggaaataaaggttattcaagtaggaaaagaggaagtcaaattgtccctgtttgcagatgacatgattgtgtatctagaagaccccatcatctcagccccaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctgggaatccaacttacaagggatgtgaaggacctcttcaaggaaaactacaaaccactgctcaaggaaataagaggatacaaacaaatggaagaacattccatgctcatgggtaggaagaatcaatatagtgaaaatggccatactgcccaaggtaatttatagattcaatgccatccccatcaagctaccaatgactttcttcacagaattggaaaaaagctactttaaagttcatatggaaccaaaaaagagcccgcatcaccaagtcaatcctaagccaaaagaacaaagctggaggcatcatgctacctgacttcaaactatactacaagactacagtaaccaaagcagcatggtactggtaccaaaacagagatacagaccaatggaacagaacagagccctcagaaataatgccacacatctacaactatctgatctttgacaaacctgacaaaaacaagcaatggggaaaggattccctatttaataaatggtgctgggaaaactggctagccatatgtagaaagctgaaactggaccccttccttacaccttatacaaaaattaattcaagatggattaaagacttaaatgttagacctaaaaccataaaaaccctagaagaaaacctaggcaataccattcaggacataggcatggacaaggacttcacgtctaaaacaccaaaagcaatggcaacaaaagccaaaattgacaaatgggatataattaaactaaagagcttctgcacagccaaagaaactaccatcagagtgaacaggcaacctacagaatgggagaaaatttttgcaatctactcatctgacaaagggctaatatccagaatctacaatgaactcaaacaaatttacaagaaaaaatcaaacaaccccatcaaaaagtgggcaaaggatatgaacgacacttctcaaaagaagatatttatgcagccaaaagacacatgaaaaaaggctcatcatcactggccatcagagaaatgcaaatcaaaaccacaatgccatactatctcataccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattacaaatcattctgctataaagacacatgcacacgtatgtttattacagcagtgctcacaatagcaaagacttggaaccaacccaaatgtccatcaatgacagactggattaagaaaatgtggcacatatacaccatggaatactatgcagccatataaaaggatgagtttatgtcctttgtagggacatggatgaagctggaaaccatcgttctcagcaaagtatcccaaggacaaaaaaccaaacactgcatgttctcactcatagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagcaaccttgggaggcaattctgcatcctacacctttgtctcattgcttttctctgcagtgactcttcttttgctctgttag

SEQ ID NO: 10985 - DNA, 7408 bp, synthetic construct
  misc_feature 1..7408: note = Synthetic polypeptide
  source 1..7408: mol_type = other DNA
ggggcggttccaagatggccgaataagaacagctccagtccacagctcccagcatgagcgacgcagaagacggatgatttctgcatttccaactgaggtaccgggttcatctcactggggactgtcggacagtgggttcaggacagtgggtgcagcgcaccgagcgtgagccgaagcagggcgaggcatcacctcacctgggaagcacaaggggtcagggaattcccttttctagccaaggaaaggggtgacagacagcatctgaaaaattgggtcattcccaccctaatactacacttttccgatggtcttagcaaacggcacaccaggagattatatcccgcgcatggctcagagggtcctacgcccacggagcctcgctcattgctagcacagcagtctgagatcaaactgcaaggcggcagcaaggctgggggaggggcgcccgccattgctgagacttcagtaggtaaacaaagcagccaggaagctcgaactgggtggagcccaccacagctcaaggaggcctgcctgcctcttgtagactccacctctggcagcagggcatagccaaacaaaaggcagcagaaacctctgcagacttaaatgtccctgtctgacagattggaagacagcagtggttctcccagcatgcagcttgagatccgagaacggacagactgcctcctcaagtgggtccctgacccccgagtagcctaactgggaggcaccccccagtaggggcagactgacacctcacacggccaggtacccctctgagacaaaatttccagaggaacgatcagacagcagcatttgctgttcaccaatattcgctgttctgcagcctccgctgctgatacccaggcaaacagggtctggagttgagctctggcaaactccgacagacctgcagctgagggtcctgactgttagaaggaaaactaacaaacagaaagaacatccacaccaaaaccccatctgcatgtcaccatcatcaaagaccaaaggtagataaaaccacaaagatggggaaaaaacagaacagaaaaactgaaaattctaaaaatcagagaacctcttcttctccaaaggaacgcagctcctcaccagcagcggaacaaagctggatggagaatgactttgatgagttgagagaagaaggcttcagacgatcaaacttctccgagctaaaggaggaagttcgaacccatggcaaagaagtcaaaaaccttgaaaaaagattagacaaatggctaactagaataactaatacacagaagtccttaaaggacctgatggagctgaaaaccacggcacgagaactacatgatgaatgcacaagcctcactaaccaattcgatcaactggaagaaagggtatcttgatggaagatcaaatgaatgaaatgaagtgagaagagaagtttagagaaaaaagaataaaaagaaacaaacaaaccctccaagaaatatgggactatgtgaaaagaccaaatctacatctgattggtgtacctgaaagtgacggggagaatggaaccaagttggaaaacactctgcaggaaattatgcaggagaacttccccaatccagcaaggcaggctaacattcaaattcaggaaatacagagaagtccacaaagatactccttgagaaggacaactccaagacacttaattgtcagattcaccaaagtggaaatgaaggaaaaaatgttaagggcagccagagacaaaggtcgggttacccacaaagggaagcccatcagactaatagctgatcgctcggcagaaattctacaagccagaagagagtgggggccaatattcaacattcttaaagaaaagaattttcaacacagaatttcatatccagccaaactaagcctcataagtgaaggagaaataaaatcctttacagacaagcaaatgctgagagattttgtcaccaccaggcctgccctacaagagctcctgaaggaagcactaaacatggaaaggaacaactggtaccagccactgcaaaaacatgccaaatcgtaaagaccatcaaggttaggaagaaactgcatcaactaacgagcaaaataaccagctaacatctcaatgacaggatcaaattcacacataacaatataaaccttaaatgtaaatgggctaaatactccaattaaaagacacagactggcaagttggataaagagtcaagacccatcagtgtgctgtattcaggaaacccttctcacgtgcagagacacacaggctcaaaataaagggatggaggaagatctaccaagcaaatggaaaacaaaacaaggcaggggttgcaaccctagtctctgataaaacagactttaaaccaacaaagatcaaaagagacaaagaaggccattacataatggtaaagggatcaattcaacaagaagagctaactaacctaaatatatatgcacccagtacaggagcacccggattcataaaggaagtccttagaggcctacgaagaggcttagactcccacacaataataatgggagactttaacacccactgtcaacattagacagatccacaagacagaaagttaacaaagatatctaggaattgaactcagccctgcaccaagtggagctaatagacatctacagaactctccaccccaattcaacaaaatatacattcttctcagcaccacaccgcacttgttccaaaattgaccacatagttggaagtaaagcactcctcagcaaatgtaaaagaacagaaatgataacaaactgtctctcagaccacagtgcgatcaaactagaactcaagattaagaaactcactcaaaaccgctcaactacatggaaactgaacaacctgctcctgaatgactactgggtacataacgaaatgaaggcagaaataaagaagttctttgaaaccaatgagaacaaagatacaacataccagaatctctgggagacatttaaagcagtgtgtagagggaaatttatagcactaaatgcccacaagagaaagcaggaaagatctaaaattgacaccctaacaccacaattaaaagaactagagaagcaagagcaaacacattcaaaagctagcagaaggcaagaaataactaagatcagagcagaactgaaggagacagagacacaaaaaacccttcaaaaaatcaatgaatccaggagctggttttttttaaaagatcaacaacattgacagaccactagcaagactaataaagaagaaaagagagaagaatcaaatagatgcaataaaaaatgataaaggggatatcaccactgatcccacagaaatacaaactaccatcagagaatactataaacacctctatgcaaataaactagaaaatctagaagaaatggataaattcctggacacatacaccctcccaagactaaaccaggaagaagttgaatctctgaatagaccaataacaggctctgaaattgaggcaataattaatagcttaccaaccaaaaaaagtccaggaccagacagattcacagccaaattctaccagaggtacaaggaggagctggtaccattccttctgaaactattccaatcaatagaaaaagagggaatcttctctaactcattttatgaggccagcatcatcctgataccaaagcctggcagagacacaacagaaaaagagaattttagaccaatatccctgatgaacatcgatgcaaaaatcatcaataaaatactggcaaaccgaatccagcaaacacatcaaaaagcttatccaccatgatcaagtgggcttcatccctgggatgcaaggctggttcaacatatgcaaatcaataaacataatccagcatataaacagaaccaaagacaaaaaccacatgattatctcaacagatgcagaaaaggcctttgataaaatccaacaacccttcatgctaaaaactctcaataaattggtactgatgggacatatctcaaaataatgggagctatttatgacaaacccacagccaatatcatactgaatgggcaaaaactggaagcattccctttgaaaactggcataagacagggatgccctctctcactactcctattcaacatagtgttggaagttctggccagggcaatcaggcaagagaaggaaataaaggttattcaagtaggaaaagaggaagtcaaattgtccctgtttgcagatgacatgattgtgtatctagaagaccccatcatctcagccccaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctgggaatccaacttacaagggatgtgaaggacctcttcaaggaaaactacaaaccactgctcaaggaaataagaggatacaaacaaatggaagaacattccatgctcatgggtaggaagaatcaatatagtgaaaatggccatactgcccaaggtaatttatagattcaatgccatccccatcaagctaccaatgactttcttcacagaattggaaaaaagctactttaaagttcatatggaaccaaaaaagagcccgcatcaccaagtcaatcctaagccaaaagaacaaagctggaggcatcatgctacctgacttcaaactatactacaagactacagtaaccaaagcagcatggtactggtaccaaaacagagatacagaccaatggaacagaacagagccctcagaaataatgccacacatctacaactatctgatctttgacaaacctgacaaaaacaagcaatggggaaaggattccctatttaataaatggtgctgggaaaactggctagccatatgtagaaagctgaaactggaccccttccttacaccttatacaaaaattaattcaagatggattaaagacttaaatgttagacctaaaaccataaaaaccctagaagaaaacctaggcaataccattcaggacataggcatggacaaggacttcacgtctaaaacaccaaaagcaatggcaacaaaagccaaaattgacaaatgggatataattaaactaaagagcttctgcacagccaaagaaactaccatcagagtgaacaggcaacctacagaatgggagaaaatttttgcaatctactcatctgacaaagggctaatatccagaatctacaatgaactcaaacaaatttacaagaaaaaatcaaacaaccccatcaaaaagtgggcaaaggatatgaacgacacttctcaaaagaagatatttatgcagccaaaagacacatgaaaaaaggctcatcatcactggccatcagagaaatgcaaatcaaaaccacaatgccatactatctcataccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattacaaatcattctgctataaagacacatgcacacgtatgtttattacagcagtgctcacaatagcaaagacttggaaccaacccaaatgtccatcaatgacagactggattaagaaaatgtggcacatatacaccatggaatactatgcagccatataaaaggatgagtttatgtcctttgtagggacatggatgaagctggaaaccatcgttctcagcaaagtatcccaaggacaaaaaaccaaacactgcatgttctcactcatagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagaagggccccgtagaagcaaagccagagtgccaggagacagaaacgaagccagcgccagccgaagtcaagacggtccccaatgacgccacacagacaaaggagaacgagagcaaagcatga

SEQ ID NO: 10986 - DNA, 7147 bp, synthetic construct
  misc_feature 1..7147: note = Synthetic polypeptide
  source 1..7147: mol_type = other DNA
ggggcggttccaagatggccgaataagaacagctccagtccacagctcccagcatgagcgacgcagaagacggatgatttctgcatttccaactgaggtaccgggttcatctcactggggactgtcggacagtgggttcaggacagtgggtgcagcgcaccgagcgtgagccgaagcagggcgaggcatcacctcacctgggaagcacaaggggtcagggaattcccttttctagccaaggaaaggggtgacagacagcatctgaaaaattgggtcattcccaccctaatactacacttttccgatggtcttagcaaacggcacaccaggagattatatcccgcgcatggctcagagggtcctacgcccacggagcctcgctcattgctagcacagcagtctgagatcaaactgcaaggcggcagcaaggctgggggaggggcgcccgccattgctgagacttcagtaggtaaacaaagcagccaggaagctcgaactgggtggagcccaccacagctcaaggaggcctgcctgcctcttgtagactccacctctggcagcagggcatagccaaacaaaaggcagcagaaacctctgcagacttaaatgtccctgtctgacagattggaagacagcagtggttctcccagcatgcagcttgagatccgagaacggacagactgcctcctcaagtgggtccctgacccccgagtagcctaactgggaggcaccccccagtaggggcagactgacacctcacacggccaggtacccctctgagacaaaatttccagaggaacgatcagacagcagcatttgctgttcaccaatattcgctgttctgcagcctccgctgctgatacccaggcaaacagggtctggagttgagctctggcaaactccgacagacctgcagctgagggtcctgactgttagaaggaaaactaacaaacagaaagaacatccacaccaaaaccccatctgcatgtcaccatcatcaaagaccaaaggtagataaaaccacaaagatggggaaaaaacagaacagaaaaactgaaaattctaaaaatcagagaacctcttcttctccaaaggaacgcagctcctcaccagcagcggaacaaagctggatggagaatgactttgatgagttgagagaagaaggcttcagacgatcaaacttctccgagctaaaggaggaagttcgaacccatggcaaagaagtcaaaaaccttgaaaaaagattagacaaatggctaactagaataactaatacacagaagtccttaaaggacctgatggagctgaaaaccacggcacgagaactacatgatgaatgcacaagcctcactaaccaattcgatcaactggaagaaagggtatcttgatggaagatcaaatgaatgaaatgaagtgagaagagaagtttagagaaaaaagaataaaaagaaacaaacaaaccctccaagaaatatgggactatgtgaaaagaccaaatctacatctgattggtgtacctgaaagtgacggggagaatggaaccaagttggaaaacactctgcaggaaattatgcaggagaacttccccaatccagcaaggcaggctaacattcaaattcaggaaatacagagaagtccacaaagatactccttgagaaggacaactccaagacacttaattgtcagattcaccaaagtggaaatgaaggaaaaaatgttaagggcagccagagacaaaggtcgggttacccacaaagggaagcccatcagactaatagctgatcgctcggcagaaattctacaagccagaagagagtgggggccaatattcaacattcttaaagaaaagaattttcaacacagaatttcatatccagccaaactaagcctcataagtgaaggagaaataaaatcctttacagacaagcaaatgctgagagattttgtcaccaccaggcctgccctacaagagctcctgaaggaagcactaaacatggaaaggaacaactggtaccagccactgcaaaaacatgccaaatcgtaaagaccatcaaggttaggaagaaactgcatcaactaacgagcaaaataaccagctaacatctcaatgacaggatcaaattcacacataacaatataaaccttaaatgtaaatgggctaaatactccaattaaaagacacagactggcaagttggataaagagtcaagacccatcagtgtgctgtattcaggaaacccttctcacgtgcagagacacacaggctcaaaataaagggatggaggaagatctaccaagcaaatggaaaacaaaacaaggcaggggttgcaaccctagtctctgataaaacagactttaaaccaacaaagatcaaaagagacaaagaaggccattacataatggtaaagggatcaattcaacaagaagagctaactaacctaaatatatatgcacccagtacaggagcacccggattcataaaggaagtccttagaggcctacgaagaggcttagactcccacacaataataatgggagactttaacacccactgtcaacattagacagatccacaagacagaaagttaacaaagatatctaggaattgaactcagccctgcaccaagtggagctaatagacatctacagaactctccaccccaattcaacaaaatatacattcttctcagcaccacaccgcacttgttccaaaattgaccacatagttggaagtaaagcactcctcagcaaatgtaaaagaacagaaatgataacaaactgtctctcagaccacagtgcgatcaaactagaactcaagattaagaaactcactcaaaaccgctcaactacatggaaactgaacaacctgctcctgaatgactactgggtacataacgaaatgaaggcagaaataaagaagttctttgaaaccaatgagaacaaagatacaacataccagaatctctgggagacatttaaagcagtgtgtagagggaaatttatagcactaaatgcccacaagagaaagcaggaaagatctaaaattgacaccctaacaccacaattaaaagaactagagaagcaagagcaaacacattcaaaagctagcagaaggcaagaaataactaagatcagagcagaactgaaggagacagagacacaaaaaacccttcaaaaaatcaatgaatccaggagctggttttttttaaaagatcaacaacattgacagaccactagcaagactaataaagaagaaaagagagaagaatcaaatagatgcaataaaaaatgataaaggggatatcaccactgatcccacagaaatacaaactaccatcagagaatactataaacacctctatgcaaataaactagaaaatctagaagaaatggataaattcctggacacatacaccctcccaagactaaaccaggaagaagttgaatctctgaatagaccaataacaggctctgaaattgaggcaataattaatagcttaccaaccaaaaaaagtccaggaccagacagattcacagccaaattctaccagaggtacaaggaggagctggtaccattccttctgaaactattccaatcaatagaaaaagagggaatcttctctaactcattttatgaggccagcatcatcctgataccaaagcctggcagagacacaacagaaaaagagaattttagaccaatatccctgatgaacatcgatgcaaaaatcatcaataaaatactggcaaaccgaatccagcaaacacatcaaaaagcttatccaccatgatcaagtgggcttcatccctgggatgcaaggctggttcaacatatgcaaatcaataaacataatccagcatataaacagaaccaaagacaaaaaccacatgattatctcaacagatgcagaaaaggcctttgataaaatccaacaacccttcatgctaaaaactctcaataaattggtactgatgggacatatctcaaaataatgggagctatttatgacaaacccacagccaatatcatactgaatgggcaaaaactggaagcattccctttgaaaactggcataagacagggatgccctctctcactactcctattcaacatagtgttggaagttctggccagggcaatcaggcaagagaaggaaataaaggttattcaagtaggaaaagaggaagtcaaattgtccctgtttgcagatgacatgattgtgtatctagaagaccccatcatctcagccccaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctgggaatccaacttacaagggatgtgaaggacctcttcaaggaaaactacaaaccactgctcaaggaaataagaggatacaaacaaatggaagaacattccatgctcatgggtaggaagaatcaatatagtgaaaatggccatactgcccaaggtaatttatagattcaatgccatccccatcaagctaccaatgactttcttcacagaattggaaaaaagctactttaaagttcatatggaaccaaaaaagagcccgcatcaccaagtcaatcctaagccaaaagaacaaagctggaggcatcatgctacctgacttcaaactatactacaagactacagtaaccaaagcagcatggtactggtaccaaaacagagatacagaccaatggaacagaacagagccctcagaaataatgccacacatctacaactatctgatctttgacaaacctgacaaaaacaagcaatggggaaaggattccctatttaataaatggtgctgggaaaactggctagccatatgtagaaagctgaaactggaccccttccttacaccttatacaaaaattaattcaagatggattaaagacttaaatgttagacctaaaaccataaaaaccctagaagaaaacctaggcaataccattcaggacataggcatggacaaggacttcacgtctaaaacaccaaaagcaatggcaacaaaagccaaaattgacaaatgggatataattaaactaaagagcttctgcacagccaaagaaactaccatcagagtgaacaggcaacctacagaatgggagaaaatttttgcaatctactcatctgacaaagggctaatatccagaatctacaatgaactcaaacaaatttacaagaaaaaatcaaacaaccccatcaaaaagtgggcaaaggatatgaacgacacttctcaaaagaagatatttatgcagccaaaagacacatgaaaaaaggctcatcatcactggccatcagagaaatgcaaatcaaaaccacaatgccatactatctcataccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattacaaatcattctgctataaagacacatgcacacgtatgtttattacagcagtgctcacaatagcaaagacttggaaccaacccaaatgtccatcaatgacagactggattaagaaaatgtggcacatatacaccatggaatactatgcagccatataaaaggatgagtttatgtcctttgtagggacatggatgaagctggaaaccatcgttctcagcaaagtatcccaaggacaaaaaaccaaacactgcatgttctcactcatagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccatagccctcctccaccggcatctgctagctcgtctacccctgttccattgtctccaccagatacaacttggcctcttcctgcccttgcaaccacagaaccagctaaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagcaaccttgggaggcaattctgcatcctacacctttgtctcattgcttttctctgcagtgactcttcttttgctctgttag

SEQ ID NO: 10987 - DNA, 6829 bp, synthetic construct
  misc_feature 1..6829: note = Synthetic polypeptide
  source 1..6829: mol_type = other DNA
ggggcggttccaagatggccgaataagaacagctccagtccacagctcccagcatgagcgacgcagaagacggatgatttctgcatttccaactgaggtaccgggttcatctcactggggactgtcggacagtgggttcaggacagtgggtgcagcgcaccgagcgtgagccgaagcagggcgaggcatcacctcacctgggaagcacaaggggtcagggaattcccttttctagccaaggaaaggggtgacagacagcatctgaaaaattgggtcattcccaccctaatactacacttttccgatggtcttagcaaacggcacaccaggagattatatcccgcgcatggctcagagggtcctacgcccacggagcctcgctcattgctagcacagcagtctgagatcaaactgcaaggcggcagcaaggctgggggaggggcgcccgccattgctgagacttcagtaggtaaacaaagcagccaggaagctcgaactgggtggagcccaccacagctcaaggaggcctgcctgcctcttgtagactccacctctggcagcagggcatagccaaacaaaaggcagcagaaacctctgcagacttaaatgtccctgtctgacagattggaagacagcagtggttctcccagcatgcagcttgagatccgagaacggacagactgcctcctcaagtgggtccctgacccccgagtagcctaactgggaggcaccccccagtaggggcagactgacacctcacacggccaggtacccctctgagacaaaatttccagaggaacgatcagacagcagcatttgctgttcaccaatattcgctgttctgcagcctccgctgctgatacccaggcaaacagggtctggagttgagctctggcaaactccgacagacctgcagctgagggtcctgactgttagaaggaaaactaacaaacagaaagaacatccacaccaaaaccccatctgcatgtcaccatcatcaaagaccaaaggtagataaaaccacaaagatggggaaaaaacagaacagaaaaactgaaaattctaaaaatcagagaacctcttcttctccaaaggaacgcagctcctcaccagcagcggaacaaagctggatggagaatgactttgatgagttgagagaagaaggcttcagacgatcaaacttctccgagctaaaggaggaagttcgaacccatggcaaagaagtcaaaaaccttgaaaaaagattagacaaatggctaactagaataactaatacacagaagtccttaaaggacctgatggagctgaaaaccacggcacgagaactacatgatgaatgcacaagcctcactaaccaattcgatcaactggaagaaagggtatcttgatggaagatcaaatgaatgaaatgaagtgagaagagaagtttagagaaaaaagaataaaaagaaacaaacaaaccctccaagaaatatgggactatgtgaaaagaccaaatctacatctgattggtgtacctgaaagtgacggggagaatggaaccaagttggaaaacactctgcaggaaattatgcaggagaacttccccaatccagcaaggcaggctaacattcaaattcaggaaatacagagaagtccacaaagatactccttgagaaggacaactccaagacacttaattgtcagattcaccaaagtggaaatgaaggaaaaaatgttaagggcagccagagacaaaggtcgggttacccacaaagggaagcccatcagactaatagctgatcgctcggcagaaattctacaagccagaagagagtgggggccaatattcaacattcttaaagaaaagaattttcaacacagaatttcatatccagccaaactaagcctcataagtgaaggagaaataaaatcctttacagacaagcaaatgctgagagattttgtcaccaccaggcctgccctacaagagctcctgaaggaagcactaaacatggaaaggaacaactggtaccagccactgcaaaaacatgccaaatcgtaaagaccatcaaggttaggaagaaactgcatcaactaacgagcaaaataaccagctaacatctcaatgacaggatcaaattcacacataacaatataaaccttaaatgtaaatgggctaaatactccaattaaaagacacagactggcaagttggataaagagtcaagacccatcagtgtgctgtattcaggaaacccttctcacgtgcagagacacacaggctcaaaataaagggatggaggaagatctaccaagcaaatggaaaacaaaacaaggcaggggttgcaaccctagtctctgataaaacagactttaaaccaacaaagatcaaaagagacaaagaaggccattacataatggtaaagggatcaattcaacaagaagagctaactaacctaaatatatatgcacccagtacaggagcacccggattcataaaggaagtccttagaggcctacgaagaggcttagactcccacacaataataatgggagactttaacacccactgtcaacattagacagatccacaagacagaaagttaacaaagatatctaggaattgaactcagccctgcaccaagtggagctaatagacatctacagaactctccaccccaattcaacaaaatatacattcttctcagcaccacaccgcacttgttccaaaattgaccacatagttggaagtaaagcactcctcagcaaatgtaaaagaacagaaatgataacaaactgtctctcagaccacagtgcgatcaaactagaactcaagattaagaaactcactcaaaaccgctcaactacatggaaactgaacaacctgctcctgaatgactactgggtacataacgaaatgaaggcagaaataaagaagttctttgaaaccaatgagaacaaagatacaacataccagaatctctgggagacatttaaagcagtgtgtagagggaaatttatagcactaaatgcccacaagagaaagcaggaaagatctaaaattgacaccctaacaccacaattaaaagaactagagaagcaagagcaaacacattcaaaagctagcagaaggcaagaaataactaagatcagagcagaactgaaggagacagagacacaaaaaacccttcaaaaaatcaatgaatccaggagctggttttttttaaaagatcaacaacattgacagaccactagcaagactaataaagaagaaaagagagaagaatcaaatagatgcaataaaaaatgataaaggggatatcaccactgatcccacagaaatacaaactaccatcagagaatactataaacacctctatgcaaataaactagaaaatctagaagaaatggataaattcctggacacatacaccctcccaagactaaaccaggaagaagttgaatctctgaatagaccaataacaggctctgaaattgaggcaataattaatagcttaccaaccaaaaaaagtccaggaccagacagattcacagccaaattctaccagaggtacaaggaggagctggtaccattccttctgaaactattccaatcaatagaaaaagagggaatcttctctaactcattttatgaggccagcatcatcctgataccaaagcctggcagagacacaacagaaaaagagaattttagaccaatatccctgatgaacatcgatgcaaaaatcatcaataaaatactggcaaaccgaatccagcaaacacatcaaaaagcttatccaccatgatcaagtgggcttcatccctgggatgcaaggctggttcaacatatgcaaatcaataaacataatccagcatataaacagaaccaaagacaaaaaccacatgattatctcaacagatgcagaaaaggcctttgataaaatccaacaacccttcatgctaaaaactctcaataaattggtactgatgggacatatctcaaaataatgggagctatttatgacaaacccacagccaatatcatactgaatgggcaaaaactggaagcattccctttgaaaactggcataagacagggatgccctctctcactactcctattcaacatagtgttggaagttctggccagggcaatcaggcaagagaaggaaataaaggttattcaagtaggaaaagaggaagtcaaattgtccctgtttgcagatgacatgattgtgtatctagaagaccccatcatctcagccccaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctgggaatccaacttacaagggatgtgaaggacctcttcaaggaaaactacaaaccactgctcaaggaaataagaggatacaaacaaatggaagaacattccatgctcatgggtaggaagaatcaatatagtgaaaatggccatactgcccaaggtaatttatagattcaatgccatccccatcaagctaccaatgactttcttcacagaattggaaaaaagctactttaaagttcatatggaaccaaaaaagagcccgcatcaccaagtcaatcctaagccaaaagaacaaagctggaggcatcatgctacctgacttcaaactatactacaagactacagtaaccaaagcagcatggtactggtaccaaaacagagatacagaccaatggaacagaacagagccctcagaaataatgccacacatctacaactatctgatctttgacaaacctgacaaaaacaagcaatggggaaaggattccctatttaataaatggtgctgggaaaactggctagccatatgtagaaagctgaaactggaccccttccttacaccttatacaaaaattaattcaagatggattaaagacttaaatgttagacctaaaaccataaaaaccctagaagaaaacctaggcaataccattcaggacataggcatggacaaggacttcacgtctaaaacaccaaaagcaatggcaacaaaagccaaaattgacaaatgggatataattaaactaaagagcttctgcacagccaaagaaactaccatcagagtgaacaggcaacctacagaatgggagaaaatttttgcaatctactcatctgacaaagggctaatatccagaatctacaatgaactcaaacaaatttacaagaaaaaatcaaacaaccccatcaaaaagtgggcaaaggatatgaacgacacttctcaaaagaagatatttatgcagccaaaagacacatgaaaaaaggctcatcatcactggccatcagagaaatgcaaatcaaaaccacaatgccatactatctcataccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattacaaatcattctgctataaagacacatgcacacgtatgtttattacagcagtgctcacaatagcaaagacttggaaccaacccaaatgtccatcaatgacagactggattaagaaaatgtggcacatatacaccatggaatactatgcagccatataaaaggatgagtttatgtcctttgtagggacatggatgaagctggaaaccatcgttctcagcaaagtatcccaaggacaaaaaaccaaacactgcatgttctcactcatagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccaggccccacctcctacggcatctgctagctcgtctacccctgttccattgtctccaccagatacaacttggcctcttcctgcccttgcaaccacagaaccagctaaaaacattgcacagaatcactgctgtaacatgttccaagctggtcttcataatgctctaatgaagtaa

SEQ ID NO: 10988 - DNA, 7408 bp, synthetic construct
  misc_feature 1..7408: note = Synthetic polypeptide
  source 1..7408: mol_type = other DNA
ggggcggttccaagatggccgaataagaacagctccagtccacagctcccagcatgagcgacgcagaagacggatgatttctgcatttccaactgaggtaccgggttcatctcactggggactgtcggacagtgggttcaggacagtgggtgcagcgcaccgagcgtgagccgaagcagggcgaggcatcacctcacctgggaagcacaaggggtcagggaattcccttttctagccaaggaaaggggtgacagacagcatctgaaaaattgggtcattcccaccctaatactacacttttccgatggtcttagcaaacggcacaccaggagattatatcccgcgcatggctcagagggtcctacgcccacggagcctcgctcattgctagcacagcagtctgagatcaaactgcaaggcggcagcaaggctgggggaggggcgcccgccattgctgagacttcagtaggtaaacaaagcagccaggaagctcgaactgggtggagcccaccacagctcaaggaggcctgcctgcctcttgtagactccacctctggcagcagggcatagccaaacaaaaggcagcagaaacctctgcagacttaaatgtccctgtctgacagattggaagacagcagtggttctcccagcatgcagcttgagatccgagaacggacagactgcctcctcaagtgggtccctgacccccgagtagcctaactgggaggcaccccccagtaggggcagactgacacctcacacggccaggtacccctctgagacaaaatttccagaggaacgatcagacagcagcatttgctgttcaccaatattcgctgttctgcagcctccgctgctgatacccaggcaaacagggtctggagttgagctctggcaaactccgacagacctgcagctgagggtcctgactgttagaaggaaaactaacaaacagaaagaacatccacaccaaaaccccatctgcatgtcaccatcatcaaagaccaaaggtagataaaaccacaaagatggggaaaaaacagaacagaaaaactgaaaattctaaaaatcagagaacctcttcttctccaaaggaacgcagctcctcaccagcagcggaacaaagctggatggagaatgactttgatgagttgagagaagaaggcttcagacgatcaaacttctccgagctaaaggaggaagttcgaacccatggcaaagaagtcaaaaaccttgaaaaaagattagacaaatggctaactagaataactaatacacagaagtccttaaaggacctgatggagctgaaaaccacggcacgagaactacatgatgaatgcacaagcctcactaaccaattcgatcaactggaagaaagggtatcttgatggaagatcaaatgaatgaaatgaagtgagaagagaagtttagagaaaaaagaataaaaagaaacaaacaaaccctccaagaaatatgggactatgtgaaaagaccaaatctacatctgattggtgtacctgaaagtgacggggagaatggaaccaagttggaaaacactctgcaggaaattatgcaggagaacttccccaatccagcaaggcaggctaacattcaaattcaggaaatacagagaagtccacaaagatactccttgagaaggacaactccaagacacttaattgtcagattcaccaaagtggaaatgaaggaaaaaatgttaagggcagccagagacaaaggtcgggttacccacaaagggaagcccatcagactaatagctgatcgctcggcagaaattctacaagccagaagagagtgggggccaatattcaacattcttaaagaaaagaattttcaacacagaatttcatatccagccaaactaagcctcataagtgaaggagaaataaaatcctttacagacaagcaaatgctgagagattttgtcaccaccaggcctgccctacaagagctcctgaaggaagcactaaacatggaaaggaacaactggtaccagccactgcaaaaacatgccaaatcgtaaagaccatcaaggttaggaagaaactgcatcaactaacgagcaaaataaccagctaacatctcaatgacaggatcaaattcacacataacaatataaaccttaaatgtaaatgggctaaatactccaattaaaagacacagactggcaagttggataaagagtcaagacccatcagtgtgctgtattcaggaaacccttctcacgtgcagagacacacaggctcaaaataaagggatggaggaagatctaccaagcaaatggaaaacaaaacaaggcaggggttgcaaccctagtctctgataaaacagactttaaaccaacaaagatcaaaagagacaaagaaggccattacataatggtaaagggatcaattcaacaagaagagctaactaacctaaatatatatgcacccagtacaggagcacccggattcataaaggaagtccttagaggcctacgaagaggcttagactcccacacaataataatgggagactttaacacccactgtcaacattagacagatccacaagacagaaagttaacaaagatatctaggaattgaactcagccctgcaccaagtggagctaatagacatctacagaactctccaccccaattcaacaaaatatacattcttctcagcaccacaccgcacttgttccaaaattgaccacatagttggaagtaaagcactcctcagcaaatgtaaaagaacagaaatgataacaaactgtctctcagaccacagtgcgatcaaactagaactcaagattaagaaactcactcaaaaccgctcaactacatggaaactgaacaacctgctcctgaatgactactgggtacataacgaaatgaaggcagaaataaagaagttctttgaaaccaatgagaacaaagatacaacataccagaatctctgggagacatttaaagcagtgtgtagagggaaatttatagcactaaatgcccacaagagaaagcaggaaagatctaaaattgacaccctaacaccacaattaaaagaactagagaagcaagagcaaacacattcaaaagctagcagaaggcaagaaataactaagatcagagcagaactgaaggagacagagacacaaaaaacccttcaaaaaatcaatgaatccaggagctggttttttttaaaagatcaacaacattgacagaccactagcaagactaataaagaagaaaagagagaagaatcaaatagatgcaataaaaaatgataaaggggatatcaccactgatcccacagaaatacaaactaccatcagagaatactataaacacctctatgcaaataaactagaaaatctagaagaaatggataaattcctggacacatacaccctcccaagactaaaccaggaagaagttgaatctctgaatagaccaataacaggctctgaaattgaggcaataattaatagcttaccaaccaaaaaaagtccaggaccagacagattcacagccaaattctaccagaggtacaaggaggagctggtaccattccttctgaaactattccaatcaatagaaaaagagggaatcttctctaactcattttatgaggccagcatcatcctgataccaaagcctggcagagacacaacagaaaaagagaattttagaccaatatccctgatgaacatcgatgcaaaaatcatcaataaaatactggcaaaccgaatccagcaaacacatcaaaaagcttatccaccatgatcaagtgggcttcatccctgggatgcaaggctggttcaacatatgcaaatcaataaacataatccagcatataaacagaaccaaagacaaaaaccacatgattatctcaacagatgcagaaaaggcctttgataaaatccaacaacccttcatgctaaaaactctcaataaattggtactgatgggacatatctcaaaataatgggagctatttatgacaaacccacagccaatatcatactgaatgggcaaaaactggaagcattccctttgaaaactggcataagacagggatgccctctctcactactcctattcaacatagtgttggaagttctggccagggcaatcaggcaagagaaggaaataaaggttattcaagtaggaaaagaggaagtcaaattgtccctgtttgcagatgacatgattgtgtatctagaagaccccatcatctcagccccaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctgggaatccaacttacaagggatgtgaaggacctcttcaaggaaaactacaaaccactgctcaaggaaataagaggatacaaacaaatggaagaacattccatgctcatgggtaggaagaatcaatatagtgaaaatggccatactgcccaaggtaatttatagattcaatgccatccccatcaagctaccaatgactttcttcacagaattggaaaaaagctactttaaagttcatatggaaccaaaaaagagcccgcatcaccaagtcaatcctaagccaaaagaacaaagctggaggcatcatgctacctgacttcaaactatactacaagactacagtaaccaaagcagcatggtactggtaccaaaacagagatacagaccaatggaacagaacagagccctcagaaataatgccacacatctacaactatctgatctttgacaaacctgacaaaaacaagcaatggggaaaggattccctatttaataaatggtgctgggaaaactggctagccatatgtagaaagctgaaactggaccccttccttacaccttatacaaaaattaattcaagatggattaaagacttaaatgttagacctaaaaccataaaaaccctagaagaaaacctaggcaataccattcaggacataggcatggacaaggacttcacgtctaaaacaccaaaagcaatggcaacaaaagccaaaattgacaaatgggatataattaaactaaagagcttctgcacagccaaagaaactaccatcagagtgaacaggcaacctacagaatgggagaaaatttttgcaatctactcatctgacaaagggctaatatccagaatctacaatgaactcaaacaaatttacaagaaaaaatcaaacaaccccatcaaaaagtgggcaaaggatatgaacgacacttctcaaaagaagatatttatgcagccaaaagacacatgaaaaaaggctcatcatcactggccatcagagaaatgcaaatcaaaaccacaatgccatactatctcataccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattacaaatcattctgctataaagacacatgcacacgtatgtttattacagcagtgctcacaatagcaaagacttggaaccaacccaaatgtccatcaatgacagactggattaagaaaatgtggcacatatacaccatggaatactatgcagccatataaaaggatgagtttatgtcctttgtagggacatggatgaagctggaaaccatcgttctcagcaaagtatcccaaggacaaaaaaccaaacactgcatgttctcactcatagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtcccaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagaagggccccgtagaagcaaagccagagtgccaggagacagaaacgaagccagcgccagccgaagtcaagacggtccccaatgacgccacacagacaaaggagaacgagagcaaagcatga

SEQ ID NO: 10989 - DNA, 379 bp, synthetic construct; identical to SEQ ID NO: 9067
  misc_feature 1..379: note = Synthetic polypeptide
  source 1..379: mol_type = other DNA

SEQ ID NO: 10990 - DNA, 948 bp, synthetic construct
  misc_feature 1..948: note = Synthetic polypeptide
  source 1..948: mol_type = other DNA
caaggccagcctcctgacgtgcgacctgcacagtggcgcaaggcccatgctcatagttgtttggtttaaaactctgctgttgcttttttttccccccaaacattcatggagctgaatgccatcgctgtcttgaaattcttcatagttctatctttgaatttgtgctttgtaagtaacatccagtggagcactggcgcatgcgtgtgagcagaggagatacgtcccattcacacagcgttccagatgcaacatggacacagaattctggggaacctacaacgtgtgggagttcagccagactccagatgagtataaggcttgatgattcgccccaagactgagaaccttgatgtcattgtcaatgtcagtgacactgaaagctgggaccagcatgttcagaagctcaacaagttcttggagccttacaacgactctatccaagcccaaaagaatgatgtctgccgccctggacgctattacgaacagccagataatggagtcctcaactaccccaaacgtgcctgccaattcaaccggacccagctgggcaactgctccggcattggggactccacccactatggttacagcactgggcagccctgtgtcttcatcaagatgaaccgggtcatcaacttctatgcaggagcaaaccagagcatgaatgttacctgtgctgggaagcgagatgaagatgctgagaatctcggcaacttcgtcatgttccccgccaacggcaacatcgacctcatgtacttcccctactatggcaaaaagttccacgtgaactacacacagcccctggtggctgtgaagttcctgaatgtgacccccaacgtggaggtgaatgtagaatgtcgcatcaacgccgccaacatcgccacagacgatgagcgagacaagttcgccggccgcgtggccttcaaactccgcatcaacaaaacctga

SEQ ID NO: 10991 - DNA, 113 bp, synthetic construct
  misc_feature 1..113: note = Synthetic polypeptide
  source 1..113: mol_type = other DNA
ggctgggcacagtggctcatgtctgtaatcccaacactttgggaggccgaggccggtgggtcacttgaggtcaggaatttgagaccagcctggccaatatggacaagcactga

SEQ ID NO: 10992 - DNA, 447 bp, synthetic construct
  misc_feature 1..447: note = Synthetic polypeptide
  source 1..447: mol_type = other DNA
tgtttttcttgattaattcttctgcagtacttgccatgaagtaataaacactccttccctattaaatatagcactttgaaagaaagcagactaaatcaagactgttgttcaaagtgaatagatggaagaattgatagttctgtcaggaaacaggaaatggaagataaagtgactagtccagagaaagcagaagaagcaaaattaaaagcaagatatcctcatctgggacaaaagcctggaggttcagatttcttaaggaaacggttgcagaaagggcaaaaatattttgattctggggattacaacatggctaaagcaaaaatgaagaacaagcaacttcctactgcagctccggataagacggaggtcactggtgaccacattcccactccgcaagaccttcctcaacggaagccgtcccttgttgctagcaagctggctggctga

SEQ ID NO: 10993 - DNA, 811 bp, synthetic construct
  misc_feature 1..811: note = Synthetic polypeptide
  source 1..811: mol_type = other DNA
ttcccaaagtgtgttccttggtatgccgtttcaatggaatattagcacatgttatgtgaagaaaaaaggtgctgtaactggtgagtttgggaagtgctgggttagacaaatgtaaataaggcttctttactaagaatgtctctgagcttttcatgctgtaatgtgccccgagatcttacagatgaccgtggatcacctgaaaatgctgcatacggcaggagggaaaggttactttgacgcgcacgcccttgctatggactatcggagtttgggatttcgggaatgcctggcagaagttgcgcgttatctgagcatcattgaaggactagatgcctctgacccgcttcgagttcgactggtttcgcatctcaacaactacgcttcccagcgggaagccgcgagcggcgcccacgcgggcctcggacacattccctgggggaccgtcttcggacatcacccgcacatcgcgcacccgctgttgctgccccagaacggccacgggaacgcgggcaccacggcctcacccacggaaccgcaccaccagggcaggctgggctcggcacatccggaggcgcctgctttgcgagcgccccctagcggcagcctcggaccggtgctccctgtggtcacctccgcctccaaactgtcgccgcctctgctctcctcagtggcctccctgtcggccttccccttctctttcggctccttccacttactgtctcccaatgcactgagcccttcagcacccacgcaggctgcaaaccttggcaagccctatagaccttgggggacggagatcggagctttttaa

SEQ ID NO: 10994 - DNA, 568 bp, synthetic construct
  misc_feature 1..568: note = Synthetic polypeptide
  source 1..568: mol_type = other DNA
ttcccaaagtgtgttccttggtatgccgtttcaatggaatattagcacatgttatgtgaagaaaaaaggtgctgtaactggtgagtttgggaagtgctgggttagacaaatgtaaataaggcttctttactaagaatgtctctgagcttttcatgctgtaatgtgccccgagatcttacagatgaccgtggatcacctgaaaatgctgcatacggcaggagggaaaggttactttgacgcgcacgcccttgctatggactatcggagtttgggatttcgggaatgcctggcagaagttgcgcgttatctgagcatcattgaaggactagatgcctctgacccgcttcgagttcgactggtttcgcatctcaacaactacgcttcccagcgggaagccgcgagcggcgcccacgcgggcctcggacacattccctgggggaccgtcttcggacatcacccgcacatcgcgcacccgctgttgctgccccagaacggccacgggaacgcgggcaccacggcctcacccacggaaccgcaccaccagggcaggctgggctcggcacatccg

SEQ ID NO: 10995 - DNA, 716 bp, synthetic construct
  misc_feature 1..716: note = Synthetic polypeptide
  source 1..716: mol_type = other DNA
tggaatgagccctggacaggatcctaagatccggtcagcctttagtgccaagagagaacattacagcatggatgaatgcaattggtttgatcatcactgccctaccagagccatattggattgttcttcatgatcgaattgtgagtgtcatcagcagccccagcttgacgtctgaaacagagtgggttggctatccattccgcctctttgatttcactgcctgtcatcagtcctactctgagatgagttgtagctatacgttagctcttgcacatgctgtgtggcaccattctagcatcggacaactttctctcattccaaagtttcttactgaagtacttcttcctatagtgaagaccgaattccagttgctttatgtataccatcttgttggaccatttttacaaagatttcagcaagagagaactcgttgtatgatagagattggtgtggcgttttatgacatgctgctgaatgttgaccagtgtagcacccatttaaattacatggatcccatctgtgacttcctctatcacatgaagtatatgtttactggtgacagcgtgaaagagcaagtagagaagattatctgtaacttaaaaccagctttaaaacttcgtcttcgattcatcacacacattagcaagatggagccagctgcagtgcctccacaagccatgaacagtgggtctccagcacctcagtctaatcagtaa

SEQ ID NO: 10996 - DNA, 743 bp, synthetic construct
  misc_feature 1..743: note = Synthetic polypeptide
  source 1..743: mol_type = other DNA
tggaatgagccctggacaggatcctaagatccggtcagcctttagtgccaagagagaacattacagcatggatgaatgcaattggtttgatcatcactgccctaccagagccatattggattgttcttcatgatcgaattgtgagtgtcatcagcagccccagcttgacgtctgaaacagagtgggttggctatccattccgcctctttgatttcactgcctgtcatcagtcctactctgagatgagttgtagctatacgttagctcttgcacatgctgtgtggcaccattctagcatcggacaactttctctcattccaaagtttcttactgaagtacttcttcctatagtgaagaccgaattccagttgctttatgtataccatcttgttggaccatttttacaaagatttcagcaagagagaactcgttgtatgatagagattggtgtggcgttttatgacatgctgctgaatgttgaccagtgtagcacccatttaaattacatggatcccatctgtgacttcctctatcacatgaagtatatgtttactggtgacagcgtgaaagagcaagtagagaagattatctgtaacttaaaaccagctttaaaacttcgtcttcgattcatcacacacattagcaagatggagccagctgcagtgcctccacaagccatgaacagtgggtctccagcacctcagtctaatcaggtgcccgtgtctttaccagtaactcagtga

SEQ ID NO: 10997 - DNA, 731 bp, synthetic construct
  misc_feature 1..731: note = Synthetic polypeptide
  source 1..731: mol_type = other DNA
tggaatgagccctggacaggatcctaagatccggtcagcctttagtgccaagagagaacattacagcatggatgaatgcaattggtttgatcatcactgccctaccagagccatattggattgttcttcatgatcgaattgtgagtgtcatcagcagccccagcttgacgtctgaaacagagtgggttggctatccattccgcctctttgatttcactgcctgtcatcagtcctactctgagatgagttgtagctatacgttagctcttgcacatgctgtgtggcaccattctagcatcggacaactttctctcattccaaagtttcttactgaagtacttcttcctatagtgaagaccgaattccagttgctttatgtataccatcttgttggaccatttttacaaagatttcagcaagagagaactcgttgtatgatagagattggtgtggcgttttatgacatgctgctgaatgttgaccagtgtagcacccatttaaattacatggatcccatctgtgacttcctctatcacatgaagtatatgtttactggtgacagcgtgaaagagcaagtagagaagattatctgtaacttaaaaccagctttaaaacttcgtcttcgattcatcacacacattagcaagatggagccagctgcagtgcctccacaagccatgaacagtgggtctccagcacctcagtctaatcaggttgacactctcacctga

SEQ ID NO: 10998 - DNA, 743 bp, synthetic construct
  misc_feature 1..743: note = Synthetic polypeptide
  source 1..743: mol_type = other DNA
tggaatgagccctggacaggatcctaagatccggtcagcctttagtgccaagagagaacattacagcatggatgaatgcaattggtttgatcatcactgccctaccagagccatattggattgttcttcatgatcgaattgtgagtgtcatcagcagccccagcttgacgtctgaaacagagtgggttggctatccattccgcctctttgatttcactgcctgtcatcagtcctactctgagatgagttgtagctatacgttagctcttgcacatgctgtgtggcaccattctagcatcggacaactttctctcattccaaagtttcttactgaagtacttcttcctatagtgaagaccgaattccagttgctttatgtataccatcttgttggaccatttttacaaagatttcagcaagagagaactcgttgtatgatagagattggtgtggcgttttatgacatgctgctgaatgttgaccagtgtagcacccatttaaattacatggatcccatctgtgacttcctctatcacatgaagtatatgtttactggtgacagcgtgaaagagcaagtaaagaagattatctgtaacttaaaaccagctttaaaacttcgtcttcgattcatcacacacattagcaagatggagccagctgcagtgcctccacaagccatgaacagtgggtctccagcacctcagtctaatcaggtgcccgtgtctttaccagtaactcagtga

SEQ ID NO: 10999 - DNA, 1797 bp, synthetic construct; identical to SEQ ID NO: 7070
  misc_feature 1..1797: note = Synthetic polypeptide
  source 1..1797: mol_type = other DNA

SEQ ID NO: 11000 - DNA, 1081 bp, synthetic construct; identical to SEQ ID NO: 7071
  misc_feature 1..1081: note = Synthetic polypeptide
  source 1..1081: mol_type = other DNA

SEQ ID NO: 11001 - DNA, 1059 bp, synthetic construct; identical to SEQ ID NO: 7072
  misc_feature 1..1059: note = Synthetic polypeptide
  source 1..1059: mol_type = other DNA

SEQ ID NO: 11002 - DNA, 909 bp, synthetic construct; identical to SEQ ID NO: 7073
  misc_feature 1..909: note = Synthetic polypeptide
  source 1..909: mol_type = other DNA

SEQ ID NO: 11003 - DNA, 1435 bp, synthetic construct
  misc_feature 1..1435: note = Synthetic polypeptide
  source 1..1435: mol_type = other DNA
attaggaataatattaaaaaccaaaagcagaaacaatatgttttccttttaggaaactgaggtgttctgcccttggattattagatgcagttctggctaccacaccataaaaggaaataacacagttgaagaaagcccaaggaagggtatctatgacggccaaaagaatgaagagacttttttatggtgacagacccaaactaaaccaaaaacttttcagatgaaaagggacatggcagcagcctttggtgttagggaatatggataagaccccctggagggggtgaacatcaccagccccgtgcgcctgatccatggcaccgtggggaagtcggctctgctttctgtgcagtacagcagtaccagcagcgacaggcctgtagtgaagtggcagctgaagcgggacaagccagtgaccgtggtgcagtccattggcacagaggtcatcggcaccctgcggcctgactatcgagaccgtatccgactctttgaaaatggctccctgcttctcagcgacctgcagctggccgatgagggcacctatgaggtcgagatctccatcaccgacgacaccttcactggggagaagaccatcaaccttactgtagatgtgcccatttcgaggccacaggtgttggtggcttcaaccactgtgctggagctcagcgaggccttcaccttgaactgctcacatgagaatggcaccaagcccagctacacctggctgaaggatggcaagcccctcctcaatgactcgagaatgctcctgtcccccgaccaaaaggtgctcaccatcacccgcgtgctcatggaggatgacgacctgtacagctgcatggtggagaaccccatcagccagggccgcagcctgcctgtcaagatcaccgtatacagaagaagctccctttacatcatcttgtctacaggaggcatcttcctccttgtgaccttggtgacagtctgtgcctgctggaaaccctccaaaaggaaacagaagaagctagaaaagcaaaactccctggaatacatggatcagaatgatgaccgcctgaaaccagaagcagacaccctccctcgaagtggtgagcaggaacggaagaaccccatggcactctatatcctgaaggacaaggactccccggagaccgaggagaacccggccccggagcctcgaagcgcgacggagcccggcccgcccggctactccgtgtctcccgccgtgcccggccgctcgccggggctgcccatccgctctgcccgccgctacccgcgctccccagcgcgctccccagccaccggccggacacactcgtcgccgcccagggccccgagctcgcccggccgctcgcgcagcgcctcgcgcacactgcggactgcgggcgtgcacataatccgcgagcaagacgaggccggcccggtggagatcagcgcctga

SEQ ID NO: 11004 - DNA, 1720 bp, synthetic construct
  misc_feature 1..1720: note = Synthetic polypeptide
  source 1..1720: mol_type = other DNA
ggggaggggagggccgaacgggaggtgagtgtaggggagcggagggccgaacgggagatgttcccttcggagaggcagctccttcacattcttaacacctggccccaactgggacttcactttgaaaagaaaacgcagagagaaagatgatgatgttgtaagccttagcagccttgatctgaaggagccaagcaataaaagagttcgacctctggctcgtgtcacgtccttggcaaatttaatctctcctgtaagaaatggagctgtcagacgttttggtcaaacaatacagtcatttacccttcgtggtgaccacagatccccagcctctgcccagaagttttctagcaggtcaacagtcccaacacccgccaagagaaggagcagtgcactgtggtcagagatgctggacatcaccatgaaggagtctctcaccaccagggagatcagacggcaggaggcaatatatgaaatgtcccgaggtgaacaggatttaattgaggatctcaaacttgcaagaaaggcctatcatgaccccatgttaaagttgtccatcatgtcagaagaggaactcacacatatatttggtgatctggactcttacatacctctgcatgaagatttgttgacaagaataggagaagcaaccaagcctgatggaacagtggagcagattggtcacattctcgtgagctggttaccgcgcttgaatgcctacagaggttactgtagtaaccagctggcagccaaagctcttcttgatcaaaagaaacaggatccaagagtccaagacttcctccagcgatgtctcgagtctcccttcagtcgaaaactagatctttggagtttcctagatatccctcgaagtcgcctagtcaaataccctttactgttaaaagaaattcttaaacacactccaaaagagcaccctgatgttcagcttctggaggatgctatattgataatacagggagtcctctctgatatcaacttgaagaaaggtgaatccgagtgccagtattacatcgacaagctggagtacctggatgaaaagcagagggaccccagaatcgaagcgagcaaagtgctgctgtgccatggggagctgcggagcaagagtggacataaactttacattttcctgtttcaagacatcttggttctgactcggcccgtcacacggaacgaacggcactcttaccaggtttaccggcagccaatcccagtccaagagctagtcctagaagacctgcaggatggagatgtgagaatgggaggctcctttcgaggagctttcagtaactcagagaaagctaaaaatatctttagaattcgcttccatgacccctctccagcccagtctcacactctgcaagccaatgacgtgttccacaagcagcagtggttcaactgtattcgagcggccattgcccccttccagtcggcaggcagtccacctgagctgcagggcctgccggagctgcacgaagagtgtgaggggaaccacccctctgcgaggaaactcacagcccagaggagggcatccacagtttccagtgttactcaggtagaagttgatgaaaacgcttacagatgtggctctggcatgcagatggcagaggacagcaagagcttaaagacacaccagacacagcccggcatccgaagagcgagggacaaagccctttctggtggcaaacggaaagagactttggtgtag

SEQ ID NO: 11005 - DNA, 456 bp, synthetic construct; identical to SEQ ID NO: 6649
  misc_feature 1..456: note = Synthetic polypeptide
  source 1..456: mol_type = other DNA

SEQ ID NO: 11006 - DNA, 480 bp, synthetic construct; identical to SEQ ID NO: 6650
  misc_feature 1..480: note = Synthetic polypeptide
  source 1..480: mol_type = other DNA

SEQ ID NO: 11007 - DNA, 186 bp, synthetic construct; identical to SEQ ID NO: 6651
  misc_feature 1..186: note = Synthetic polypeptide
  source 1..186: mol_type = other DNA

SEQ ID NO: 11008 - DNA, 866 bp, synthetic construct
  misc_feature 1..866: note = Synthetic polypeptide
  source 1..866: mol_type = other DNA
catgtctttgcacatgctattccctcctggaatgctcttccatgcactgtcctgcagctctctccggtctcagcctcaataccctgaccatcttctctttctgcaagaccccggagctgcggactccctgccacctactggtgctgagcttggctcttgcggacagtgggatcagcctgaatgccctcgttgcagccacatccagccttctccgtgtctcccacaggcgctggccctacggctcggacggctgccaggctcacggcttccagggctttgtgacagcgttggccagcatctgcagcagtgcagccatcgcatgggggcgttatcaccactactgcacccgtagccagctggcctggaactcagccgtctctctggtgctcttcgtgtggctgtcttctgccttctgggcagctctgccccttctgggttggggtcactacgactatgagccactggggacatgctgcaccctggactactccaagggggacagaaacttcaccagcttcctcttcaccatgtccttcttcaacttcgccatgcccctcttcatcacgatcacttcctacagtctcatggagcagaaactggggaagagtggccatctccaggtaaacaccactctgccagcaaggacgctgctgctcggctggggcccctatgccatcctgtatctatacgcagtcatcgcagacgtgacttccatctcccccaaactgcagatggtgcccgccctcattgccaaaatggtgcccacgatcaatgccatcaactatgccctgggcaatgagatggtctgcaggggaatctggcagtgcctctcaccgcagaagagggagaaggaccgaaccaagtga

SEQ ID NO: 11009 - DNA, 740 bp, synthetic construct
  misc_feature 1..740: note = Synthetic polypeptide
  source 1..740: mol_type = other DNA
catgtctttgcacatgctattccctcctggaatgctcttccatgcactgtcctgcagctctctccggtctcagcctcaataccctgaccatcttctctttctgcaagaccccggagctgcggactccctgccacctactggtgctgagcttggctcttgcggacagtgggatcagcctgaatgccctcgttgcagccacatccagccttctccggcgctggccctacggctcggacggctgccaggctcacggcttccagggctttgtgacagcgttggccagcatctgcagcagtgcagccatcgcatgggggcgttatcaccactactgcacccgtagccagctggcctggaactcagccgtctctctggtgctcttcgtgtggctgtcttctgccttctgggcagctctgccccttctgggttggggtcactacgactatgagccactggggacatgctgcaccctggactactccaagggggacagaaacttcaccagcttcctcttcaccatgtccttcttcaacttcgccatgcccctcttcatcacgatcacttcctacagtctcatggagcagaaactggggaagagtggccatctccaggtgcccgccctcattgccaaaatggtgcccacgatcaatgccatcaactatgccctgggcaatgagatggtctgcaggggaatctggcagtgcctctcaccgcagaagagggagaaggaccgaaccaagtga

SEQ ID NO: 11010 - DNA, 1541 bp, synthetic construct
  misc_feature 1..1541: note = Synthetic polypeptide
  source 1..1541: mol_type = other DNA
tcagtttaaggggtcatgacgagcattttaaaaaacaaagtaggaaatatcagacagcaatgcagatagatagtaaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacgcctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaa

SEQ ID NO: 11011 - DNA, 1291 bp, synthetic construct
  misc_feature 1..1291: note = Synthetic polypeptide
  source 1..1291: mol_type = other DNA
tcttgcacctggattcccgcaaaatcttccactcatcttcattccaagcctatttcctcacaaaccattttctgttcttaagtgagagcagtccttctagaatcagaaatcacctgctaagaagctgactaatgcattaagcaagtccctgagctgtgcttccagccgtgaacctttgcaccccatgttcccagatcagcctgagaagccactcaacttggctcacatcgttgatacttggcctcccagacctgtaaccagcatgaacgacaccctgttctcccactctgttccctcctcaggaagtccttttattaccaggagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttga

SEQ ID NO: 11012 - DNA, 355 bp, synthetic construct
  misc_feature 1..355: note = Synthetic polypeptide
  source 1..355: mol_type = other DNA
tcttgcacctggattcccgcaaaatcttccactcatcttcattccaagcctatttcctcacaaaccattttctgttcttaagtgagagcagtccttctagaatcagaaatcacctgctaagaagctgactaatgcattaagcaagtccctgagctgtgcttccagccgtgaacctttgcaccccatgttcccagatcagcctgagaagccactcaacttggctcacatcgttgatacttggcctcccagacctgtaaccagcatgaacgacaccctgttctcccactctgttccctcctcaggaagtccttttattaccaggagctcggacggtgcttttggtggatgcgtctag

SEQ ID NO: 11013 - DNA, 1405 bp, synthetic construct
  misc_feature 1..1405: note = Synthetic polypeptide
  source 1..1405: mol_type = other DNA
tcttgcacctggattcccgcaaaatcttccactcatcttcattccaagcctatttcctcacaaaccattttctgttcttaagtgagagcagtccttctagaatcagaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcagctccacgtcagcactgagaccagactcgagcacccctgtcctgtaagcgagacaaaatggcgtgtgttattttggggttttgtgttttttggtgggtttctttccttggctctccagatttacttttggggcctgttctaa

SEQ ID NO: 11014 - DNA, 346 bp, synthetic construct
  misc_feature 1..346: note = Synthetic polypeptide
  source 1..346: mol_type = other DNA
tcttgcacctggattcccgcaaaatcttccactcatcttcattccaagcctatttcctcacaaaccattttctgttcttaagtgagagcagtccttctagaatcagaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagctcggacggtgcttttggtggatgcgtctag

SEQ ID NO: 11015 - DNA, 1303 bp, synthetic construct
  misc_feature 1..1303: note = Synthetic polypeptide
  source 1..1303: mol_type = other DNA
tcttgcacctggattcccgcaaaatcttccactcatcttcattccaagcctatttcctcacaaaccattttctgttcttaagtgagagcagtccttctagaatcagaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaaggaagaagaactgaagcagggaactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttga

SEQ ID NO: 11016 - DNA, 1465 bp, synthetic construct
  misc_feature 1..1465: note = Synthetic polypeptide
  source 1..1465: mol_type = other DNA
tcttgcacctggattcccgcaaaatcttccactcatcttcattccaagcctatttcctcacaaaccattttctgttcttaagtgagagcagtccttctagaatcagaaatcacctgctaagaagctgactaatgcattaagcaagtccctgagctgtgcttccagccgtgaacctttgcaccccatgttcccagatcagcctgagaagccactcaacttggctcacatcgtgctggacaatatgcctcccagacctgtaaccagcatgaacgacaccctgttctcccactctgttccctcctcaggaagtccttttattaccaggagctctcctcccaaggacagtgaagtagagcagaacaaactgctggctagggctgctccagcttttctgaagggcaaagggatacagtacagcctgaatgtggcagacaggctagctgatgaacatgttctcatcgggttgtatgtcaacatgctccggaacaacccctcatgcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttga

SEQ ID NO: 11017 - DNA, 1282 bp, synthetic construct
  misc_feature 1..1282: note = Synthetic polypeptide
  source 1..1282: mol_type = other DNA
tcttgcacctggattcccgcaaaatcttccactcatcttcattccaagcctatttcctcacaaaccattttctgttcttaagtgagagcagtccttctagaatcagaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttga

SEQ ID NO: 11018 - DNA, 772 bp, synthetic construct
  misc_feature 1..772: note = Synthetic polypeptide
  source 1..772: mol_type = other DNA
tcttgcacctggattcccgcaaaatcttccactcatcttcattccaagcctatttcctcacaaaccattttctgttcttaagtgagagcagtccttctagaatcagaaatcacctgctaagaagctgactaatgcattaagcaagtccctgagctgtgcttccagccgtgaacctttgcaccccatgttcccagatcagcctgagaagccactcaacttggctcacatcgttgatacttggcctcccagacctgtaaccagcatgaacgacaccctgttctcccactctgttccctcctcaggaagtccttttattaccaggagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaaggaagaagaactgaagcagggagtaagttatgtcccctactgcaggtcttaa

SEQ ID NO: 11019 - DNA, 934 bp, synthetic construct
  misc_feature 1..934: note = Synthetic polypeptide
  source 1..934: mol_type = other DNA
tcttgcacctggattcccgcaaaatcttccactcatcttcattccaagcctatttcctcacaaaccattttctgttcttaagtgagagcagtccttctagaatcagaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagctctcctcccaaggacagtgaagtagagcagaacaaactgctggctagggctgctccagcttttctgaagggcaaagggatacagtacagcctgaatgtggcagacaggctagctgatgaacatgttctcatcgggttgtatgtcaacatgctccggaacaacccctcatgcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaaggaagaagaactgaagcagggagtaagttatgtcccctactgcaggtcttaa

SEQ ID NO: 11020 - DNA, 763 bp, synthetic construct
  misc_feature 1..763: note = Synthetic polypeptide
  source 1..763: mol_type = other DNA
tcttgcacctggattcccgcaaaatcttccactcatcttcattccaagcctatttcctcacaaaccattttctgttcttaagtgagagcagtccttctagaatcagaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaaggaagaagaactgaagcagggagtaagttatgtcccctactgcaggtcttaa

SEQ ID NO: 11021 - DNA, 943 bp, synthetic construct
  misc_feature 1..943: note = Synthetic polypeptide
  source 1..943: mol_type = other DNA
tcttgcacctggattcccgcaaaatcttccactcatcttcattccaagcctatttcctcacaaaccattttctgttcttaagtgagagcagtccttctagaatcagaaatcacctgctaagaagctgactaatgcattaagcaagtccctgagctgtgcttccagccgtgaacctttgcaccccatgttcccagatcagcctgagaagccactcaacttggctcacatcgttgatacttggcctcccagacctgtaaccagcatgaacgacaccctgttctcccactctgttccctcctcaggaagtccttttattaccaggagctctcctcccaaggacagtgaagtagagcagaacaaactgctggctagggctgctccagcttttctgaagggcaaagggatacagtacagcctgaatgtggcagacaggctagctgatgaacatgttctcatcgggttgtatgtcaacatgctccggaacaacccctcatgcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaaggaagaagaactgaagcagggagtaagttatgtcccctactgcaggtcttaa

SEQ ID NO: 11022 - DNA, 1462 bp, synthetic construct
  misc_feature 1..1462: note = Synthetic polypeptide
  source 1..1462: mol_type = other DNA
tcttgcacctggattcccgcaaaatcttccactcatcttcattccaagcctatttcctcacaaaccattttctgttcttaagtgagagcagtccttctagaatcagaaatcacctgctaagaagctgactaatgcattaagcaagtccctgagctgtgcttccagccgtgaacctttgcaccccatgttcccagatcagcctgagaagccactcaacttggctcacatcgttgatacttggcctcccagacctgtaaccagcatgaacgacaccctgttctcccactctgttccctcctcaggaagtccttttattaccaggagctctcctcccaaggacagtgaagtagagcagaacaaactgctggctagggctgctccagcttttctgaagggcaaagggatacagtacagcctgaatgtggcagacaggctagctgatgaacatgttctcatcgggttgtatgtcaacatgctccggaacaacccctcatgcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttga

SEQ ID NO: 11023 - DNA, 293 bp, synthetic construct
  misc_feature 1..293: note = Synthetic polypeptide
  source 1..293: mol_type = other DNA
tcttgcacctggattcccgcaaaatcttccactcatcttcattccaagcctatttcctcacaaaccattttctgttcttaagtgagagcagtccttctagaatcagaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcag

SEQ ID NO: 11024 - DNA, 699 bp, synthetic construct
  misc_feature 1..699: note = Synthetic polypeptide
  source 1..699: mol_type = other DNA
ggcccgctgagagatccattttgtttcaccctcactgtgttttttaaaaacacgaagttgccaacaattataacagaaaaatttcccatacaaatctgcgtttctggtgtcttccagaaaatctgcagatctggcctcacagctgcattccccagcaactgccctccagagggtggcatgtacatcttccagctctttgactcctatgccgccagtgggatgtgccttctcttcgtggccatctttgagtgcatctgcatcggctgggtgtatggaagcaaccggttctatgataacattgaagacatgattggctaccggccaccgtcgctcattaagtggtgctggatgatcatgacccctgggatctgcgcggggatcttcatcttcttcttgatcaagtacaagccactcaagtacaacaacatctacacctacccagcctggggctatggcattggctggctcatggccctgtcctccatgctctgcatcccgctctggatctgcatcacagtgtggaagacggaggggacactgcccgagaaactccagaagttgacgacccccagcacagatctgaaaatgcggggcaagcttggggtgagcccacggatggtgacagttaatgactgtgatgccaaactcaagagtgacgggaccatcgcagccatcacagagaaggagacgcacttctga

SEQ ID NO: 11025 - DNA, 270 bp, synthetic construct
  misc_feature 1..270: note = Synthetic polypeptide
  source 1..270: mol_type = other DNA
gctggcagtggtgggtgcatgtctgtattcccagcaactaggaaggctgagggatcagagaaggctgaagaaggtggagaaactgaggcacaaaaagagggcagtgaagatgtgggcaacctccctgaagcccaggagaagaatgaagaagaaggagagacagccacagaagagacggaagaaatagccatggagggtgcggaaggggaagccgaggaggaggaagaaactgcagaaggagaagagcctggagaagacgaagattcctag

SEQ ID NO: 11026 - DNA, 201 bp, synthetic construct
  misc_feature 1..201: note = Synthetic polypeptide
  source 1..201: mol_type = other DNA
gctggcagtggtgggtgcatgtctgtattcccagcaactaggaaggctgagggatcagagaaggctgaagaaggtggagaaactgaggcacaaaaagagggcagtgaagatgtgggcaacctccctgaagcccaggagaagaatgaagaagaaggagagacagccacagaagagacggaagaaatagccatggagggtgcg

SEQ ID NO: 11027 - DNA, 216 bp, synthetic construct
  misc_feature 1..216: note = Synthetic polypeptide
  source 1..216: mol_type = other DNA
gctggcagtggtgggtgcatgtctgtattcccagcaactaggaaggctgagggatcagagaaggctgaagaaggtggagaaactgaggcacaaaaagagggcagtgaagatgtgggcaacctccctgaagcccaggagaagaataaaatggaagctatgaagcaacatttcaaatgtctctccacaaaccaaactcaacagaatactttggcttga

SEQ ID NO: 11028 - DNA, 649 bp, synthetic construct
  misc_feature 1..649: note = Synthetic polypeptide
  source 1..649: mol_type = other DNA
cagcaggtcctcaaataatgttattttgtttaacgtcatttctttataatgttgatgagaaaaaaaaacaacaactgattcccagccatggccactgtctgtgtagagtttgcacattctcgtcatgtctgtgtgggttttctctgggcactccaatttcctcccacatcccagagatgtgcacattaggttaattggtgtatctaaattatctaaattatccaagtatgagtgaggggtgtgtgtgtgtgtgcgtgcacgcattctgtgatggaatggcatcctttccagggtgccttgcaccctgagctgccagaataagattcagccacccaggaccctgaaatggaataagcaggttggaaatgaagaataagtgaatacaaattattgtaaaataaaaatttgtaaagtatataataatcatacaaatgcataacagtaaataatttggtataagagcactcagccagcctgccatatttattattgtttttgaactgcatggtggtaggagatactccttacaatttttgctctgcaaagatttattccttggtttaactcaccaccatgatgactgctgtcactcactgcttatactaatccagcatgacctcactttaattacatcaccaataggagctga

SEQ ID NO: 11029 - DNA, 644 bp, synthetic construct
  misc_feature 1..644: note = Synthetic polypeptide
  source 1..644: mol_type = other DNA
cagcaggtcctcaaataatgttattttgtttaacgtcatttctttataatgttgatgagaaaaaaaaacaacaactgattcccagccatggccactgtctgtgtagagtttgcacattctcgtcatgtctgtgtgggttttctctgggcactccaatttcctcccacatcccagagatgtgcacattaggttaattggtgtatctaaattatctaaattatccaagtatgagtgaggggtgtgtgtgtgtgtgcgtgcacgcattctgtgatggaatggcatcctttccagggtgccttgcaccctgagctgccagaataagattcagccacccaggaccctgaaatggaataagcaggttggaaatgaagaataagtgaatacaaattattgtaaaataaaaatttgtaaagtatataataatcatacaaatgcataacagtaaataatttggtataagagcactcagccagcctgccatatttattattgtttttgaactgcatggtggtaggagatactccttacaatttttgctctgcaaagatttattccttggtttaactcaccaccatgatgactgctgtcactcactgcttatactaatccagcatgacctcactttaattacatcaccaatagga

SEQ ID NO: 11030 - DNA, 1136 bp, synthetic construct
  misc_feature 1..1136: note = Synthetic polypeptide
  source 1..1136: mol_type = other DNA
cagcaggtcctcaaataatgttattttgtttaacgtcatttctttataatgttgatgagaaaaaaaaacaacaactgattcccagccatggccactgtctgtgtagagtttgcacattctcgtcatgtctgtgtgggttttctctgggcactccaatttcctcccacatcccagagatgtgcacattaggttaattggtgtatctaaattatctaaattatccaagtatgagtgaggggtgtgtgtgtgtgtgcgtgcacgcattctgtgatggaatggcatcctttccagggtgccttgcaccctgagctgccagaataagattcagccacccaggaccctgaaatggaataagcaggttggaaatgaagaataagtgaatacaaattattgtaaaataaaaatttgtaaagtatataataatcatacaaatgcataacagtaaataatttggtataagagcactcagccagcctgccatatttattattgtttttgaactgcatggtggtaggagatactccttacaatttttgctctgcaaagatttattccttggtttaactcaccaccatgatgactgctgtcactcactgcttatactaatccagcatgacctcactttaattacatcaccaataggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctgggatggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctag

SEQ ID NO: 11031 - DNA, 989 bp, synthetic construct
  misc_feature 1..989: note = Synthetic polypeptide
  source 1..989: mol_type = other DNA
cagcaggtcctcaaataatgttattttgtttaacgtcatttctttataatgttgatgagaaaaaaaaacaacaactgattcccagccatggccactgtctgtgtagagtttgcacattctcgtcatgtctgtgtgggttttctctgggcactccaatttcctcccacatcccagagatgtgcacattaggttaattggtgtatctaaattatctaaattatccaagtatgagtgaggggtgtgtgtgtgtgtgcgtgcacgcattctgtgatggaatggcatcctttccagggtgccttgcaccctgagctgccagaataagattcagccacccaggaccctgaaatggaataagcaggttggaaatgaagaataagtgaatacaaattattgtaaaataaaaatttgtaaagtatataataatcatacaaatgcataacagtaaataatttggtataagagcactcagccagcctgccatatttattattgtttttgaactgcatggtggtaggagatactccttacaatttttgctctgcaaagatttattccttggtttaactcaccaccatgatgactgctgtcactcactgcttatactaatccagcatgacctcactttaattacatcaccaataggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctggtatgcccctctgctttggggacttcagtgccagtcagccagagccggatgtcaggctctga

SEQ ID NO: 11032 - DNA, 3648 bp, synthetic construct
  misc_feature 1..3648: note = Synthetic polypeptide
  source 1..3648: mol_type = other DNA
aagatggccaactagctggatctgggatgcacctcttctacagagaggaaccaaaatattgagtaaaccctcacactttcaacagatcttttgagagaaaacactgaaatttaatatataggccatgacagacatgattgaagaagtaggaagcaacactgctggctcagtattgccagacaccttaggaccagaatggacccaaggaaggtgtgagtgaagaaacccgggaacaccactttcccactgtcaacctctgaaattctagaggagttcccacaacccctgaatacgtttggattggtaggaggagctgcctggagaccatacagaggcactacttgaagccacaaggagcccaaaagccttcagtgtgctaggcagctgcagcaaaacgtgactctgggcacccacccccgagtgccctgcatccgagcggctacatctgctgtctgccacaccaggatagagtggggcccatgcatgttcacatgaccaattcaggatccaccaccattcctgcaggactgaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaa

SEQ ID NO: 11033 - DNA, 1138 bp, synthetic construct
  misc_feature 1..1138: note = Synthetic polypeptide
  source 1..1138: mol_type = other DNA
aagatggccaactagctggatctgggatgcacctcttctacagagaggaaccaaaatattgagtaaaccctcacactttcaacagatcttttgagagaaaacactgaaatttaatatataggccatgacagacatgattgaagaagtaggaagcaacactgctggctcagtattgccagacaccttaggaccagaatggacccaaggaaggtgtgagtgaagaaacccgggaacaccactttcccactgtcaacctctgaaattctagaggagttcccacaacccctgaatacgtttggattggtaggaggagctgcctggagaccatacagaggcactacttgaagccacaaggagcccaaaagccttcagtgtgctaggcagctgcagcaaaacgtgactctgggcacccacccccgagtgccctgcatccgagcggctacatctgctgtctgccacaccaggatagagtggggcccatgcatgttcacatgaccaattcaggatccaccaccattcctgcaggactgaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagca

SEQ ID NO: 11034 - DNA, 1749 bp, synthetic construct
  misc_feature 1..1749: note = Synthetic polypeptide
  source 1..1749: mol_type = other DNA
aagatggccaactagctggatctgggatgcacctcttctacagagaggaaccaaaatattgagtaaaccctcacactttcaacagatcttttgagagaaaacactgaaatttaatatataggccatgacagacatgattgaagaagtaggaagcaacactgctggctcagtattgccagacaccttaggaccagaatggacccaaggaaggtgtgagtgaagaaacccgggaacaccactttcccactgtcaacctctgaaattctagaggagttcccacaacccctgaatacgtttggattggtaggaggagctgcctggagaccatacagaggcactacttgaagccacaaggagcccaaaagccttcagtgtgctaggcagctgcagcaaaacgtgactctgggcacccacccccgagtgccctgcatccgagcggctacatctgctgtctgccacaccaggatagagtggggcccatgcatgttcacatgaccaattcaggatccaccaccattcctgcaggactgaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaattta

SEQ ID NO: 11035 - DNA, 1152 bp, synthetic construct
  misc_feature 1..1152: note = Synthetic polypeptide
  source 1..1152: mol_type = other DNA
aagatggccaactagctggatctgggatgcacctcttctacagagaggaaccaaaatattgagtaaaccctcacactttcaacagatcttttgagagaaaacactgaaatttaatatataggccatgacagacatgattgaagaagtaggaagcaacactgctggctcagtattgccagacaccttaggaccagaatggacccaaggaaggtgtgagtgaagaaacccgggaacaccactttcccactgtcaacctctgaaattctagaggagttcccacaacccctgaatacgtttggattggtaggaggagctgcctggagaccatacagaggcactacttgaagccacaaggagcccaaaagccttcagtgtgctaggcagctgcagcaaaacgtgactctgggcacccacccccgagtgccctgcatccgagcggctacatctgctgtctgccacaccaggatagagtggggcccatgcatgttcacatgaccaattcaggatccaccaccattcctgcaggactgaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatc

SEQ ID NO: 11036 - DNA, 1771 bp, synthetic construct; identical to SEQ ID NO: 9104
  misc_feature 1..1771: note = Synthetic polypeptide
  source 1..1771: mol_type = other DNA

SEQ ID NO: 11037 - DNA, 56 bp, synthetic construct; identical to SEQ ID NO: 9105
  misc_feature 1..56: note = Synthetic polypeptide
  source 1..56: mol_type = other DNA

SEQ ID NO: 11038 - DNA, 1810 bp, synthetic construct; identical to SEQ ID NO: 9106
  misc_feature 1..1810: note = Synthetic polypeptide
  source 1..1810: mol_type = other DNA

SEQ ID NO: 11039 - DNA, 1768 bp, synthetic construct; identical to SEQ ID NO: 9107
  misc_feature 1..1768: note = Synthetic polypeptide
  source 1..1768: mol_type = other DNA

SEQ ID NO: 11040 - DNA, 677 bp, synthetic construct; identical to SEQ ID NO: 9108
  misc_feature 1..677: note = Synthetic polypeptide
  source 1..677: mol_type = other DNA

SEQ ID NO: 11041 - DNA, 5350 bp, synthetic construct; identical to SEQ ID NO: 655
  misc_feature 1..5350: note = Synthetic polypeptide
  source 1..5350: mol_type = other DNA

SEQ ID NO: 11042 - DNA, 665 bp, synthetic construct
  misc_feature 1..665: note = Synthetic polypeptide
  source 1..665: mol_type = other DNA
caggcacaactgttttcatgtgtatcactttattgcacttcacaggtatcatatgtttcttacaaagtggaggtttgtggcagccctgcatggagcaagtctgtcagcaccatctttctaacagattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagaggttcctccagaagaaattaattatttaacacgaattcactacaaagctcagtctgatggtatctggggtgaacatgaaattgattacattttgttggtgaggaagaatgtaactttgaatccagatcccaatgagattaaaagctattgttatgtgtcaaaggaagaactaaaagaacttctgaaaaaagcagccagtggtgaaattaagataacgccatggtttaaaattattgcagcgacttttctctttaaatggtgggataacttaaatcatttgaatcagtttgttgaccatgagaaaatatacagaatgtga

SEQ ID NO: 11043 - DNA, 430 bp, synthetic construct
  misc_feature 1..430: note = Synthetic polypeptide
  source 1..430: mol_type = other DNA
caggcacaactgttttcatgtgtatcactttattgcacttcacaggtatcatatgtttcttacaaagtggaggtttgtggcagccctgcatggagcaagtctgtcagcaccatctttctaacagattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagaggtaaccagctctcctacacaaccatacaagctgaaacctaaacatactataaaaaggtttttaataaaatttttaaattcaaa

SEQ ID NO: 11044 - DNA, 347 bp, synthetic construct
  misc_feature 1..347: note = Synthetic polypeptide
  source 1..347: mol_type = other DNA
caggcacaactgttttcatgtgtatcactttattgcacttcacaggtatcatatgtttcttacaaagtggaggtttgtggcagccctgcatggagcaagtctgtcagcaccatctttctaacagattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagag

SEQ ID NO: 11045 - DNA, 3082 bp, synthetic construct
  misc_feature 1..3082: note = Synthetic polypeptide
  source 1..3082: mol_type = other DNA
ggccgggtgctgtggctcacgcctgtaatcccagcactttgggaggccgagaaccactcacgaattcttgtttggtgcccttgctgaactggttgataatgcaagagatgctgatgccaccagaatagatatttatgcagaaagacgagaggaccttcgaggaggatttatgctttgctttttggatgatggagcaggaatggatccaagtgatgctgccagtgtgatccagtttgggaagtcggccaagcgaacacctgagtctactcagattgggcagtacgggaatgggttaaaatcgggctcaatgcgcattgggaaggattttatcctgttcaccaagaaggaagacaccatgacctgcctcttcctgtctcgcacgtttcatgaggaagaaggcattgatgaagtgatagtcccactgcccacctggaatgctcggacccgggaacctgtcacagacaatgtagagaaatttgccattgagacagaactcatctataagtactctccattccgcactgaggaggaagtgatgacccagtttatgaagattcctggggacagcggaacattggtgatcatcttcaatctcaaactcatggataatggagagccagaactagacataatctcaaatccaagagatatccagatggcagagacgtccccagagggcacgaagccagagcggcgctcgttccgtgcctatgccgctgtgctctatattgatccccggatgaggatcttcatccatgggcacaaggtgcagaccaagaggctctcctgctgcctgtacaagcccaggatgtacaagtacacgtcaagccgtttcaagacccgtgcggagcaggaggtgaagaaagcagagcacgtagcaaggattgctgaagagaaggcgcgggaggcagagagcaaagctcggacattagaagtacgcctaggtggagacctcacgcgggactccagggtgatgttgcgacaggtccagaacagagccatcactctgcgcagagaagccgatgtcaagaagaggatcaaggaggccaagcagcgagcacttaaagaacctaaggaactgaattttgtttttggtgtcaacattgaacaccgggatctggatggcatgttcatctacaactgtagccgactgatcaaaatgtatgagaaagtgggcccacagctggaagggggcatggcatgtggcggggttgttggggttgttgatgtgccctacctggtcctggagcctacacacaacaaacaggactttgctgatgccaaggagtaccggcacctgctccgagcaatgggggagcacctggcgcagtattggaaggatattgccatcgcccagaggggaatcatcaagttctgggatgagtttggctacctctctgccaactggaaccagcccccatccagtgagctgcgttacaaacgccggagagctatggaaatccccaccaccatccagtgcgatttgtgtctgaaatggagaaccctccccttccagctgagttctgtggaaaaagattaccctgacacctgggtttgctccatgaaccctgatcctgaacaggaccggtgtgaggcttctgaacaaaagcagaaggttcccctgggaacattcagaaaggacatgaagacgcaggaagagaagcagaaacaactgacagagaaaattcgccagcagcaggagaagctggaggcccttcagaaaaccacacccatccgctcccaagcagacctgaagaaattgcccttggaagtgaccaccagaccttccactgaggaacctgtgcgtagacctcagcgtcctcggtcgccccctttacctgctgtgatcaggaacgcccccagcagacccccttctttgccaactcctagaccagccagccagccccgaaaggctcctgtcatcagcagtaccccaaagctccctgctttggcagcccgggaggaggccagcacatctaggctgctccagccacctgaggcaccccgaaagcctgccaacactctcgtcaagactgcatcccgacctgcccctctggtgcagcaactgtcaccatctttactgcccaactccaagagccctcgggaggttccttctcccaaagtcatcaagactccagtggtgaagaagacagagtcacccatcaaactctccccggctacccctagtcggaagcggagtgtcgcagtttctgatgaggaagaagttgaggaggaagctgagaggaggaaggagaggtgcaagcggggcagatttgttgtgaaggaggaaaagaaggactcgaatgagctctcagacagtgctggggaagaggactcggctgacctcaagagagctcagaaagataaagggctgcacgtggaggtgcgtgtgaacagggagtggtacacgggccgtgtcacagccgtggaggtgggcaagcatgtggtgcggtggaaggtgaagtttgactacgtgcccacagacacgacaccaagagaccgctgggtggagaaaggcagtgaggatgtgcggctgatgaaacccccttctccggaacatcagagccttgatacacaacaggagggcggggaggaggaggtgggccctgtggcccagcaggccatagctgtcgcagagccctccacttccgaatgcctccgcattgagcctgacaccactgccctgagcaccaatcacgagaccatcgacctgcttgtccagatcctccggaattgtttacggtacttcctgcctccaagtttccccatctccaagaagcagctgagtgctatgaattcagatgagctaatatcttttcctctgaaggagtacttcaagcaatatgaagtagggctccaaaacctgtgcaattcctaccagagccgtgctgactcccgggccaaggcctccgaggaaagcctgcgcacctccgagaggaagctccgcgagacggaggagaagctgcagaagctgaggaccaacatcgtggcactcctgcaaaaggtgcaggaggacatagacatcaacacagatgatgagctggacgcctacattgaggacctcatcaccaagggggactga

SEQ ID NO: 11046 - DNA, 415 bp, synthetic construct
  misc_feature 1..415: note = Synthetic polypeptide
  source 1..415: mol_type = other DNA
tgatacagtttggctttgtgccctcacctaaatctcatcttgaattttaatcccctagatgtttagggagagatctggtaggaggtgattggattatgggggtggttccttcatgctgttctcatcatagtgagtgaattatcacgagatcttttggttttataaatggtagtttttcctgtgctgacacatgctcactctcgcctgctgccatgtaaaaccatgcctttgcttctcttttgccttcagccatgattgtaagtttcctgaggcctccccagccacacagaaccactgggctggcttagatgaagatgaagatgcacatgtctgggaggataattgggatgatgacaatgtagaggatgacttctctaatcagttacgggctggatacagtgaactggaggaatag

SEQ ID NO: 11047 - DNA, 406 bp, synthetic construct
  misc_feature 1..406: note = Synthetic polypeptide
  source 1..406: mol_type = other DNA
tgatacagtttggctttgtgccctcacctaaatctcatcttgaattttaatcccctagatgtttagggagagatctggtaggaggtgattggattatgggggtggttccttcatgctgttctcatcatagtgagtgaattatcacgagatcttttggttttataaatggtagtttttcctgtgctgacacatgctcactctcgcctgctgccatgtaaaaccatgcctttgcttctcttttgccttcagccatgattgtaagtttcctgaggcctccccagccacacagaaccactgggctggcttagatgaagatgaagatgcacatgtctgggaggataattgggatgatgacaatgtagaggatgacttctctaatcagttacgctgtgagaaaaagccctga

SEQ ID NO: 11048 - DNA, 487 bp, synthetic construct
  misc_feature 1..487: note = Synthetic polypeptide
  source 1..487: mol_type = other DNA
tgatacagtttggctttgtgccctcacctaaatctcatcttgaattttaatcccctagatgtttagggagagatctggtaggaggtgattggattatgggggtggttccttcatgctgttctcatcatagtgagtgaattatcacgagatcttttggttttataaatggtagtttttcctgtgctgacacatgctcactctcgcctgctgccatgtaaaaccatgcctttgcttctcttttgccttcagccatgattgtaagtttcctgaggcctccccagccacacagaaccactgggctggcttagatgaagatgaagatgcacatgtctgggaggataattgggatgatgacaatgtagaggatgacttctctaatcagttacgggcaactgtactcctgatgatattggtctgtgaaaccccgtatggctgctatgttctccaccaaaagggaagaatgtgcagtgctttcctctgctgttaa

SEQ ID NO: 11049 - DNA, 430 bp, synthetic construct
  misc_feature 1..430: note = Synthetic polypeptide
  source 1..430: mol_type = other DNA
tgatacagtttggctttgtgccctcacctaaatctcatcttgaattttaatcccctagatgtttagggagagatctggtaggaggtgattggattatgggggtggttccttcatgctgttctcatcatagtgagtgaattatcacgagatcttttggttttataaatggtagtttttcctgtgctgacacatgctcactctcgcctgctgccatgtaaaaccatgcctttgcttctcttttgccttcagccatgattgtaagtttcctgaggcctccccagccacacagaaccactgggctggcttagatgaagatgaagatgcacatgtctgggaggataattgggatgatgacaatgtagaggatgacttctctaatcagttacgagctgaactagagaaacatggttataagatggagacttcatag

SEQ ID NO: 11050 - DNA, 152 bp, synthetic construct; identical to SEQ ID NO: 9151
  misc_feature 1..152: note = Synthetic polypeptide
  source 1..152: mol_type = other DNA

SEQ ID NO: 11051 - DNA, 1765 bp, synthetic construct; identical to SEQ ID NO: 6684
  misc_feature 1..1765: note = Synthetic polypeptide
  source 1..1765: mol_type = other DNA

SEQ ID NO: 11052 - DNA, 733 bp, synthetic construct
  misc_feature 1..733: note = Synthetic polypeptide
  source 1..733: mol_type = other DNA
ggccaggcacagtggctcacgcctgtaatcccagcgttttgggaggccgaagcaggtggatcgcctcaggtcaggagtgcgagaccagcctggccaacatggtgaaaccccgtctccactaaaaatacaaaaaaattagctaggtatccttagtctgttggagcatggagaagagtacacattttctctaccctgtgcatatgctcggtcaattttgactgttccttgggtagaactgggtggcaaagtcagtgtcaactgtgcaaaaactggatattcagccagcatcacttttcataccaagccattttatggtggcaaactgcatcgggttacagctgaagtaaagcacaacatcaccaacactgtggtatgcagagtgcaaggggaatggaatagtgttcttgagttcacatatagcaatggagagacaaagtatgtggacttgactaaattggcagtgacgaagaaaagagtgagacctctggagaagcaggatccatttgaatccaggcgattgtggaaaaatgtgacagactcgctgagagaatctgaaattgataaggccacagagcataagcataccctggaagaacgtcagaggactgaagaaaggcatcgtactgaaacaggcacaccttggaaaaccaaatattttattaaagagggagatggctgggtttatcataaaccactttggaaaataattccaacaacacaaccagcagagtga

SEQ ID NO: 11053 - DNA, 1443 bp, synthetic construct; identical to SEQ ID NO: 6760
  misc_feature 1..1443: note = Synthetic polypeptide
  source 1..1443: mol_type = other DNA

SEQ ID NO: 11054 - DNA, 984 bp, synthetic construct; identical to SEQ ID NO: 6761
  misc_feature 1..984: note = Synthetic polypeptide
  source 1..984: mol_type = other DNA

SEQ ID NO: 11055 - DNA, 1032 bp, synthetic construct; identical to SEQ ID NO: 6762
  misc_feature 1..1032: note = Synthetic polypeptide
  source 1..1032: mol_type = other DNA

SEQ ID NO: 11056 - DNA, 1756 bp, synthetic construct
  misc_feature 1..1756: note = Synthetic polypeptide
  source 1..1756: mol_type = other DNA
aacctagaattttatactcagccaaaataggaaaaacccatttgccaaaatttcaaagactcagaaagtttactacccacagacctactatgaaagaattactaaaggacgtaatccagaaagaagatatatgaaaccggaacgaatcagtccgggacacgaggccatggaaaaaaaccttgaagataacttacagagtttggctacacgattagctccaatttataagcagtatgctccagtagcttaccaaaatcaggtggaatatgaaaatgttgcccgagaatgtcggcttggcagcaaggaaggtcgtcccttctctggggtcactgcttgcctggacttctgtgctcatccccacagggacattcacaacatgaataatggaagcactgtggtttgtaccttaactcgagaagataaccgctctttgggtgttattcctcaagatgagcagctccatgtgctacctctttataagctttcagacacagatgagtttggctccaaggaaggaatggaagccaagatcaaatctggggccatcgaggtcctggcaccccgccgcaaaaaaagaacgtgtttcactcagcctgttccccgttctggaaagaagagggctgcgatgatgacagaggttcttgcacataagataagggcagtggaaaagaaacctattccccgaatcaagcggaagaataactcaacaacaacaaacaacagtaagccttcgtcactgccaaccttagggagtaacactgagaccgtgcaacctgaagtaaaaagtgaaaccgaaccccattttatcttaaaaagttcagacaacactaaaacttattcgctgatgccatccgctcctcacccagtgaaagaggcatctccaggcttctcctggtccccgaagactgcttcagccacaccagctccactgaagaatgacgcaacagcctcatgcgggttttcagaaagaagcagcactccccactgtacgatgccttcgggaagactcagtggtgccaatgcagctgctgctgatggccctggcatttcacagcttggcgaagtggctcctctccccaccctgtctgctcctgtgatggagcccctcattaattctgagccttccactggtgtgactgagccgctaacgcctcatcagccaaaccaccagccctccttcctcacctctcctcaagaccttgcctcttctccaatggaagaagatgagcagcattctgaagcagatgagcctccatcagacgaacccctatctgatgaccccctgtcacctgctgaggagaaattgccccacattgatgagtattggtcagacagtgagcacatctttttggatgcaaatattggtggggtggccatcgcacctgctcacggctcggttttgattgagtgtgcccggcgagagctgcacgctaccactcctgttgagcaccccaaccgtaatcatccaacccgcctctcccttgtcttttaccagcacaaaaacctaaataagccccaacatggttttgaactaaacaagattaagtttgaggctaaagaagctaagaataagaaaatgaaggcctcagagcaaaaagaccaggcagctaatgaaggtccagaacagtcctctgaagtaaatgaattgaaccaaattccttctcataaagcattaacattaacccatgacaatgttgtcaccgtgtccccttatgctctcacacacgttgcggggccctataaccattgggtctga

SEQ ID NO: 11057 - DNA, 810 bp, synthetic construct
  misc_feature 1..810: note = Synthetic polypeptide
  source 1..810: mol_type = other DNA
ggccaggtgcagtggctcatgcctgtaatccgagcactttgggaggctgagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacaacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgcc

SEQ ID NO: 11058 - DNA, 1218 bp, synthetic construct
  misc_feature 1..1218: note = Synthetic polypeptide
  source 1..1218: mol_type = other DNA
ggccaggtgcagtggctcatgcctgtaatccgagcactttgggaggctgagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggtgttgtttaccaggatggattttatggtgcagacatttatggtggttatgctgcataccgctacgcccagcctacccctgccactgccgctgcctacagtgacagttacggacgagtttatgctgccgacccctaccaccacgcacttgctccagcccccacctacggcgttggtgccatgaatgcttttgcacctttgactgatgccaagactaggagccatgctgatgatgtgggtctcgttctttcttcattgcaggctagtatataccgagggggatacaaccgttttgctccatactaa

SEQ ID NO: 11059 - DNA, 1137 bp, synthetic construct
  misc_feature 1..1137: note = Synthetic polypeptide
  source 1..1137: mol_type = other DNA
ggccaggtgcagtggctcatgcctgtaatccgagcactttgggaggctgagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcagtgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggtgttgtttaccaggatggattttatggtgcagacatttatggtggttatgctgcataccgctacgcccagcctacccctgccactgccgctgcctacagtgacagttacggacgagtttatgctgccgacccctaccaccacgcacttgctccagcccccacctacggcgttggtgccatgaatgcttttgcacctttgactgatgccaagactaggagccatgctgatgatgtgggtctcgttctttcttcattgcaggctagtatataccgagggggatacaaccgttttgctccatactaa

SEQ ID NO: 11060 - DNA, 1296 bp, synthetic construct
  misc_feature 1..1296: note = Synthetic polypeptide
  source 1..1296: mol_type = other DNA
ggccaggtgcagtggctcatgcctgtaatccgagcactttgggaggctgagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggtgttgtttaccaggatggattttatggtgcagacatttatggtggttatgctgcataccgctacgcccagcctacccctgccactgccgctgcctacagtgacagaaatcagttcgtcttcgttgcagcagatgaaatttcttgtaacacctctgcagttacggacgagtttatgctgccgacccctaccaccacgcacttgctccagcccccacctacggcgttggtgccatgccccaaggttccagccccagcacagacttcagaggagctaagctgcacacttccaggcctctgctgtcaggcagctgagaatctgactgcctctcctcccctattacaattcatgtttaaagtcatagtcgcccaggaaagaaaatag

SEQ ID NO: 11061 - DNA, 1173 bp, synthetic construct
  misc_feature 1..1173: note = Synthetic polypeptide
  source 1..1173: mol_type = other DNA
ggccaggtgcagtggctcatgcctgtaatccgagcactttgggaggctgagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggtgttgtttaccaggatggattttatggtgcagacatttatggtggttatgctgcataccgctacgcccagcctacccctgccactgccgctgcctacagtgacagttacggacgagtttatgctgccgacccctaccaccacgcacttgctccagcccccacctacggcgttggtgccatgccccaaggttccagccccagcacagacttcagaggagctaagctgcacacttccaggcctctgctgtcaggcagctga

SEQ ID NO: 11062 - DNA, 1059 bp, synthetic construct
  misc_feature 1..1059: note = Synthetic polypeptide
  source 1..1059: mol_type = other DNA
ggccaggtgcagtggctcatgcctgtaatccgagcactttgggaggctgagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacaatttggtaaaatcttagatgttgaaattatttttaatgagcgaggctcaaaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggtgttgtttaccaggatggattttatggtgcagacatttatggtggttatgctgcataccgctacgcccagcctacccctgccactgccgctgcctacagtgacagaaatcagttcgtcttcgttgcagcagatgaaatttcttgtaacacctctgcagttacggacgagtttatgctgccgacccctaccaccacgcacttgctccagcccccacctacggcgttggtgccatgccccaaggttccagccccagcacagacttcagaggagctaagctgcacacttccaggcctctgctgtcaggcagctgagaatctgactgcctctcctcccctattacaattcatgtttaaagtcatagtcgcccaggaaagaaaatag

SEQ ID NO: 11063 - DNA, 1092 bp, synthetic construct
  misc_feature 1..1092: note = Synthetic polypeptide
  source 1..1092: mol_type = other DNA
ggccaggtgcagtggctcatgcctgtaatccgagcactttgggaggctgagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacaacagatgacgcagcaccgacggatggccagccccagacacaaccttctgaaaacacggaaaacaagtctcagcccaagcggctgcatgtctccaatatccccttcaggttccgggatccggacctcagacaaatgtttggtggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggtgttgtttaccaggatggattttatggtgcagacatttatggtggttatgctgcataccgctacgcccagcctacccctgccactgccgctgcctacagtgacagaaatcagttcgtcttcgttgcagcagatgaaatttcttgtaacacctctgcagttacggacgagtttatgctgccgacccctaccaccacgcacttgctccagcccccacctacggcgttggtgccatga

SEQ ID NO: 11064 - DNA, 813 bp, synthetic construct
  misc_feature 1..813: note = Synthetic polypeptide
  source 1..813: mol_type = other DNA
ggccaggtgcagtggctcatgcctgtaatccgagcactttgggaggctgagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgcc

SEQ ID NO: 11065 - DNA, 1143 bp, synthetic construct
  misc_feature 1..1143: note = Synthetic polypeptide
  source 1..1143: mol_type = other DNA
ggccaggtgcagtggctcatgcctgtaatccgagcactttgggaggctgagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggagtagtgtatcaagagcctgtgtatggcaataaattgctgcagggtggttatgctgcataccgctacgcccagcctacccctgccactgccgctgcctacagtgacagttacggacgagtttatgctgccgacccctaccaccacgcacttgctccagcccccacctacggcgttggtgccatggctagtatataccgagggggatacaaccgttttgctccatactaa

SEQ ID NO: 11066 - DNA, 1221 bp, synthetic construct
  misc_feature 1..1221: note = Synthetic polypeptide
  source 1..1221: mol_type = other DNA
ggccaggtgcagtggctcatgcctgtaatccgagcactttgggaggctgagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggagtagtgtatcaagagcctgtgtatggcaataaattgctgcagggtggttatgctgcataccgctacgcccagcctacccctgccactgccgctgcctacagtgacagttacggacgagtttatgctgccgacccctaccaccacgcacttgctccagcccccacctacggcgttggtgccatgaatgcttttgcacctttgactgatgccaagactaggagccatgctgatgatgtgggtctcgttctttcttcattgcaggctagtatataccgagggggatacaaccgttttgctccatactaa

SEQ ID NO: 11067 - DNA, 1152 bp, synthetic construct
  misc_feature 1..1152: note = Synthetic polypeptide
  source 1..1152: mol_type = other DNA
ggccaggtgcagtggctcatgcctgtaatccgagcactttgggaggctgagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggagtagtgtatcaagagcctgtgtatggcaataaattgctgcagggtggttatgctgcataccgctacgcccagcctacccctgccactgccgctgcctacagtgacagaaatcagttcgtcttcgttgcagcagatgaaatttcttgtaacacctctgcagttacggacgagtttatgctgccgacccctaccaccacgcacttgctccagcccccacctacggcgttggtgccatga

SEQ ID NO: 11068 - DNA, 585 bp, synthetic construct
  misc_feature 1..585: note = Synthetic polypeptide
  source 1..585: mol_type = other DNA
ggccaggtgcagtggctcatgcctgtaatccgagcactttgggaggctgagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgag

SEQ ID NO: 11069 - DNA, 256 bp, synthetic construct
  misc_feature 1..256: note = Synthetic polypeptide
  source 1..256: mol_type = other DNA
ggctgagcgcggcagctgacgtctgtaatcccagcactttggaaggctgaggaaggtggatcacttgaggagcagccagggcttcctgcatctgaagttcgcgcggacccgtgagaaccaggtggtgctgggccaacacagcgggcccttccccagcgtgcccgagctcgtcctccactacagttcacgcccactgccggtgcagggtgccgagcatctggctctgctgtaccccgtggtcacgcagaccccctga

SEQ ID NO: 11070 - DNA, 1114 bp, synthetic construct; identical to SEQ ID NO: 9614
  misc_feature 1..1114: note = Synthetic polypeptide
  source 1..1114: mol_type = other DNA

SEQ ID NO: 11071 - DNA, 488 bp, synthetic construct
  misc_feature 1..488: note = Synthetic polypeptide
  source 1..488: mol_type = other DNA
aggggtccccaacccctgggccacggaccagtaccagtggcctgttacgaacgaacgggctggctgcaccgcaggaggtgagcagagagcaatccagcaaagcttcatctgtatttaccgacactccccatcatttgcatctccacatcctgtcagatcagcggcagcattagattctcataggagcatgaaccctattgtgaactacatatgcaagggatctgggatctaggttgcttgctccttatgagaatctaatgcctgatgtgtcattctgtcccatcacccccagatgggaccatctagtttcatgaaaacaggctcagggctcccactgacttaatgagaggaaccttaaccccaaagcagcctgccttaagagaagggaagaagaaaaagtttctgccgtatcggcagagccgccaaccacactgccaggaacccatcctgggcttagtgaaactaccaaccctatgggtcatatgtaa

SEQ ID NO: 11072 - DNA, 377 bp, synthetic construct
  misc_feature 1..377: note = Synthetic polypeptide
  source 1..377: mol_type = other DNA
aggggtccccaacccctgggccacggaccagtaccagtggcctgttacgaacgaacgggctggctgcaccgcaggaggtgagcagagagcaatccagcaaagcttcatctgtatttaccgacactccccatcatttgcatctccacatcctgtcagatcagcggcagcattagattctcataggagcatgaaccctattgtgaactacatatgcaagggatctgggatctaggttgcttgctccttatgagaatctaatgcctgatgtgtcattctgtcccatcacccccagatgggaccatctagtttcatgaaaacaggctcagggctcccactgacttaatgagaggaaccttaaccccaaagcagcctgcctt

SEQ ID NO: 11073 - DNA, 877 bp, synthetic construct
  misc_feature 1..877: note = Synthetic polypeptide
  source 1..877: mol_type = other DNA
gttaccctctttcccttgaaacttctctgatcaccagtggcttagtggtcaaatccaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtatggctttcccaacgaaaggctaa

SEQ ID NO: 11074 - DNA, 895 bp, synthetic construct
  misc_feature 1..895: note = Synthetic polypeptide
  source 1..895: mol_type = other DNA
gttaccctctttcccttgaaacttctctgatcaccagtggcttagtggtcaaatccaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattagagtggattgaaatgccagtcatgcctgatatttcagcccattga

SEQ ID NO: 11075 - DNA, 877 bp, synthetic construct
  misc_feature 1..877: note = Synthetic polypeptide
  source 1..877: mol_type = other DNA
gttaccctctttcccttgaaacttctctgatcaccagtggcttagtggtcaaatccaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtaagttcttctccccatggggttaa

SEQ ID NO: 11076 - DNA, 943 bp, synthetic construct
  misc_feature 1..943: note = Synthetic polypeptide
  source 1..943: mol_type = other DNA
gttaccctctttcccttgaaacttctctgatcaccagtggcttagtggtcaaatccaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtgcggtggctactaaagttcgaaggcacgatatgcgtgtccatccttaccaaaggattgtgaccgcagaccgagccgccaccggcaactaa

SEQ ID NO: 11077 - DNA, 919 bp, synthetic construct
  misc_feature 1..919: note = Synthetic polypeptide
  source 1..919: mol_type = other DNA
gttaccctctttcccttgaaacttctctgatcaccagtggcttagtggtcaaatccaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtgcggtggctactaaagttcgaaggcacgatatgcgtgtccatccttaccaaaggattgtgaccgcagaccgagccgccaccggcaactaa

SEQ ID NO: 11078 - DNA, 871 bp, synthetic construct
  misc_feature 1..871: note = Synthetic polypeptide
  source 1..871: mol_type = other DNA
gttaccctctttcccttgaaacttctctgatcaccagtggcttagtggtcaaatccaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattagagtggattgaaatgccagtcatgcctgatatttcagcccattga

SEQ ID NO: 11079 - DNA, 1392 bp, synthetic construct; identical to SEQ ID NO: 6782
  misc_feature 1..1392: note = Synthetic polypeptide
  source 1..1392: mol_type = other DNA

SEQ ID NO: 11080 - DNA, 933 bp, synthetic construct; identical to SEQ ID NO: 6783
  misc_feature 1..933: note = Synthetic polypeptide
  source 1..933: mol_type = other DNA

SEQ ID NO: 11081 - DNA, 981 bp, synthetic construct; identical to SEQ ID NO: 6784
  misc_feature 1..981: note = Synthetic polypeptide
  source 1..981: mol_type = other DNA

SEQ ID NO: 11082 - DNA, 352 bp, synthetic construct
  misc_feature 1..352: note = Synthetic polypeptide
  source 1..352: mol_type = other DNA
cactgtagcctgaggactcttctaaagacagcagtctgactcctgtgctcacatgccctccttggctccccattgccctctagataaagccttcaccctgcttccgccagcctcactcctcaccactgttctgaatgtcccgccgtctctctcacccctaggtctttgctcaggctgtcccctctgcctgacatcctcttctcgctcctttcctacttgtccttggcttcaccagctctttgccatccaggctgtagaagtctcctcctccaggatgccggcttgctttctcagctagggaggtgaacacaggatgactacagtgttccctgggcctcatctctgcatgtga

SEQ ID NO: 11083 - DNA, 1377 bp, synthetic construct
  misc_feature 1..1377: note = Synthetic polypeptide
  source 1..1377: mol_type = other DNA
tgaattgtcattttcaatgcatgttttctggttgtataaaagctttcccatgcaatagggctgatgttataacagtagattatagtgtattttcaccagacaaagaaaactttttatgattcactgaggacaatcccttcacaatctagaacctgcagattggatcgtctgagaacaccagagaaagagaaagactgtccttgccatccacactacagcaaaactttggagctttaaaccttgggttcataatctcacagctgagaagggtccctccacactcctggaactgtacatccattggaacccttaagggattttatattggaagacatggatcttgctgccaacgagatcagcatttatgacaaactttcagagactgttgatttggtgagacagaccggccatcagtgtggcatgtcagagaaggcaattgaaaaatttatcagacagctgctggaaaagaatgaacctcagagaccccccccgcagtatcctctccttatagttgtgtataaggttctcgcaaccttgggattaatcttgctcactgcctactttgtgattcaacctttcagcccattagcacctgagccagtgctttctggagctcacacctggcgctcactcatccatcacattaggctgatgtccttgcccattgccaagaagtacatgtcagaaaataagggagttcctctgcatgggggtgatgaagacagaccctttccagactttgacccctggtggacaaacgactgtgagcagaatgagtcagagcccattcctgccaactgcactggctgtgcccagaaacacctgaaggtgatgctcctggaagacgccccaaggaaatttgagaggctccatccactggtgatcaagacgggaaagcccctgttggaggaagagattcagcattttttgtgccagtaccctgaggcgacagaaggcttctctgaagggtttttcgccaagtggtggcgctgctttcctgagcggtggttcccatttccttatccatggaggagacctctgaacagatcacaaatgttacgtgagctttttcctgttttcactcacctgccatttccaaaagatgcctctttaaacaagtgctcctttcttcacccagaacctgttgtggggagtaagatgcataagatgcctgacctatttatcattggcagcggtgaggccatgttgcagctcatccctcccttccagtgccgaagacattgtcagtctgtggccatgccaatagagccaggggatatcggctatgtcgacaccacccactggaaggtctacgttatagccagaggggtccagcctttggtcatctgcgatggaaccgctttctcagaactgtag

SEQ ID NO: 11084 - DNA, 3052 bp, synthetic construct; identical to SEQ ID NO: 7029
  misc_feature 1..3052: note = Synthetic polypeptide
  source 1..3052: mol_type = other DNA

SEQ ID NO: 11085 - DNA, 3055 bp, synthetic construct; identical to SEQ ID NO: 7030
  misc_feature 1..3055: note = Synthetic polypeptide
  source 1..3055: mol_type = other DNA

SEQ ID NO: 11086 - DNA, 712 bp, synthetic construct
  misc_feature 1..712: note = Synthetic polypeptide
  source 1..712: mol_type = other DNA
cagtagtctccccttattcatagttttgttttccacagtttcagttacatgaggtcaactgcagtccgaaaatattaaacagaaaatttcagaaatgaacaatttgtaagttttaacttgcaggtggctctgagtagtgccacaaaatcttgtgtcatctggcttcatccagttcaggacatgaatcctccctttgtccagtgtctccacactgtctactgtccctggctgttagtcactgagtagccttcttcattattagattgtcatggtattgcagtgcttgtgttcaagtaacccttattatacttgatgatggctctagagtgcaagagtggtggtgcaggcattcagatatgctaaagacgagctgtcaagtgcttcctttaagcactttaggtgcttaaagatgaaagttctcaacttaaggagagaaaaaaaaatcgtatgctgaggttgctaagacctatggtgtgcattgacaacgtactcagaagattatgttccaccatatgattatcagccacatgcttatccctgtcaagatgattattccatagtccacagaaaatgccgttctcagttcacggatctaaatggttctaaaagatttggcatcaacacttggcatgatgagagtgggatttatgctaattcagatgtaaaacagaaactctatcccttgactagtgggcctattgtgccaatttaa

SEQ ID NO: 11087 - DNA, 1018 bp, synthetic construct
  misc_feature 1..1018: note = Synthetic polypeptide
  source 1..1018: mol_type = other DNA
ctacttggctgtggaatcttgagcaggcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctga

SEQ ID NO: 11088 - DNA, 1120 bp, synthetic construct
  misc_feature 1..1120: note = Synthetic polypeptide
  source 1..1120: mol_type = other DNA
ccttgatactcagtgttgaaccagtacactggaccaatattatcgacatttcttggaagcttgttagaaatgcatcttctcaggtcccaccctcccaacctcccctaccctaccaccacagaaccagaaactgcattttcacaagatccctagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttga

SEQ ID NO: 11089 - DNA, 1243 bp, synthetic construct
  misc_feature 1..1243: note = Synthetic polypeptide
  source 1..1243: mol_type = other DNA
ccttgatactcagtgttgaaccagtacactggaccaatattatcgacatttcttggaagcttgttagaaatgcatcttctcaggtcccaccctcccaacctcccctaccctaccaccacagaaccagaaactgcattttcacaagatccctagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcagctccacgtcagcactgagaccagactcgagcacccctgtcctgtaagcgagacaaaatggcgtgtgttattttggggttttgtgttttttggtgggtttctttccttggctctccagatttacttttggggcctgttctaa

SEQ ID NO: 11090 - DNA, 1141 bp, synthetic construct
  misc_feature 1..1141: note = Synthetic polypeptide
  source 1..1141: mol_type = other DNA
ccttgatactcagtgttgaaccagtacactggaccaatattatcgacatttcttggaagcttgttagaaatgcatcttctcaggtcccaccctcccaacctcccctaccctaccaccacagaaccagaaactgcattttcacaagatccctagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaaggaagaagaactgaagcagggaactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttga

SEQ ID NO: 11091 - DNA, 601 bp, synthetic construct
  misc_feature 1..601: note = Synthetic polypeptide
  source 1..601: mol_type = other DNA
ccttgatactcagtgttgaaccagtacactggaccaatattatcgacatttcttggaagcttgttagaaatgcatcttctcaggtcccaccctcccaacctcccctaccctaccaccacagaaccagaaactgcattttcacaagatccctagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaaggaagaagaactgaagcagggagtaagttatgtcccctactgcaggtcttaa

SEQ ID NO: 11092 - DNA, 511 bp, synthetic construct
  misc_feature 1..511: note = Synthetic polypeptide
  source 1..511: mol_type = other DNA
ccttgatactcagtgttgaaccagtacactggaccaatattatcgacatttcttggaagcttgttagaaatgcatcttctcaggtcccaccctcccaacctcccctaccctaccaccacagaaccagaaactgcattttcacaagatccctagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagcgcaaagatgagctggaacagagaatgtctgctctccaggagagccggagagagctaa

SEQ ID NO: 11093 - DNA, 419 bp, synthetic construct
  misc_feature 1..419: note = Synthetic polypeptide
  source 1..419: mol_type = other DNA
ccttgatactcagtgttgaaccagtacactggaccaatattatcgacatttcttggaagcttgttagaaatgcatcttctcaggtcccaccctcccaacctcccctaccctaccaccacagaaccagaaactgcattttcacaagatccctagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaa

SEQ ID NO: 11094 - DNA, 1587 bp, synthetic construct
  misc_feature 1..1587: note = Synthetic polypeptide
  source 1..1587: mol_type = other DNA
gcaagtcgcatcgcctctctgagcctcagtttccacatctgccatatggaggcaagattattggttccaagttccccgaagagttatctggagggcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctga

SEQ ID NO: 11095 - DNA, 166 bp, synthetic construct
  misc_feature 1..166: note = Synthetic polypeptide
  source 1..166: mol_type = other DNA
cagctctgccacttactactggcagactctgcatataaacctctcagaacttcatcttcctcctctgtaaattagagtaattgtagaatctatttcaggattgcagtaaggatgaaatgacataataatgcaaaggcaaacgccacatccttcgatgcatgggtaa

SEQ ID NO: 11096 - DNA, 329 bp, synthetic construct
  misc_feature 1..329: note = Synthetic polypeptide
  source 1..329: mol_type = other DNA
cagctctgccacttactactggcagactctgcatataaacctctcagaacttcatcttcctcctctgtaaattagagtaattgtagaatctatttcaggattgcagtaaggatgaaatgacataataatgcaaaggcaaacgccacatccttcgatgcatgggtaacagtggaatttgtagggcctcttgcaaaaagaacgaacagccctacctctattgcagaaattgtcagtcctgctgcctccagtcctacatgaggataagcatttctggcaaagaggaaaataccgactggtcttatgagaagcagtggccaagactaccttga

SEQ ID NO: 11097 - DNA, 687 bp, synthetic construct
  misc_feature 1..687: note = Synthetic polypeptide
  source 1..687: mol_type = other DNA
gctgtgtgtcataatggataagatgtatatttcataaccagagacagctgggaacaaatctaggccctattatttaccaactgagtgaccttgaagatgacttaacctaagaatcaggtagtgtgccagtatttgaaaaatcccaatgtatctgattcactgctgctgcagaatattttccaagctctgaatgtatattacaattattcgggccaggtgaaatgcctgaatatttcagagacagcaactagcagtctgggaacactgggttggagctatcaggcctgcacagaagtagtcatgcccttttgtactaatggtgtcgatgacatgtttgaacctcactcatggaacttaaaggaactttctgatgactgttttcaacagtggggtgtgagaccaaggccctcctggatcactactatgtatggaggcaaaaacattagttcacacacaaacattgttttcagcaatggtgaactagacccctggtcaggaggtggagtaactaaggatatcacagacactctggttgcagtcaccatctcagagggggcccaccacttagatctccgcaccaagaatgccttggatcctatgtctgtgctgttagcccgctccttggaagttagacatatgaagaattggatcagagatttctatgacagtgcgggaaagcagcactga

SEQ ID NO: 11098 - DNA, 212 bp, synthetic construct
  misc_feature 1..212: note = Synthetic polypeptide
  source 1..212: mol_type = other DNA
gctgtgtgtcataatggataagatgtatatttcataaccagagacagctgggaacaaatctaggccctattatttaccaactgagtgaccttgaagatgacttaacctaagaatcaggtagtgtgccagtatttgaaaaatcccaatgtatctgattcactgctgctgcagaatattttccaagctctgaatgtatattacaattattcggg

SEQ ID NO: 11099 - DNA, 1235 bp, synthetic construct
  misc_feature 1..1235: note = Synthetic polypeptide
  source 1..1235: mol_type = other DNA
gatgcagcagaaacgccttgagaatgttcgtggcatcagagagaaagatgagagctcaccaggtgctcaccttcctcctgctcttcgtgatcacctcggtggcctctgaaaacgccagcacatcccgaggctgtgggctggacctcctccctcagtacgtgtccctgtgcgacctggacgccatctggggcattgtggtggaggcggtggccggggcgggcgccctgatcacactgctcctgatgctcatcctcctggtgcggctgcccttcatcaaggagaaggagaagaagagccctgtgggcctccactttctgttcctcctggggaccctgggcctctttgggctgacgtttgccttcatcatccaggaggacgagaccatctgctctgtccgccgcttcctctggggcgtcctctttgcgctctgcttctcctgcctgctgagccaggcatggcgcgtgcggaggctggtgcggcatggcacgggccccgcgggctggcagctggtgggcctggcgctgtgcctgatgctggtgcaagtcatcatcgctgtggagtggctggtgctcaccgtgctgcgtgacacaaggccagcctgcgcctacgagcccatggactttgtgatggccctcatctacgacatggtactgcttgtggtcaccctggggctggccctcttcactctgtgcggcaagttcaagaggtggaagctgaacggggccttcctcctcatcacagccttcctctctgtgctcatctgggtggcctggatgaccatgtacctcttcggcaatgtcaagctgcagcagggggatgcctggaacgaccccaccttggccatcacgctggcggccagcggctgggtcttcgtcatcttccacgccatccctgagatccactgcacccttctgccagccctgcaggagaacacgcccaactacttcgacacgtcgcagcccaggatgcgggagacggccttcgaggaggacgtgcagctgccgcgggcctatatggagaacaaggccttctccatggatgaacacaatgcagctctccgaacagcaggatttcccaacggcagcttgggaaaaagacccagtggcagcttggggaaaagacccagcgctccgtttagaagcaacgtgtatcagccaactgagatggccgtcgtgctcaacggtgggaccatcccaactgctccgccaagtcacacaggaagacacctttggtga

SEQ ID NO: 11100 - DNA, 417 bp, synthetic construct
  misc_feature 1..417: note = Synthetic polypeptide
  source 1..417: mol_type = other DNA
ggctggtcgcagtggctcacgcctgtaatcccagcacttcgggaggccgaggcgggtggatcatgtgagggtggtgagaagctgcaggatgcctactacatcttccaggagatggctgacaagtgctcgcccaccctgctgctgctcaatgggcaggcggcctgccacatggcccagggccgctgggaggccgctgagggcctgctgcaggaggcgctagacaaggatagtggctacccagagacgctggtcaacctcatcgtcctgtcccagcacctgggcaagccccctgaggtgacaaaccgatacctgtcccagctgaaggatgcccacaggtcccatcccttcatcaaggagtaccaggccaaggagaacgactttgacaggctggtgctacagtacgctcccagcgcctga

SEQ ID NO: 11101 - DNA, 220 bp, synthetic construct
  misc_feature 1..220: note = Synthetic polypeptide
  source 1..220: mol_type = other DNA
ggctggtcgcagtggctcacgcctgtaatcccagcacttcgggaggccgaggcgggtggatcatgtgagggtggtgagaagctgcaggatgcctactacatcttccaggagatggctgacaagtgctcgcccaccctgctgctgctcaatgggcaggcggcctgccacatggcccagggccgctgggaggccgctgagggcctgctgcaggaggcgctag

SEQ ID NO: 11102 - DNA, 1727 bp, synthetic construct
  misc_feature 1..1727: note = Synthetic polypeptide
  source 1..1727: mol_type = other DNA
gaacacttggcttccacacgtgtctcagacagagaagcttccttagtctccttgtttcacctcatgggtgggtggattgtctagaatgagtgctaggcgatcatgactggccttgtcttctaggacagatggtgtcccattacctctgcacgtcctgtctcacaaatgagggatatcctctcctctgctcgtaggtggactgactccctgaatcttttttctgtaacgaatgtcatgaaaccaaaggaacagggctgggcctggggatggggttgcggctgggtgcaggggaggttgcgtcagggctacctgggcggtggaggcttcggggtggggtgaatgttgcagagaactccttgctcctctggcaggcatttcaaaatgtggcttggactgaggcacaggcctcctccttgttcgcaggtgttctttgattttccttggcattcagggaaaagccacttgatccgcctttccaccaggcacatgcgtggacactaatgttggtttcatcattgcaacatatgcctccggtgacatacattcacaccatctgctgtgggatacgccagtgccacgcgtgatcgcattgtctccacctcggattctcaccgaccctgtttgcacctgtcctggaaagcggtgtctgctggcaggagccccacggcttttagaagtggggcacaccactgctctttcaacggaggagggaggcagagggctcactgatcagtgaacatttagctgacaccacgccttgagggccatgggatcattctgtgcagcagcgaggccctgcctgcctcaccagatgtgctgagcccttcctttctaaccaggaggggtccaaactaagatctgaagaggattcctgagaacccagcaggcgccttgaagctccccctccatcagtggaagtcggctcaaggaggtcctgaagactggactcctgggggtttggccctgggacaggatactcaaggccccttctcccacgccgccacaaactggacccctgaaccagccgccgccgtggcagcagcaggagcctcgccgccaccacggagcagtggcgttattgaaaggggacgcagcctaactgccaggagggaagcgcgagtcggcccagccaatgcgcatgcgcgaggcgcgagcggcttctcccattacagtggttcccacggttgtcttagaaacaagtcctcgaggcttggcaaagcgggagccttccgcggcagagcttgggtgtccgggctctgaggctccggtctgacctctccacggggtcgacgggaatgtctccggatgccaggagttgcaaagggcagacctagatgaggaaaccccaggcagagtcctggggaagcagcacggcatccgagcctcaggcttgcctggacggtgttggttgggtttcttttgatttctcctgcttagaaatggtgcgagaactttggatgtggaacgtggaggaggaggaacacgaagtggggatctgcacttggggtggtcagcactgcggatgcccagcaaagtcactgcctggtccacatcccggaggggtctctgcgcctcagtcggcatcgcagctgatggtgaaacttttggtgtggcagaagagtgtccacaaacttcggaaggtatccgctacatcctccatagccgtgtatccctgcccagggcaatcttctgggggagcggaaagtcctgctcccgggccagggctg

SEQ ID NO: 11103 - DNA, 793 bp, synthetic construct
  misc_feature 1..793: note = Synthetic polypeptide
  source 1..793: mol_type = other DNA
ggtgcggaggctcatgcctgtaatcccagcactctgggaggccaaggtaggcaggccacttgaactcaggagttcgagaccagcctgggcaacatggcaaaaccccatctctacaaaaaatacaaaaattagctgggtgtggtggcacatgcctctagtctcagctacccgagaggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccgcccccacctgagttctatccaggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgagccagccgccgccacctccctactacccaccggaagataagaagacccagtag

SEQ ID NO: 11104 - DNA, 703 bp, synthetic construct
  misc_feature 1..703: note = Synthetic polypeptide
  source 1..703: mol_type = other DNA
ggtgcggaggctcatgcctgtaatcccagcactctgggaggccaaggtaggcaggccacttgaactcaggagttcgagaccagcctgggcaacatggcaaaaccccatctctacaaaaaatacaaaaattagctgggtgtggtggcacatgcctctagtctcagctacccgagaggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccgcccccacctgagttctatccaggaccccccatgatggacggggccatgggatacgtgcagcccccaccaccgccctaccctgggcccatggaacctccggtcagcggccccgatgtcccctccactcctgcagagccagccgccgccacctccctactacccaccggaagataa

SEQ ID NO: 11105 - DNA, 781 bp, synthetic construct
  misc_feature 1..781: note = Synthetic polypeptide
  source 1..781: mol_type = other DNA
ggtgcggaggctcatgcctgtaatcccagcactctgggaggccaaggtaggcaggccacttgaactcaggagttcgagaccagcctgggcaacatggcaaaaccccatctctacaaaaaatacaaaaattagctgggtgtggtggcacatgcctctagtctcagctacccgagaggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccgcccccacctggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgagccagccgccgccacctccctactacccaccggaagataagaagacccagtag

SEQ ID NO: 11106 - DNA, 658 bp, synthetic construct
  misc_feature 1..658: note = Synthetic polypeptide
  source 1..658: mol_type = other DNA
ggtgcggaggctcatgcctgtaatcccagcactctgggaggccaaggtaggcaggccacttgaactcaggagttcgagaccagcctgggcaacatggcaaaaccccatctctacaaaaaatacaaaaattagctgggtgtggtggcacatgcctctagtctcagctacccgagaggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagagttctatccaggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgagccagccgccgccacctccctactacccaccggaagataagaagacccagtag

SEQ ID NO: 11107 - DNA, 574 bp, synthetic construct
  misc_feature 1..574: note = Synthetic polypeptide
  source 1..574: mol_type = other DNA
ggtgcggaggctcatgcctgtaatcccagcactctgggaggccaaggtaggcaggccacttgaactcaggagttcgagaccagcctgggcaacatggcaaaaccccatctctacaaaaaatacaaaaattagctgggtgtggtggcacatgcctctagtctcagctacccgagaggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccgcccccacctgagttctatccaggaccccccatgatggacggggcc

SEQ ID NO: 11108 - DNA, 415 bp, synthetic construct
  misc_feature 1..415: note = Synthetic polypeptide
  source 1..415: mol_type = other DNA
ggctcagtggctcacacctgtaatcccagcactttgggaggccgagacgggaggatcacctgacgtcaggaattcaagaccagcctggtcaacatgggagcagcacatcgcagagtgcatggccaagatgccacagatgattgtgaactggcagcagcagcagcgggagaactgggagaaggcccaggctgacaaggagaggagggcccgactgcaggctgaggcccaggagctcctgggctaccaggtggacccaaggagtgcccgcttccaggagctgctccaggacctagagaagaaggagcgcaagcgcctcaaggaggaaaaacagaaacggaagaaggaggcgcgagctgctgcattggctgcagctgtggctcaagacccagcagcctctggggcacccagctcctga

SEQ ID NO: 11109 - DNA, 699 bp, synthetic construct
  misc_feature 1..699: note = Synthetic polypeptide
  source 1..699: mol_type = other DNA
caggcacaactgttttcatgtgtatcactttattgcacttcacaggtatcatatgtttcttacaaagtggaggtttgtggcagccctgcatggagcaagtctgtcagcaccatctttctaacagtatgtgctcacttcatgtctctctcacattttggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagaggttcctccagaagaaattaattatttaacacgaattcactacaaagctcagtctgatggtatctggggtgaacatgaaattgattacattttgttggtgaggaagaatgtaactttgaatccagatcccaatgagattaaaagctattgttatgtgtcaaaggaagaactaaaagaacttctgaaaaaagcagccagtggtgaaattaagataacgccatggtttaaaattattgcagcgacttttctctttaaatggtgggataacttaaatcatttgaatcagtttgttgaccatgagaaaatatacagaatgtga

SEQ ID NO: 11110 - DNA, 464 bp, synthetic construct
  misc_feature 1..464: note = Synthetic polypeptide
  source 1..464: mol_type = other DNA
caggcacaactgttttcatgtgtatcactttattgcacttcacaggtatcatatgtttcttacaaagtggaggtttgtggcagccctgcatggagcaagtctgtcagcaccatctttctaacagtatgtgctcacttcatgtctctctcacattttggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagaggtaaccagctctcctacacaaccatacaagctgaaacctaaacatactataaaaaggtttttaataaaatttttaaattcaaa

SEQ ID NO: 11111 - DNA, 381 bp, synthetic construct
  misc_feature 1..381: note = Synthetic polypeptide
  source 1..381: mol_type = other DNA
caggcacaactgttttcatgtgtatcactttattgcacttcacaggtatcatatgtttcttacaaagtggaggtttgtggcagccctgcatggagcaagtctgtcagcaccatctttctaacagtatgtgctcacttcatgtctctctcacattttggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagag

SEQ ID NO: 11112 - DNA, 558 bp, synthetic construct
  misc_feature 1..558: note = Synthetic polypeptide
  source 1..558: mol_type = other DNA
ggcaaggcacagtggctcacgcctgtaattccagcactttgggaggccgaggtgtgggcccatcgctggatggatctgtcagaacacggctttgggctggccctgctcaacgactgcaagtatggcgcgtcagtgcgaggcagcatcctcagcctctcgctcttgcgggcgcctaaagccccggacgctactgctgacacggggcgccacgagttcacctatgcactgatgccgcacaaggcccccagcccagcgcccgccacctcctggagtgcgttttccgtgtcttcacccgcggtcgtattggagaccgtcaagcaggcggagagcagcccccagcgccgctcgctggtcctgaggctgtatgaggcccacggcagccacgtggactgctggctgcacttgtcgctgccggttcaggaggccatcctctgcgatctcttggagcgaccagaccctgctggccacttgacccttcgggacaaccgcctgaagctcaccttttctcccttccaagtgctgtccctgttgctcgtgcttcagcctccgccacactga

SEQ ID NO: 11113 - DNA, 627 bp, synthetic construct
  misc_feature 1..627: note = Synthetic polypeptide
  source 1..627: mol_type = other DNA
ggcaaggcacagtggctcacgcctgtaattccagcactttgggaggccgaggtgtgggcccatcgctggatggatctgtcagaacacggctttgggctggccctgctcaacgactgcaagtatggcgcgtcagtgcgaggcagcatcctcagcctctcgctcttgcgggcgcctaaagccccggacgctactgctgacacggggcgccacgagttcacctatgcactgatgccgcacaagggctctttccaggatgctggcgttatccaagctgcctacagcctaaacttccccctgttggctctgccagcccccagcccagcgcccgccacctcctggagtgcgttttccgtgtcttcacccgcggtcgtattggagaccgtcaagcaggcggagagcagcccccagcgccgctcgctggtcctgaggctgtatgaggcccacggcagccacgtggactgctggctgcacttgtcgctgccggttcaggaggccatcctctgcgatctcttggagcgaccagaccctgctggccacttgacccttcgggacaaccgcctgaagctcaccttttctcccttccaagtgctgtccctgttgctcgtgcttcagcctccgccacactga

SEQ ID NO: 11114 - DNA, 942 bp, synthetic construct
  misc_feature 1..942: note = Synthetic polypeptide
  source 1..942: mol_type = other DNA
gtctgggcgcaaagcacaggtgactgcctgccaccagcttgtgacccccatcaagttactttgacttgcacagctgtgaagcggtggtcataataaaattcatttcaaaaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgagaaaccagcctggacaccaagtctgtgtcagaaggccacctcaagaggaacatcgtggtgaagaccgtggagatgcgggatggagaggtcattaaggagtccaagcaggagcacaaggatgtgatgtga

SEQ ID NO: 11115 - DNA, 939 bp, synthetic construct
  misc_feature 1..939: note = Synthetic polypeptide
  source 1..939: mol_type = other DNA
gtctgggcgcaaagcacaggtgactgcctgccaccagcttgtgacccccatcaagttactttgacttgcacagctgtgaagcggtggtcataataaaattcatttcaaaaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgagggggcaaaagcaccaaagacggggaaaatcacaaggtcacaagatatctcaaaagcctcacaatacgagttataccaatacaggctcaccagattgtaaatggaacgccgccggctcgcggttag

SEQ ID NO: 11116 - DNA, 960 bp, synthetic construct
  misc_feature 1..960: note = Synthetic polypeptide
  source 1..960: mol_type = other DNA
gtctgggcgcaaagcacaggtgactgcctgccaccagcttgtgacccccatcaagttactttgacttgcacagctgtgaagcggtggtcataataaaattcatttcaaaaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgaggtcagtacagcagggcctcgtgggaagggcactggagtcctgccccctcctccagggcctgtaggttgctccagactgggactgaggatcagggcaaagggatccagctctccctgggggccttcgtgacactgcagcgctcctag

SEQ ID NO: 11117 - DNA, 387 bp, synthetic construct
  misc_feature 1..387: note = Synthetic polypeptide
  source 1..387: mol_type = other DNA
gtctgggcgcaaagcacaggtgactgcctgccaccagcttgtgacccccatcaagttactttgacttgcacagctgtgaagcggtggtcataataaaattcatttcaaaaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggagtaccaggacctgctcaatgtcaagctggccctggacatcgagatcgccacctacaggaagctgctagagggcgaggagaaccggatcaccattcccgtgcagaccttctccaacctgcagatt

SEQ ID NO: 11118 - DNA, 428 bp, synthetic construct
  misc_feature 1..428: note = Synthetic polypeptide
  source 1..428: mol_type = other DNA
gtctgggcgcaaagcacaggtgactgcctgccaccagcttgtgacccccatcaagttactttgacttgcacagctgtgaagcggtggtcataataaaattcatttcaaaaggatgaaaccaacctgaggctggaagccgagaacaacctggctgcctatagacaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctg

SEQ ID NO: 11119 - DNA, 190 bp, synthetic construct
  misc_feature 1..190: note = Synthetic polypeptide
  source 1..190: mol_type = other DNA
gtctgggcgcaaagcacaggtgactgcctgccaccagcttgtgacccccatcaagttactttgacttgcacagctgtgaagcggtggtcataataaaattcatttcaaaaggatgaaaccaacctgaggctggaagccgagaacaacctggctgcctatagacaggaagcagatgaagccaccctggccc

SEQ ID NO: 11120 - DNA, 1171 bp, synthetic construct
  misc_feature 1..1171: note = Synthetic polypeptide
  source 1..1171: mol_type = other DNA
gctgggcatcgtggctcacacttgtaatcccaacactttgggaggccaaggcaggcggatcacttgagtcgctggagagaccatccttgttgacggagtcagtgaggaatttcggcttgttgacctgcttcctagcacccactatactgccaccatgtatgccaccaatggacctctcaccagtggcaccatcagcaccaacttttctactctcctggaccctccggcaaacctgacagccagtgaagtcaccagacaaagtgccctgatctcctggcagcctcccagggcagagattgaaaattatgtcttgacctacaaatccaccgatggaagccgcaaggagctgattgtggatgcagaagacacctggattcgactggagggcctgttggagaacacagactacacggtgctcctgcaggcagcacaggacaccacgtggagcagcatcacctccaccgctttcaccacaggaggccgggtgttccctcatccccaagactgtgcccagcatttgatgaatggagacactttgagtggggtttaccccatcttcctcaatggggagctgagccagaaattacaagtgtactgtgatatgaccaccgacgggggcggctggattgtattccagaggcggcagaatggccaaactgattttttccggaaatgggctgattaccgtgttggcttcgggaacgtggaggatgagttctggctggggctggacaatatacacaggatcacatcccagggccgctatgagctgcgcgtggacatgcgggatggccaagaggccgccttcgcctcctacgacaggttctctgtcgaggacagcagaaacctgtacaaactccgcataggaagctacaacggcactgcgggggactccctcagctatcatcaaggacgccctttctccacagaggatagagacaatgatgttgcagtgactaactgtgccatgtcgtacaagggagcatggtggtataagaactgccaccggaccaacctcaatgggaagtacggggagtccaggcacagtcagggcatcaactggtaccattggaaaggccatgagttctccatcccctttgtggaaatgaagatgcgcccctacaaccaccgtctcatggcagggagaaaacggcagtccttacagttctga

SEQ ID NO: 11121 - DNA, 1257 bp, synthetic construct; identical to SEQ ID NO: 625
  misc_feature 1..1257: note = Synthetic polypeptide
  source 1..1257: mol_type = other DNA

SEQ ID NO: 11122 - DNA, 1215 bp, synthetic construct; identical to SEQ ID NO: 626
  misc_feature 1..1215: note = Synthetic polypeptide
  source 1..1215: mol_type = other DNA

SEQ ID NO: 11123 - DNA, 507 bp, synthetic construct; identical to SEQ ID NO: 628
  misc_feature 1..507: note = Synthetic polypeptide
  source 1..507: mol_type = other DNA

SEQ ID NO: 11124 - DNA, 313 bp, synthetic construct; identical to SEQ ID NO: 629
  misc_feature 1..313: note = Synthetic polypeptide
  source 1..313: mol_type = other DNA

SEQ ID NO: 11125 - DNA, 291 bp, synthetic construct; identical to SEQ ID NO: 630
  misc_feature 1..291: note = Synthetic polypeptide
  source 1..291: mol_type = other DNA

SEQ ID NO: 11126 - DNA, 743 bp, synthetic construct
  misc_feature 1..743: note = Synthetic polypeptide
  source 1..743: mol_type = other DNA
gcattgttcatcacactgtattacatttactcaattgcactgtttcctagaccggatgatgggcacactggagcaaggactctttaatttctatacttccggtgcctaaacaggtgggcatcgttggcaggaccggggcagggaagtcctccctggccagtgggctgctgcggctccaggaggcagctgagggtgggatctggatcgacggggtccccattgcccacgtggggctgcacacactgcgctccaggatcagcatcatcccccaggaccccatcctgttccctggctctctgcggatgaacctcgacctgctgcaggagcactcggacgaggctatctgggcagccctggagacggtgcagctcaaagccttggtggccagcctgcccggccagctgcagtacaagtgtgctgaccgaggcgaggacctgagcgtgggccagaaacagctcctgtgtctggcacgtgcccttctccggaagacccagatcctcatcctggacgaggctactgctgccgtggaccctggcacggagctgcagatgcaggccatgctcgggagctggtttgcacagtgcactgtgctgctcattgcccaccgcctgcgctccgtgatggactgtgcccgggttctggtcatggacaaggggcaggtggcagagagcggcagcccggcccagctgctggcccagaagggcctgttttacagactggcccaggagtcaggcctggtctga

SEQ ID NO: 11127 - DNA, 752 bp, synthetic construct
  misc_feature 1..752: note = Synthetic polypeptide
  source 1..752: mol_type = other DNA
ggccgggcgcagcggctcaagcctgtaatcccggcactttgagaggccgagcagagcactgtccagagcttcctccagtggacaatagcatatttgtcgcaaaggaggtggaaggacagattctggggacttacgtttgtatcaagggctaccacctggtaggaaagaagacccttttttgcaatgcctctaaggagtgggataacaccactactgagtgccgcttgggccactgtcctgatcctgtgctggtgaatggagagttcagttcttcagggcctgtgaatgtaagtgacaaaatcacgtttatgtgcaatgaccactacatcctcaagggcagcaatcggagccagtgtctagaggaccacacctgggcacctccctttcccatctgcaaaagtagggactgtgaccctcctgggaatccagttcatggctattttgaaggaaataacttcaccttaggatccaccattagttattactgtgaagacaggtactacttagtgggcgtgcaggagcagcaatgcgttgatggggagtggagcagtgcacttccagtctgcaagttgatccaggaagctcccaaaccagagtgtgagaaggcacttcttgcctttcaggagagtaagaacctctgcgaagccatggagaactttatgcaacaattaaaggaaagtggcatgacaatggaggagctaaaatattctctggagctgaagaaagctgagttgaaggcaaaattgttgtaa

SEQ ID NO: 11128 - DNA, 536 bp, synthetic construct
  misc_feature 1..536: note = Synthetic polypeptide
  source 1..536: mol_type = other DNA
ggccgggcgcagcggctcaagcctgtaatcccggcactttgagaggccgagcagagcactgtccagagcttcctccagtggacaatagcatatttgtcgcaaaggaggtggaaggacagattctggggacttacgtttgtatcaagggctaccacctggtaggaaagaagacccttttttgcaatgcctctaaggagtgggataacaccactactgagtgccgcttgggccactgtcctgatcctgtgctggtgaatggagagttcagttcttcagggcctgtgaatgtaagtgacaaaatcacgtttatgtgcaatgaccactacatcctcaagggcagcaatcggagccagtgtctagaggaccacacctgggcacctccctttcccatctgcaaaagtagggactgtgaccctcctgggaatccagttcatggctattttgaaggaaataacttcaccttaggatccaccattagttattactgtgaagacaggtactacttagtgggcgtgcaggagcagcaatgcgttgat

SEQ ID NO: 11129 - DNA, 448 bp, synthetic construct
  misc_feature 1..448: note = Synthetic polypeptide
  source 1..448: mol_type = other DNA
gactggctgcggtgactcatgcctgtaatcccagagctttgggggatcatctgaggccatcgatgatgactgtaaccagacagggcagatgacagctggatttcttgactggccacagggcacattcgcctcccaggtgacgctggagggggacaagttgaaagtggagcgggagatcgatgggggcctggagaccctgcgcctgaagctgccagctgtggtgacagctgacctgaggctcaacgagccccgctacgccacgctgcccaacatcatgaaagccaagaagaagaagatcgaggtgatcaagcctggggacctgggtgtggacctgacctccaagctctctgtgatcagtgtggaggacccgccccagcgcacggccggcgtcaaggtggagaccactgaggacctggtggccaagctgaaggagattgggcggatttga

SEQ ID NO: 11130 - DNA, 374 bp, synthetic construct
  misc_feature 1..374: note = Synthetic polypeptide
  source 1..374: mol_type = other DNA
gactggctgcggtgactcatgcctgtaatcccagagctttgggggatcatctgaggccatcgatgatgactgtaaccagacagggcagatgacagctggatttcttgactggccacagggcacattcgcctcccaggtgacgctggagggggacaagttgaaagtggagcgggagatcgatgggggcctggagaccctgcgcctgaagctgccagctgtggtgacagctgacctgaggctcaacgagccccgctacgccacgctgcccaacatcatgaaagccaagaagaagaagatcgaggtgatcaagcctggggacctgggtgtggacctgacctccaagctctctgtgatcagtgtggaggacccgcccc

SEQ ID NO: 11131 - DNA, 1206 bp, synthetic construct; identical to SEQ ID NO: 7670
  misc_feature 1..1206: note = Synthetic polypeptide
  source 1..1206: mol_type = other DNA

SEQ ID NO: 11132 - DNA, 1134 bp, synthetic construct; identical to SEQ ID NO: 7671
  misc_feature 1..1134: note = Synthetic polypeptide
  source 1..1134: mol_type = other DNA

SEQ ID NO: 11133 - DNA, 1002 bp, synthetic construct; identical to SEQ ID NO: 7672
  misc_feature 1..1002: note = Synthetic polypeptide
  source 1..1002: mol_type = other DNA

SEQ ID NO: 11134 - DNA, 590 bp, synthetic construct
  misc_feature 1..590: note = Synthetic polypeptide
  source 1..590: mol_type = other DNA
caaaagtcagtgaactatggcccagagcgacctctgatttgtaaataaagctttattggaacatcaccacatacattcatttacatattatttatggctgcctgtgtgctacaacagcagcgctgagtcaccgtgacagagaccgtatgacctgcagagcctgagatatttactacatctgttccaccatagaaaaggccatcgatgatgactgtaaccagacagggcagatgacagctggatttcttgactggccacagggcacattcgcctcccaggtgacgctggagggggacaagttgaaagtggagcgggagatcgatgggggcctggagaccctgcgcctgaagctgccagctgtggtgacagctgacctgaggctcaacgagccccgctacgccacgctgcccaacatcatgaaagccaagaagaagaagatcgaggtgatcaagcctggggacctgggtgtggacctgacctccaagctctctgtgatcagtgtggaggacccgccccagcgcacggccggcgtcaaggtggagaccactgaggacctggtggccaagctgaaggagattgggcggatttga

SEQ ID NO: 11135 - DNA, 516 bp, synthetic construct
  misc_feature 1..516: note = Synthetic polypeptide
  source 1..516: mol_type = other DNA
caaaagtcagtgaactatggcccagagcgacctctgatttgtaaataaagctttattggaacatcaccacatacattcatttacatattatttatggctgcctgtgtgctacaacagcagcgctgagtcaccgtgacagagaccgtatgacctgcagagcctgagatatttactacatctgttccaccatagaaaaggccatcgatgatgactgtaaccagacagggcagatgacagctggatttcttgactggccacagggcacattcgcctcccaggtgacgctggagggggacaagttgaaagtggagcgggagatcgatgggggcctggagaccctgcgcctgaagctgccagctgtggtgacagctgacctgaggctcaacgagccccgctacgccacgctgcccaacatcatgaaagccaagaagaagaagatcgaggtgatcaagcctggggacctgggtgtggacctgacctccaagctctctgtgatcagtgtggaggacccgcccc

SEQ ID NO: 11136 - DNA, 7958 bp, synthetic construct
  misc_feature 1..7958: note = Synthetic polypeptide
  source 1..7958: mol_type = other DNA
aatttggtggcccatacagggaaaacattgtcctccgggaaagggtctttgatcacctcttgtgaggagacacatcccactgccttgttgcagtggcctcatgagtaaggaatcgagacccacctggtctgatgaataaccccagactctcaacaacgtggggagaaaaagacttgcaacactatggtggccaggtaactctgtgcgcagaccaaggtaagaaatgtcgcaggagtgacaaagtacttccttggtggtcactatattctggtggctgaaagttcatgaatggtaacaagtgctactgctgtgtggagtgaatgagtccaatctgtgggtctatggttacctcatacggcttagccttctctgaaggatcctgatgttggggtttatatagtcctcccaatgctaagcgggacttaaaatattcctaggaggaaagtggccagagtggatgaagcaaaaggagaagagtgtgaagaacctccaggaggtggggctaaaagataggcaagaaatctctaatacgagggattgagccacagaaagctccagacagataaaaaagaaattcctaatatgaggaactgagccacagcaagcctccagcaggcaacaaatccctaatatgagggattgagcctagctaagacccaatatgggaaataccccaagaaagacagagaataagaaggatgaaaatagtaacaaggatataccccttgatagtcccctaggtttcatgttaaaatactggaaagataatgagaggactaagcataagaagaaggagcaaatgataaaatattgctgtttcatttggacccaaggtcccatcctcaaaccctcaatcttctggccaaagtatgggtcgaatgagggtgtaatgagtcaactcctaatccaatatgttaatgataaaagtctggtttctcaagaagaactagactatgctctttgttggaagcagggacctgtcctcctctttcccttaaagacaactagggaagaatccgatccagcatctcaaattgagaagtcagacaagccgactcccacacctaaagtcagcacatgggatcccctagactgtcttcctttgcttactgccccaatcctaacccccctactcctcaggcagctgctgctgccccagatcccatcccagattcttccccaactcatgatgttcctcccgcttacaaccctgactctcaggggcagtcgtcccaagagcctgttcattgccaacctaaatatccttccttaaaagggctccaacatgaaatagagcagtgtaaaaaggacattcagaactccccttttctttccacacctaaggagtcagccataactttcttccctttaaaaggggtatcacaaggaggggaagtcattggttttgtaaatgctctcttgactatttcagaagtctgaggtctgaagaaagaacttaagccactgctagatgacccctatggagtggcagatcaagttgatcaattcttaggacctcagttatacacttgggtcgagcaaatgtctatcctaggcatcttcttttcaggggaggaaagaagcatgatccgtagggctgctatggcaatttgggaacatgaacaccctcctggtcaaaacgttcctactgtggaccaaacatttgctgcccaagcaagactcctggtgggacaacagcaatgcagcccactgagaaaacatgcaggacctaagggaaataataataaaaggaatcagtgaatccatacccagaactcaaaagctctctaaagcatttgatatacaacaggagaaagatgagggacctataagattcctagacagactaaaggagcaaatgaagcaatatacaggtctgaatttagaagatccccttgggcaaaggatgttaaagatccattttgtcactaaaggctggccagatgtttcaaaaaagttacaaaaattggaggactgagaaaaccgacctctaagagaacttctcagagaagctcaaaaggtgtatgtgaggagggacagggaaaaacaaaaacagaagtcaaaaccaatgttatctactttccagcaggtggctccaaacccatatgctactaaatgaggcttccagggagccagaaactataaaaggtcccaagcctcccaaacccagtttagagaaaccaaaccttcagctagaggacccaagtctacatttcccaggccccctaaagagcatagaaaagcaagaccaaaaaatcccaaaactgagagaggggaaggacaagataagtgttacaaatgtggaaggacagcccccttcaaaagagaatgtcccaaattagaaaaggagagagaagcccttccactcacgacctttgaagaggaacagggaagtcaggggctctgtctatattatcttgagtcccaccaggagcccttgataaatttggaggtgggacctacacatgagcttatcacatttttggttgattcaggagcggcctgttcctctgtttgtttcccctcatctaatgttgcctgctcttcagaagaacttatagtctctgagataaaaggggaaggatttacggtgagaatcttagaaaatacagaagtcaagtaccaagactaaacaacccaggttcaatttttgttaatccctgaagcagcaactagtttgttaggaagagacttaatgttaaagttaggcataggcctacaagtcagcccaaagggattccttacttcattaaacttactcaccacggcggatgagaaatacattcatcctgatgtttggtcaagggaagaaaactgaggaaagcttcgaattctcccaatccacatcaagctaaacaccccgcactgggaagtagtgaggaggaagcaattccccattcccttagagggcatgctagggctaaaacctataattgaaagtctcattaatgatgggcttcttgaaccctgtatgtctccttataacaccccaatactgcctgtcaaaaaatcagatgggtcataccggctggtgaaagacctcagagccattaaccaaacagtccagaccactaaccctgttgtccccaacccttacaccattctcagcaaaattccatataatcatcaatggtttactgtaatagatttaaaggatgctttttgggcatgtccctggctgaagagagccgagacacatttgcctttgagtgggaagatccccagttagggtgaaaacaatggtatcaatggacagtcttgcctcaggggttcatggattcacccaacctttttggtcaaattttagaacaagtgctagacaaagtttctgttccaaaacaattatgcctgcttcaatatgtcgatgatattctcatatctggtgaggatatagagaaagaagctggcttctctacacatatttttgaccatctacagttcgaggggttacgggtctcaaagggaaagcttcagtgtatggagcctaaagttaaatatttaggccgcttaataagtgcgggcaagcgaaggatagggcctgaatgggtcgaaggaatcgtgtccttacccttgcctcagactaaacaggaactcaggaaatttttagggttagttggatactgccgcttaaggattaactcacatgccctaaacagtaaacttttataccaaaaacttgcccagggaaaacctgagcatctcctgtggacttctaaagaggtcgatcaggtcaaagagctaaaaggaatagcttataactgctcttgccctagccttaccttccctagaaaatacacttcaccttttcgtcagcgtgaaaaatggggtggctttaggggtgcttatccaagagcacagaggctgctggcagcccatggccttcctgtcaaaaattttggacctggtcacctgtggatggcctcagtgcatccaatccattgcagctacagcagtattagttgaagagagtagaaaattaacctttgggtggagattaacagtaagcacaccccaccaagttagagagctattttaaataaaaaagcaggaaggtgactaactgactccagaatcttaaaatatggggctattctactaaaaaaagatgagagaacacctatgtctagatttaattgactaccaaacaaaactcaggccagatctaggaaagatccctttcaaaacaggacggcacttatttatagatggttcctcccagctgattgagggaaaaagacacaacgggtatccagtaatcgatggagaaattctctatgtataagaacagagtcaagaaaattgcctaataattggtctgcccaaacttgtgaactgtttgcactcagccaagccttaaagcacttgcaaaaccaggaaggaaccatctatactgattctaagtatgcctttggagtggctcatacatttggaaaaagttggactgaatgtggcctcactaatagtaaaggtcatgaccttgttcataaggagttaatcatccaagtactggataaccttcagttgccagaagaaatagctattgtccgtgtacccgggcaccagaaaagcctttcttttgaaagtcgaggaaataacctaacaaaccagatagccaaacaagctgctgtttcctccgaaacacctatgtttcacttaactccttgtcttccttcccctactgcaatttcctttttctcttccattgaaaaagaagaataaagataggagccaaaggagaagaccagaatgaaaacggctgttactagaccaaaaggaaatgttatccaagcccgttatgtggaagatctagtctcaactatatctgaggacacactggggatcccaagccatgtgcgatgcagttctcagggtctatggatgtataagaatttacaccctagccaaacaagttacagatagttgcttaatatgtaaaaagactagtaagcagattctaagaaaaccgccccttggagaaagagattcagggctaagaccatttccaagtgttcaattaattatactgaaatgcccccaattggtcatttaaaatacttattagtaataatagaccactttacctactgggtagagactatcccacactcaaatgcaaccaccagtaacgtagttaaggcattaattgaaaacattgtacccagatttggactaatacaaagcactgattcagacaatggaacccatttcactgcatatgtcattaaaaagttagcccaggtactagacataaaatggaaaaaccatatcccttggcatctctcctcctcaagaagagtagaaaggatgaatcagactctaaaaagccacttaactaaattagttctagaaacttgattgccatggactaaatgtcttcctattgccttgttaagaatccgaactgctcctcagagagatactggcctttccccttatgagatgctctatggattgccctatttatactccactgctaacattcctacattcaaaataaaagatcagttcctcaaaaattatatacttggtccatactctactttctcttcccttaagactaaaggtctcctagcacaggcgccaccgctggagtttccagcacattagcgtcagcctggagaccatgtcctcataaaagggtggaaggaaggcaaactcaaaccagcttgggaaggaccctacttggtgctcctaaatactaagactgcagtccgaacagcagaatgaggatggactgatcacacccgcgtcaaaaaggcgctgccacctccaggatcataaaccgtcactccagggctcaccccaaccaaattaactctaaaaagggcttaataatcacttgtttattttttcttttctttccaacagaaggtcatcttgtcatcaatgtaacttgggctaaccatcctttaatccttcagtttgatgcttgttcagtcatcctgtgtggagacaagcaagctcaaaggaagctgtctcatgtagataagtacctatgtccataccataaaaagtcaaccaagtataagtatagaaccttaaaaagtccctgtggtgactggacagatgtttggaaaccactcagtatggagggtggacagccaggccccctttttcaaataagttatggggactaaaacagaaactccaactaattcatggtcccaccccaccaaactgtaagccactgcagtgtaacccctcattgctaattatagctaacccccaaacaatggcccaagaacccactatattcaaacagtatggattaggagcaaatgttacaaaacaaaatcccataaaaatcttcaaccactggttaacaatgataattaaaaaaaaatccacacccagagtctgggaaacgagtggaatctaacactctctccaagtatagcgagctcagcgtcctcctcccatctccaaaacaacccaactaaagtaacggttgtaaaggtaaaaaatttaaagcagactatagccctagagacaggatgtcaagatgcaaatgcttggctaaaatggattaaatattccatctgcactttaaacaaatatgaatgttatgcttgtgctcacggtagaccagaggcccagattgtcccctttccactcagatggtcttctaactgaccgggcataagctgtatggtagttctcttccaagatcacacagcctggggtgacaaatcatgtcaagctctttctctgctgttccctgaagctcaacaccctgagggtcagcccccgagggccatcagcttccgtttcccaatgccaattttactttgtgtctctcacaacagggagaaaacttggtgttccttggagccttaatgggatgcagtgagcttaagtccttccaagagcttacccatcagtctgcccttagtcatcctcgagcggatgtatggtgtgacctgggagctgtcatttccctcctgctctggggacgacagctttttgcactgtactcaggcaatgatgtcacggatatttcagatgaccgcttcccgaagccccctgagattgcaaatggctatgtggagcacttgtttcgctaccagtgtaagaactactacagactgcgcacagaaggagatggagtatacaccttaaatgataagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggggccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggtggttctacaccctaactaccaccaggtagatattgggctcatcaaactcaaacagaaggtgcttgttaatgagagagtgatgcccatctgcctaccttcaaagaattatgcagaagtagggcgtgtgggttacgtgtctggctggggacaaagtgacaactttaaacttactgaccatctgaagtatgtcatgctgcctgtggctgaccaatacgattgcataacgcattatgaaggcagcacatgccccaaatggaaggcaccgaagagccctgtaggggtgcagcccatactgaacgaacacaccttctgtgtcggcatgtctaagtaccaggaagacacctgctatggcgatgcgggcagtgcctttgccgttcacgacctggaggaggacacctggtacgcggctgggatcctaagctttgataagagctgtgctgtggctgagtatggtgtgtatgtgaaggtgacttccatccagcactgggttcagaagaccatagctgagaactaa

SEQ ID NO: 11137 - DNA, 7265 bp, synthetic construct
  misc_feature 1..7265: note = Synthetic polypeptide
  source 1..7265: mol_type = other DNA
aatttggtggcccatacagggaaaacattgtcctccgggaaagggtctttgatcacctcttgtgaggagacacatcccactgccttgttgcagtggcctcatgagtaaggaatcgagacccacctggtctgatgaataaccccagactctcaacaacgtggggagaaaaagacttgcaacactatggtggccaggtaactctgtgcgcagaccaaggtaagaaatgtcgcaggagtgacaaagtacttccttggtggtcactatattctggtggctgaaagttcatgaatggtaacaagtgctactgctgtgtggagtgaatgagtccaatctgtgggtctatggttacctcatacggcttagccttctctgaaggatcctgatgttggggtttatatagtcctcccaatgctaagcgggacttaaaatattcctaggaggaaagtggccagagtggatgaagcaaaaggagaagagtgtgaagaacctccaggaggtggggctaaaagataggcaagaaatctctaatacgagggattgagccacagaaagctccagacagataaaaaagaaattcctaatatgaggaactgagccacagcaagcctccagcaggcaacaaatccctaatatgagggattgagcctagctaagacccaatatgggaaataccccaagaaagacagagaataagaaggatgaaaatagtaacaaggatataccccttgatagtcccctaggtttcatgttaaaatactggaaagataatgagaggactaagcataagaagaaggagcaaatgataaaatattgctgtttcatttggacccaaggtcccatcctcaaaccctcaatcttctggccaaagtatgggtcgaatgagggtgtaatgagtcaactcctaatccaatatgttaatgataaaagtctggtttctcaagaagaactagactatgctctttgttggaagcagggacctgtcctcctctttcccttaaagacaactagggaagaatccgatccagcatctcaaattgagaagtcagacaagccgactcccacacctaaagtcagcacatgggatcccctagactgtcttcctttgcttactgccccaatcctaacccccctactcctcaggcagctgctgctgccccagatcccatcccagattcttccccaactcatgatgttcctcccgcttacaaccctgactctcaggggcagtcgtcccaagagcctgttcattgccaacctaaatatccttccttaaaagggctccaacatgaaatagagcagtgtaaaaaggacattcagaactccccttttctttccacacctaaggagtcagccataactttcttccctttaaaaggggtatcacaaggaggggaagtcattggttttgtaaatgctctcttgactatttcagaagtctgaggtctgaagaaagaacttaagccactgctagatgacccctatggagtggcagatcaagttgatcaattcttaggacctcagttatacacttgggtcgagcaaatgtctatcctaggcatcttcttttcaggggaggaaagaagcatgatccgtagggctgctatggcaatttgggaacatgaacaccctcctggtcaaaacgttcctactgtggaccaaacatttgctgcccaagcaagactcctggtgggacaacagcaatgcagcccactgagaaaacatgcaggacctaagggaaataataataaaaggaatcagtgaatccatacccagaactcaaaagctctctaaagcatttgatatacaacaggagaaagatgagggacctataagattcctagacagactaaaggagcaaatgaagcaatatacaggtctgaatttagaagatccccttgggcaaaggatgttaaagatccattttgtcactaaaggctggccagatgtttcaaaaaagttacaaaaattggaggactgagaaaaccgacctctaagagaacttctcagagaagctcaaaaggtgtatgtgaggagggacagggaaaaacaaaaacagaagtcaaaaccaatgttatctactttccagcaggtggctccaaacccatatgctactaaatgaggcttccagggagccagaaactataaaaggtcccaagcctcccaaacccagtttagagaaaccaaaccttcagctagaggacccaagtctacatttcccaggccccctaaagagcatagaaaagcaagaccaaaaaatcccaaaactgagagaggggaaggacaagataagtgttacaaatgtggaaggacagcccccttcaaaagagaatgtcccaaattagaaaaggagagagaagcccttccactcacgacctttgaagaggaacagggaagtcaggggctctgtctatattatcttgagtcccaccaggagcccttgataaatttggaggtgggacctacacatgagcttatcacatttttggttgattcaggagcggcctgttcctctgtttgtttcccctcatctaatgttgcctgctcttcagaagaacttatagtctctgagataaaaggggaaggatttacggtgagaatcttagaaaatacagaagtcaagtaccaagactaaacaacccaggttcaatttttgttaatccctgaagcagcaactagtttgttaggaagagacttaatgttaaagttaggcataggcctacaagtcagcccaaagggattccttacttcattaaacttactcaccacggcggatgagaaatacattcatcctgatgtttggtcaagggaagaaaactgaggaaagcttcgaattctcccaatccacatcaagctaaacaccccgcactgggaagtagtgaggaggaagcaattccccattcccttagagggcatgctagggctaaaacctataattgaaagtctcattaatgatgggcttcttgaaccctgtatgtctccttataacaccccaatactgcctgtcaaaaaatcagatgggtcataccggctggtgaaagacctcagagccattaaccaaacagtccagaccactaaccctgttgtccccaacccttacaccattctcagcaaaattccatataatcatcaatggtttactgtaatagatttaaaggatgctttttgggcatgtccctggctgaagagagccgagacacatttgcctttgagtgggaagatccccagttagggtgaaaacaatggtatcaatggacagtcttgcctcaggggttcatggattcacccaacctttttggtcaaattttagaacaagtgctagacaaagtttctgttccaaaacaattatgcctgcttcaatatgtcgatgatattctcatatctggtgaggatatagagaaagaagctggcttctctacacatatttttgaccatctacagttcgaggggttacgggtctcaaagggaaagcttcagtgtatggagcctaaagttaaatatttaggccgcttaataagtgcgggcaagcgaaggatagggcctgaatgggtcgaaggaatcgtgtccttacccttgcctcagactaaacaggaactcaggaaatttttagggttagttggatactgccgcttaaggattaactcacatgccctaaacagtaaacttttataccaaaaacttgcccagggaaaacctgagcatctcctgtggacttctaaagaggtcgatcaggtcaaagagctaaaaggaatagcttataactgctcttgccctagccttaccttccctagaaaatacacttcaccttttcgtcagcgtgaaaaatggggtggctttaggggtgcttatccaagagcacagaggctgctggcagcccatggccttcctgtcaaaaattttggacctggtcacctgtggatggcctcagtgcatccaatccattgcagctacagcagtattagttgaagagagtagaaaattaacctttgggtggagattaacagtaagcacaccccaccaagttagagagctattttaaataaaaaagcaggaaggtgactaactgactccagaatcttaaaatatggggctattctactaaaaaaagatgagagaacacctatgtctagatttaattgactaccaaacaaaactcaggccagatctaggaaagatccctttcaaaacaggacggcacttatttatagatggttcctcccagctgattgagggaaaaagacacaacgggtatccagtaatcgatggagaaattctctatgtataagaacagagtcaagaaaattgcctaataattggtctgcccaaacttgtgaactgtttgcactcagccaagccttaaagcacttgcaaaaccaggaaggaaccatctatactgattctaagtatgcctttggagtggctcatacatttggaaaaagttggactgaatgtggcctcactaatagtaaaggtcatgaccttgttcataaggagttaatcatccaagtactggataaccttcagttgccagaagaaatagctattgtccgtgtacccgggcaccagaaaagcctttcttttgaaagtcgaggaaataacctaacaaaccagatagccaaacaagctgctgtttcctccgaaacacctatgtttcacttaactccttgtcttccttcccctactgcaatttcctttttctcttccattgaaaaagaagaataaagataggagccaaaggagaagaccagaatgaaaacggctgttactagaccaaaaggaaatgttatccaagcccgttatgtggaagatctagtctcaactatatctgaggacacactggggatcccaagccatgtgcgatgcagttctcagggtctatggatgtataagaatttacaccctagccaaacaagttacagatagttgcttaatatgtaaaaagactagtaagcagattctaagaaaaccgccccttggagaaagagattcagggctaagaccatttccaagtgttcaattaattatactgaaatgcccccaattggtcatttaaaatacttattagtaataatagaccactttacctactgggtagagactatcccacactcaaatgcaaccaccagtaacgtagttaaggcattaattgaaaacattgtacccagatttggactaatacaaagcactgattcagacaatggaacccatttcactgcatatgtcattaaaaagttagcccaggtactagacataaaatggaaaaaccatatcccttggcatctctcctcctcaagaagagtagaaaggatgaatcagactctaaaaagccacttaactaaattagttctagaaacttgattgccatggactaaatgtcttcctattgccttgttaagaatccgaactgctcctcagagagatactggcctttccccttatgagatgctctatggattgccctatttatactccactgctaacattcctacattcaaaataaaagatcagttcctcaaaaattatatacttggtccatactctactttctcttcccttaagactaaaggtctcctagcacaggcgccaccgctggagtttccagcacattagcgtcagcctggagaccatgtcctcataaaagggtggaaggaaggcaaactcaaaccagcttgggaaggaccctacttggtgctcctaaatactaagactgcagtccgaacagcagaatgaggatggactgatcacacccgcgtcaaaaaggcgctgccacctccaggatcataaaccgtcactccagggctcaccccaaccaaattaactctaaaaagggcttaataatcacttgtttattttttcttttctttccaacagaaggtcatcttgtcatcaatgtaacttgggctaaccatcctttaatccttcagtttgatgcttgttcagtcatcctgtgtggagacaagcaagctcaaaggaagctgtctcatgtagataagtacctatgtccataccataaaaagtcaaccaagtataagtatagaaccttaaaaagtccctgtggtgactggacagatgtttggaaaccactcagtatggagggtggacagccaggccccctttttcaaataagttatggggactaaaacagaaactccaactaattcatggtcccaccccaccaaactgtaagccactgcagtgtaacccctcattgctaattatagctaacccccaaacaatggcccaagaacccactatattcaaacagtatggattaggagcaaatgttacaaaacaaaatcccataaaaatcttcaaccactggttaacaatgataattaaaaaaaaatccacacccagagtctgggaaacgagtggaatctaacactctctccaagtatagcgagctcagcgtcctcctcccatctccaaaacaacccaactaaagtaacggttgtaaaggtaaaaaatttaaagcagactatagccctagagacaggatgtcaagatgcaaatgcttggctaaaatggattaaatattccatctgcactttaaacaaatatgaatgttatgcttgtgctcacggtagaccagaggcccagattgtcccctttccactcagatggtcttctaactgaccgggcataagctgtatggtagttctcttccaagatcacacagcctggggtgacaaatcatgtcaagctctttctctgctgttccctgaagctcaacaccctgagggtcagcccccgagggccatcagcttccgtttcccaatgccaattttactttgtgtctctcacaacagggagaaaacttggtgttccttggagccttaatgggatgcagtgagcttaagtccttccaagagcttacccatcagtctgcccttagtcatcctcgagcggatgtatggtgtgacctgggagctgtcatttccctcctgctctggggacgacagctttttgcactgtactcaggcaatgatgtcacggatatttcagatgaccgcttcccgaagccccctgagattgcaaatggctatgtggagcacttgtttcgctaccagtgtaagaactactacagactgcgcacagaaggagatggagtatacaccttaaatgataagaagcagtggataaataaggctgttggagataaacttcctgaatgtgaagcagtatgtgggaagcccaagaatccggcaaacccagtgcagcggatcctgggaggacacctggtacgcggctgggatcctaagctttga

SEQ ID NO: 11138 - DNA, 304 bp, synthetic construct
  misc_feature 1..304: note = Synthetic polypeptide
  source 1..304: mol_type = other DNA
tgatattgtttggctctgtccccacccgaatctcacatggaattttcagccccatgtgttggaggcgggtcctgctgggaggtgattgtatcacggggctggtttctaatggtttagccccacctcccaggtgctgtttctcacaaggtctcattgtttaaaagtgtgtagcacctcccccttcgctctgtctctcctgctgtcttgtgaagaagggacttgcttcctctttgccttccaccatgattatcactggcaagtggttttatatcgcatcggcctttcgaaacgaggagtacaataa

SEQ ID NO: 11139 - DNA, 740 bp, synthetic construct
  misc_feature 1..740: note = Synthetic polypeptide
  source 1..740: mol_type = other DNA
tgatattgtttggctctgtccccacccgaatctcacatggaattttcagccccatgtgttggaggcgggtcctgctgggaggtgattgtatcacggggctggtttctaatggtttagccccacctcccaggtgctgtttctcacaaggtctcattgtttaaaagtgtgtagcacctcccccttcgctctgtctctcctgctgtcttgtgaagaagggacttgcttcctctttgccttccaccatgattatcactggcaagtggttttatatcgcatcggcctttcgaaacgaggagtacaataagtcggttcaggagatccaagcaaccttcttttactttacccccaacaagacagaggacacgatctttctcagagagtaccagacccgccagaaccagtgcttctataactccagttacctgaatgtccagcgggagaatgggaccgtctccagatacgagggaggccgagaacatgttgctcacctgctgttccttagggacaccaagaccttgatgtttggttcctacctggacgatgagaagaactgggggctgtctttctatgctgacaagccagagacgaccaaggagcaactgggagagttctacgaagctctcgactgcttgtgcattcccaggtcagatgtcatgtacaccgactggaaaaaggataagtgtgagccactggagaagcagcacgagaaggagaggaaacaggaggagggggaatcctag

SEQ ID NO: 11140 - DNA, 1245 bp, synthetic construct
  misc_feature 1..1245: note = Synthetic polypeptide
  source 1..1245: mol_type = other DNA
gggtaaaagccagggaaagacagattttggctcagtatagtgaagactttggtaacttggcagcccaaaggttgaagggcagttgttagaatcagtgaatttttggccatcggaggtatgtattcgagcagaggctgggaaggcaggggagccttcagacatctggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaa

SEQ ID NO: 11141 - DNA, 690 bp, synthetic construct
  misc_feature 1..690: note = Synthetic polypeptide
  source 1..690: mol_type = other DNA
gggtaaaagccagggaaagacagattttggctcagtatagtgaagactttggtaacttggcagcccaaaggttgaagggcagttgttagaatcagtgaatttttggccatcggaggtatgtattcgagcagaggctgggaaggcaggggagccttcagacatctggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggtatggtccaagcctgaggctcctggcaccaccgggtgctgtcaagggaacaggccaagagcaccaggggcagggctgccactag

SEQ ID NO: 11142 - DNA, 1104 bp, synthetic construct
  misc_feature 1..1104: note = Synthetic polypeptide
  source 1..1104: mol_type = other DNA
gggtaaaagccagggaaagacagattttggctcagtatagtgaagactttggtaacttggcagcccaaaggttgaagggcagttgttagaatcagtgaatttttggccatcggaggtatgtattcgagcagaggctgggaaggcaggggagccttcagacatctggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaaggacagatccagaaactga

SEQ ID NO: 11143 - DNA, 711 bp, synthetic construct
  misc_feature 1..711: note = Synthetic polypeptide
  source 1..711: mol_type = other DNA
gggtaaaagccagggaaagacagattttggctcagtatagtgaagactttggtaacttggcagcccaaaggttgaagggcagttgttagaatcagtgaatttttggccatcggaggtatgtattcgagcagaggctgggaaggcaggggagccttcagacatctggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccac

SEQ ID NO: 11144 - DNA, 470 bp, synthetic construct
  misc_feature 1..470: note = Synthetic polypeptide
  source 1..470: mol_type = other DNA
gggtaaaagccagggaaagacagattttggctcagtatagtgaagactttggtaacttggcagcccaaaggttgaagggcagttgttagaatcagtgaatttttggccatcggaggtatgtattcgagcagaggctgggaaggcaggggagccttcagacatctggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtg

SEQ ID NO: 11145 - DNA, 226 bp, synthetic construct
  misc_feature 1..226: note = Synthetic polypeptide
  source 1..226: mol_type = other DNA
gggtaaaagccagggaaagacagattttggctcagtatagtgaagactttggtaacttggcagcccaaaggttgaagggcagttgttagaatcagtgaatttttggccatcggaggtatgtattcgagcagaggctgggaaggcaggggagccttcagacatctggatgacaaggagtatgtgggctttgcaaccctccccaaccaagtccaccgaaagtccgtga

SEQ ID NO: 11146 - DNA, 692 bp, synthetic construct
  misc_feature 1..692: note = Synthetic polypeptide
  source 1..692: mol_type = other DNA
tgatatagtttggatgtgtgttcctgctcaaatctcatattgaattgtaatctccagtgttggaggtggtgcttggtgggaggtgactggatcatgcgggtggatttctcatgaatggtctagcaccatctccctaggtactgtcctcatgacagcgagtgagttctcatgagatctggttgtttaaaagtgtgtaacgcctcctccctctctcgttcctgcacctgttatgtgagatgcctccctccccctttgccttctgccatgattgtaagttttccgaggcctccccagaagccgagcagatgccagcaccatgtttcctgtacagcctgcagaactgggactgtgaccctcctgggaatccagttcatggctattttgaaggaaataacttcaccttaggatccaccattagttattactgtgaagacaggtactacttagtgggcgtgcaggagcagcaatgcgttgatggggagtggagcagtgcacttccagtctgcaagttgatccaggaagctcccaaaccagagtgtgagaaggcacttcttgcctttcaggagagtaagaacctctgcgaagccatggagaactttatgcaacaattaaaggaaagtggcatgacaatggaggagctaaaatattctctggagctgaagaaagctgagttgaaggcaaaattgttgtaa

SEQ ID NO: 11147 - DNA, 476 bp, synthetic construct
  misc_feature 1..476: note = Synthetic polypeptide
  source 1..476: mol_type = other DNA
tgatatagtttggatgtgtgttcctgctcaaatctcatattgaattgtaatctccagtgttggaggtggtgcttggtgggaggtgactggatcatgcgggtggatttctcatgaatggtctagcaccatctccctaggtactgtcctcatgacagcgagtgagttctcatgagatctggttgtttaaaagtgtgtaacgcctcctccctctctcgttcctgcacctgttatgtgagatgcctccctccccctttgccttctgccatgattgtaagttttccgaggcctccccagaagccgagcagatgccagcaccatgtttcctgtacagcctgcagaactgggactgtgaccctcctgggaatccagttcatggctattttgaaggaaataacttcaccttaggatccaccattagttattactgtgaagacaggtactacttagtgggcgtgcaggagcagcaatgcgttgat

SEQ ID NO: 11148 - DNA, 8217 bp, synthetic construct
  misc_feature 1..8217: note = Synthetic polypeptide
  source 1..8217: mol_type = other DNA
aatttggtggcccatacagggaaaacattgtcctccgggaaagggtctttgatcacctcttgtgaggagacacatcccactgccttgttgcagtggcctcatgagtaaggaatcgagacccacctggtctgatgaataaccccagactctcaacaacgtggggagaaaaagacttgcaacactatggtggccaggtaactctgtgcgcagaccaaggtaagaaatgtcgcaggagtgacaaagtacttccttggtggtcactatattctggtggctgaaagttcatgaatggtaacaagtgctactgctgtgtggagtgaatgagtccaatctgtgggtctatggttacctcatacggcttagccttctctgaaggatcctgatgttggggtttatatagtcctcccaatgctaagcgggacttaaaatattcctaggaggaaagtggccagagtggatgaagcaaaaggagaagagtgtgaagaacctccaggaggtggggctaaaagataggcaagaaatctctaatacgagggattgagccacagaaagctccagacagataaaaaagaaattcctaatatgaggaactgagccacagcaagcctccagcaggcaacaaatccctaatatgagggattgagcctagctaagacccaatatgggaaataccccaagaaagacagagaataagaaggatgaaaatagtaacaaggatataccccttgatagtcccctaggtttcatgttaaaatactggaaagataatgagaggactaagcataagaagaaggagcaaatgataaaatattgctgtttcatttggacccaaggtcccatcctcaaaccctcaatcttctggccaaagtatgggtcgaatgagggtgtaatgagtcaactcctaatccaatatgttaatgataaaagtctggtttctcaagaagaactagactatgctctttgttggaagcagggacctgtcctcctctttcccttaaagacaactagggaagaatccgatccagcatctcaaattgagaagtcagacaagccgactcccacacctaaagtcagcacatgggatcccctagactgtcttcctttgcttactgccccaatcctaacccccctactcctcaggcagctgctgctgccccagatcccatcccagattcttccccaactcatgatgttcctcccgcttacaaccctgactctcaggggcagtcgtcccaagagcctgttcattgccaacctaaatatccttccttaaaagggctccaacatgaaatagagcagtgtaaaaaggacattcagaactccccttttctttccacacctaaggagtcagccataactttcttccctttaaaaggggtatcacaaggaggggaagtcattggttttgtaaatgctctcttgactatttcagaagtctgaggtctgaagaaagaacttaagccactgctagatgacccctatggagtggcagatcaagttgatcaattcttaggacctcagttatacacttgggtcgagcaaatgtctatcctaggcatcttcttttcaggggaggaaagaagcatgatccgtagggctgctatggcaatttgggaacatgaacaccctcctggtcaaaacgttcctactgtggaccaaacatttgctgcccaagcaagactcctggtgggacaacagcaatgcagcccactgagaaaacatgcaggacctaagggaaataataataaaaggaatcagtgaatccatacccagaactcaaaagctctctaaagcatttgatatacaacaggagaaagatgagggacctataagattcctagacagactaaaggagcaaatgaagcaatatacaggtctgaatttagaagatccccttgggcaaaggatgttaaagatccattttgtcactaaaggctggccagatgtttcaaaaaagttacaaaaattggaggactgagaaaaccgacctctaagagaacttctcagagaagctcaaaaggtgtatgtgaggagggacagggaaaaacaaaaacagaagtcaaaaccaatgttatctactttccagcaggtggctccaaacccatatgctactaaatgaggcttccagggagccagaaactataaaaggtcccaagcctcccaaacccagtttagagaaaccaaaccttcagctagaggacccaagtctacatttcccaggccccctaaagagcatagaaaagcaagaccaaaaaatcccaaaactgagagaggggaaggacaagataagtgttacaaatgtggaaggacagcccccttcaaaagagaatgtcccaaattagaaaaggagagagaagcccttccactcacgacctttgaagaggaacagggaagtcaggggctctgtctatattatcttgagtcccaccaggagcccttgataaatttggaggtgggacctacacatgagcttatcacatttttggttgattcaggagcggcctgttcctctgtttgtttcccctcatctaatgttgcctgctcttcagaagaacttatagtctctgagataaaaggggaaggatttacggtgagaatcttagaaaatacagaagtcaagtaccaagactaaacaacccaggttcaatttttgttaatccctgaagcagcaactagtttgttaggaagagacttaatgttaaagttaggcataggcctacaagtcagcccaaagggattccttacttcattaaacttactcaccacggcggatgagaaatacattcatcctgatgtttggtcaagggaagaaaactgaggaaagcttcgaattctcccaatccacatcaagctaaacaccccgcactgggaagtagtgaggaggaagcaattccccattcccttagagggcatgctagggctaaaacctataattgaaagtctcattaatgatgggcttcttgaaccctgtatgtctccttataacaccccaatactgcctgtcaaaaaatcagatgggtcataccggctggtgaaagacctcagagccattaaccaaacagtccagaccactaaccctgttgtccccaacccttacaccattctcagcaaaattccatataatcatcaatggtttactgtaatagatttaaaggatgctttttgggcatgtccctggctgaagagagccgagacacatttgcctttgagtgggaagatccccagttagggtgaaaacaatggtatcaatggacagtcttgcctcaggggttcatggattcacccaacctttttggtcaaattttagaacaagtgctagacaaagtttctgttccaaaacaattatgcctgcttcaatatgtcgatgatattctcatatctggtgaggatatagagaaagaagctggcttctctacacatatttttgaccatctacagttcgaggggttacgggtctcaaagggaaagcttcagtgtatggagcctaaagttaaatatttaggccgcttaataagtgcgggcaagcgaaggatagggcctgaatgggtcgaaggaatcgtgtccttacccttgcctcagactaaacaggaactcaggaaatttttagggttagttggatactgccgcttaaggattaactcacatgccctaaacagtaaacttttataccaaaaacttgcccagggaaaacctgagcatctcctgtggacttctaaagaggtcgatcaggtcaaagagctaaaaggaatagcttataactgctcttgccctagccttaccttccctagaaaatacacttcaccttttcgtcagcgtgaaaaatggggtggctttaggggtgcttatccaagagcacagaggctgctggcagcccatggccttcctgtcaaaaattttggacctggtcacctgtggatggcctcagtgcatccaatccattgcagctacagcagtattagttgaagagagtagaaaattaacctttgggtggagattaacagtaagcacaccccaccaagttagagagctattttaaataaaaaagcaggaaggtgactaactgactccagaatcttaaaatatggggctattctactaaaaaaagatgagagaacacctatgtctagatttaattgactaccaaacaaaactcaggccagatctaggaaagatccctttcaaaacaggacggcacttatttatagatggttcctcccagctgattgagggaaaaagacacaacgggtatccagtaatcgatggagaaattctctatgtataagaacagagtcaagaaaattgcctaataattggtctgcccaaacttgtgaactgtttgcactcagccaagccttaaagcacttgcaaaaccaggaaggaaccatctatactgattctaagtatgcctttggagtggctcatacatttggaaaaagttggactgaatgtggcctcactaatagtaaaggtcatgaccttgttcataaggagttaatcatccaagtactggataaccttcagttgccagaagaaatagctattgtccgtgtacccgggcaccagaaaagcctttcttttgaaagtcgaggaaataacctaacaaaccagatagccaaacaagctgctgtttcctccgaaacacctatgtttcacttaactccttgtcttccttcccctactgcaatttcctttttctcttccattgaaaaagaagaataaagataggagccaaaggagaagaccagaatgaaaacggctgttactagaccaaaaggaaatgttatccaagcccgttatgtggaagatctagtctcaactatatctgaggacacactggggatcccaagccatgtgcgatgcagttctcagggtctatggatgtataagaatttacaccctagccaaacaagttacagatagttgcttaatatgtaaaaagactagtaagcagattctaagaaaaccgccccttggagaaagagattcagggctaagaccatttccaagtgttcaattaattatactgaaatgcccccaattggtcatttaaaatacttattagtaataatagaccactttacctactgggtagagactatcccacactcaaatgcaaccaccagtaacgtagttaaggcattaattgaaaacattgtacccagatttggactaatacaaagcactgattcagacaatggaacccatttcactgcatatgtcattaaaaagttagcccaggtactagacataaaatggaaaaaccatatcccttggcatctctcctcctcaagaagagtagaaaggatgaatcagactctaaaaagccacttaactaaattagttctagaaacttgattgccatggactaaatgtcttcctattgccttgttaagaatccgaactgctcctcagagagatactggcctttccccttatgagatgctctatggattgccctatttatactccactgctaacattcctacattcaaaataaaagatcagttcctcaaaaattatatacttggtccatactctactttctcttcccttaagactaaaggtctcctagcacaggcgccaccgctggagtttccagcacattagcgtcagcctggagaccatgtcctcataaaagggtggaaggaaggcaaactcaaaccagcttgggaaggaccctacttggtgctcctaaatactaagactgcagtccgaacagcagaatgaggatggactgatcacacccgcgtcaaaaaggcgctgccacctccaggatcataaaccgtcactccagggctcaccccaaccaaattaactctaaaaagggcttaataatcacttgtttattttttcttttctttccaacagaaggtcatcttgtcatcaatgtaacttgggctaaccatcctttaatccttcagtttgatgcttgttcagtcatcctgtgtggagacaagcaagctcaaaggaagctgtctcatgtagataagtacctatgtccataccataaaaagtcaaccaagtataagtatagaaccttaaaaagtccctgtggtgactggacagatgtttggaaaccactcagtatggagggtggacagccaggccccctttttcaaataagttatggggactaaaacagaaactccaactaattcatggtcccaccccaccaaactgtaagccactgcagtgtaacccctcattgctaattatagctaacccccaaacaatggcccaagaacccactatattcaaacagtatggattaggagcaaatgttacaaaacaaaatcccataaaaatcttcaaccactggttaacaatgataattaaaaaaaaatccacacccagagtctgggaaacgagtggaatctaacactctctccaagtatagcgagctcagcgtcctcctcccatctccaaaacaacccaactaaagtaacggttgtaaaggtaaaaaatttaaagcagactatagccctagagacaggatgtcaagatgcaaatgcttggctaaaatggattaaatattccatctgcactttaaacaaatatgaatgttatgcttgtgctcacggtagaccagaggcccagattgtcccctttccactcagatggtcttctaactgaccgggcataagctgtatggtagttctcttccaagatcacacagcctggggtgacaaatcatgtcaagctctttctctgctgttccctgaagctcaacaccctgagggtcagcccccgagggccatcagcttccgtttcccaatgccaattttactttgtgtctctcacaacagggagaaaacttggtgttccttggagccttaatgggatgcagtgagcttaagtccttccaagagcttacccatcagtctgcccttagtcatcctcgagcggatgtatggtggtattgtggtggaccattactggacactgccgagtaactggagcagaacatgcactctaattccattggctatccctttcaccctggcatttcatcaaccagaaaagacagaaaccaaacactgtaaaacaagagaggcccctcatgggtctgttgactcccacatttatatagattccactggagtccaacgaggagtgccagatgaatttaaggcccaaaatcagacaactgcaggatttgaatccacgttcttctgtgacctgggagctgtcatttccctcctgctctggggacgacagctttttgcactgtactcaggcaatgatgtcacggatatttcagatgaccgcttcccgaagccccctgagattgcaaatggctatgtggagcacttgtttcgctaccagtgtaagaactactacagactgcgcacagaaggagatggagtatacaccttaaatgataagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggggccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggtggttctacaccctaactaccaccaggtagatattgggctcatcaaactcaaacagaaggtgcttgttaatgagagagtgatgcccatctgcctaccttcaaagaattatgcagaagtagggcgtgtgggttacgtgtctggctggggacaaagtgacaactttaaacttactgaccatctgaagtatgtcatgctgcctgtggctgaccaatacgattgcataacgcattatgaaggcagcacatgccccaaatggaaggcaccgaagagccctgtaggggtgcagcccatactgaacgaacacaccttctgtgtcggcatgtctaagtaccaggaagacacctgctatggcgatgcgggcagtgcctttgccgttcacgacctggaggaggacacctggtacgcggctgggatcctaagctttgataagagctgtgctgtggctgagtatggtgtgtatgtgaaggtgacttccatccagcactgggttcagaagaccatagctgagaactaa

SEQ ID NO: 11149 - DNA, 7524 bp, synthetic construct
  misc_feature 1..7524: note = Synthetic polypeptide
  source 1..7524: mol_type = other DNA
aatttggtggcccatacagggaaaacattgtcctccgggaaagggtctttgatcacctcttgtgaggagacacatcccactgccttgttgcagtggcctcatgagtaaggaatcgagacccacctggtctgatgaataaccccagactctcaacaacgtggggagaaaaagacttgcaacactatggtggccaggtaactctgtgcgcagaccaaggtaagaaatgtcgcaggagtgacaaagtacttccttggtggtcactatattctggtggctgaaagttcatgaatggtaacaagtgctactgctgtgtggagtgaatgagtccaatctgtgggtctatggttacctcatacggcttagccttctctgaaggatcctgatgttggggtttatatagtcctcccaatgctaagcgggacttaaaatattcctaggaggaaagtggccagagtggatgaagcaaaaggagaagagtgtgaagaacctccaggaggtggggctaaaagataggcaagaaatctctaatacgagggattgagccacagaaagctccagacagataaaaaagaaattcctaatatgaggaactgagccacagcaagcctccagcaggcaacaaatccctaatatgagggattgagcctagctaagacccaatatgggaaataccccaagaaagacagagaataagaaggatgaaaatagtaacaaggatataccccttgatagtcccctaggtttcatgttaaaatactggaaagataatgagaggactaagcataagaagaaggagcaaatgataaaatattgctgtttcatttggacccaaggtcccatcctcaaaccctcaatcttctggccaaagtatgggtcgaatgagggtgtaatgagtcaactcctaatccaatatgttaatgataaaagtctggtttctcaagaagaactagactatgctctttgttggaagcagggacctgtcctcctctttcccttaaagacaactagggaagaatccgatccagcatctcaaattgagaagtcagacaagccgactcccacacctaaagtcagcacatgggatcccctagactgtcttcctttgcttactgccccaatcctaacccccctactcctcaggcagctgctgctgccccagatcccatcccagattcttccccaactcatgatgttcctcccgcttacaaccctgactctcaggggcagtcgtcccaagagcctgttcattgccaacctaaatatccttccttaaaagggctccaacatgaaatagagcagtgtaaaaaggacattcagaactccccttttctttccacacctaaggagtcagccataactttcttccctttaaaaggggtatcacaaggaggggaagtcattggttttgtaaatgctctcttgactatttcagaagtctgaggtctgaagaaagaacttaagccactgctagatgacccctatggagtggcagatcaagttgatcaattcttaggacctcagttatacacttgggtcgagcaaatgtctatcctaggcatcttcttttcaggggaggaaagaagcatgatccgtagggctgctatggcaatttgggaacatgaacaccctcctggtcaaaacgttcctactgtggaccaaacatttgctgcccaagcaagactcctggtgggacaacagcaatgcagcccactgagaaaacatgcaggacctaagggaaataataataaaaggaatcagtgaatccatacccagaactcaaaagctctctaaagcatttgatatacaacaggagaaagatgagggacctataagattcctagacagactaaaggagcaaatgaagcaatatacaggtctgaatttagaagatccccttgggcaaaggatgttaaagatccattttgtcactaaaggctggccagatgtttcaaaaaagttacaaaaattggaggactgagaaaaccgacctctaagagaacttctcagagaagctcaaaaggtgtatgtgaggagggacagggaaaaacaaaaacagaagtcaaaaccaatgttatctactttccagcaggtggctccaaacccatatgctactaaatgaggcttccagggagccagaaactataaaaggtcccaagcctcccaaacccagtttagagaaaccaaaccttcagctagaggacccaagtctacatttcccaggccccctaaagagcatagaaaagcaagaccaaaaaatcccaaaactgagagaggggaaggacaagataagtgttacaaatgtggaaggacagcccccttcaaaagagaatgtcccaaattagaaaaggagagagaagcccttccactcacgacctttgaagaggaacagggaagtcaggggctctgtctatattatcttgagtcccaccaggagcccttgataaatttggaggtgggacctacacatgagcttatcacatttttggttgattcaggagcggcctgttcctctgtttgtttcccctcatctaatgttgcctgctcttcagaagaacttatagtctctgagataaaaggggaaggatttacggtgagaatcttagaaaatacagaagtcaagtaccaagactaaacaacccaggttcaatttttgttaatccctgaagcagcaactagtttgttaggaagagacttaatgttaaagttaggcataggcctacaagtcagcccaaagggattccttacttcattaaacttactcaccacggcggatgagaaatacattcatcctgatgtttggtcaagggaagaaaactgaggaaagcttcgaattctcccaatccacatcaagctaaacaccccgcactgggaagtagtgaggaggaagcaattccccattcccttagagggcatgctagggctaaaacctataattgaaagtctcattaatgatgggcttcttgaaccctgtatgtctccttataacaccccaatactgcctgtcaaaaaatcagatgggtcataccggctggtgaaagacctcagagccattaaccaaacagtccagaccactaaccctgttgtccccaacccttacaccattctcagcaaaattccatataatcatcaatggtttactgtaatagatttaaaggatgctttttgggcatgtccctggctgaagagagccgagacacatttgcctttgagtgggaagatccccagttagggtgaaaacaatggtatcaatggacagtcttgcctcaggggttcatggattcacccaacctttttggtcaaattttagaacaagtgctagacaaagtttctgttccaaaacaattatgcctgcttcaatatgtcgatgatattctcatatctggtgaggatatagagaaagaagctggcttctctacacatatttttgaccatctacagttcgaggggttacgggtctcaaagggaaagcttcagtgtatggagcctaaagttaaatatttaggccgcttaataagtgcgggcaagcgaaggatagggcctgaatgggtcgaaggaatcgtgtccttacccttgcctcagactaaacaggaactcaggaaatttttagggttagttggatactgccgcttaaggattaactcacatgccctaaacagtaaacttttataccaaaaacttgcccagggaaaacctgagcatctcctgtggacttctaaagaggtcgatcaggtcaaagagctaaaaggaatagcttataactgctcttgccctagccttaccttccctagaaaatacacttcaccttttcgtcagcgtgaaaaatggggtggctttaggggtgcttatccaagagcacagaggctgctggcagcccatggccttcctgtcaaaaattttggacctggtcacctgtggatggcctcagtgcatccaatccattgcagctacagcagtattagttgaagagagtagaaaattaacctttgggtggagattaacagtaagcacaccccaccaagttagagagctattttaaataaaaaagcaggaaggtgactaactgactccagaatcttaaaatatggggctattctactaaaaaaagatgagagaacacctatgtctagatttaattgactaccaaacaaaactcaggccagatctaggaaagatccctttcaaaacaggacggcacttatttatagatggttcctcccagctgattgagggaaaaagacacaacgggtatccagtaatcgatggagaaattctctatgtataagaacagagtcaagaaaattgcctaataattggtctgcccaaacttgtgaactgtttgcactcagccaagccttaaagcacttgcaaaaccaggaaggaaccatctatactgattctaagtatgcctttggagtggctcatacatttggaaaaagttggactgaatgtggcctcactaatagtaaaggtcatgaccttgttcataaggagttaatcatccaagtactggataaccttcagttgccagaagaaatagctattgtccgtgtacccgggcaccagaaaagcctttcttttgaaagtcgaggaaataacctaacaaaccagatagccaaacaagctgctgtttcctccgaaacacctatgtttcacttaactccttgtcttccttcccctactgcaatttcctttttctcttccattgaaaaagaagaataaagataggagccaaaggagaagaccagaatgaaaacggctgttactagaccaaaaggaaatgttatccaagcccgttatgtggaagatctagtctcaactatatctgaggacacactggggatcccaagccatgtgcgatgcagttctcagggtctatggatgtataagaatttacaccctagccaaacaagttacagatagttgcttaatatgtaaaaagactagtaagcagattctaagaaaaccgccccttggagaaagagattcagggctaagaccatttccaagtgttcaattaattatactgaaatgcccccaattggtcatttaaaatacttattagtaataatagaccactttacctactgggtagagactatcccacactcaaatgcaaccaccagtaacgtagttaaggcattaattgaaaacattgtacccagatttggactaatacaaagcactgattcagacaatggaacccatttcactgcatatgtcattaaaaagttagcccaggtactagacataaaatggaaaaaccatatcccttggcatctctcctcctcaagaagagtagaaaggatgaatcagactctaaaaagccacttaactaaattagttctagaaacttgattgccatggactaaatgtcttcctattgccttgttaagaatccgaactgctcctcagagagatactggcctttccccttatgagatgctctatggattgccctatttatactccactgctaacattcctacattcaaaataaaagatcagttcctcaaaaattatatacttggtccatactctactttctcttcccttaagactaaaggtctcctagcacaggcgccaccgctggagtttccagcacattagcgtcagcctggagaccatgtcctcataaaagggtggaaggaaggcaaactcaaaccagcttgggaaggaccctacttggtgctcctaaatactaagactgcagtccgaacagcagaatgaggatggactgatcacacccgcgtcaaaaaggcgctgccacctccaggatcataaaccgtcactccagggctcaccccaaccaaattaactctaaaaagggcttaataatcacttgtttattttttcttttctttccaacagaaggtcatcttgtcatcaatgtaacttgggctaaccatcctttaatccttcagtttgatgcttgttcagtcatcctgtgtggagacaagcaagctcaaaggaagctgtctcatgtagataagtacctatgtccataccataaaaagtcaaccaagtataagtatagaaccttaaaaagtccctgtggtgactggacagatgtttggaaaccactcagtatggagggtggacagccaggccccctttttcaaataagttatggggactaaaacagaaactccaactaattcatggtcccaccccaccaaactgtaagccactgcagtgtaacccctcattgctaattatagctaacccccaaacaatggcccaagaacccactatattcaaacagtatggattaggagcaaatgttacaaaacaaaatcccataaaaatcttcaaccactggttaacaatgataattaaaaaaaaatccacacccagagtctgggaaacgagtggaatctaacactctctccaagtatagcgagctcagcgtcctcctcccatctccaaaacaacccaactaaagtaacggttgtaaaggtaaaaaatttaaagcagactatagccctagagacaggatgtcaagatgcaaatgcttggctaaaatggattaaatattccatctgcactttaaacaaatatgaatgttatgcttgtgctcacggtagaccagaggcccagattgtcccctttccactcagatggtcttctaactgaccgggcataagctgtatggtagttctcttccaagatcacacagcctggggtgacaaatcatgtcaagctctttctctgctgttccctgaagctcaacaccctgagggtcagcccccgagggccatcagcttccgtttcccaatgccaattttactttgtgtctctcacaacagggagaaaacttggtgttccttggagccttaatgggatgcagtgagcttaagtccttccaagagcttacccatcagtctgcccttagtcatcctcgagcggatgtatggtggtattgtggtggaccattactggacactgccgagtaactggagcagaacatgcactctaattccattggctatccctttcaccctggcatttcatcaaccagaaaagacagaaaccaaacactgtaaaacaagagaggcccctcatgggtctgttgactcccacatttatatagattccactggagtccaacgaggagtgccagatgaatttaaggcccaaaatcagacaactgcaggatttgaatccacgttcttctgtgacctgggagctgtcatttccctcctgctctggggacgacagctttttgcactgtactcaggcaatgatgtcacggatatttcagatgaccgcttcccgaagccccctgagattgcaaatggctatgtggagcacttgtttcgctaccagtgtaagaactactacagactgcgcacagaaggagatggagtatacaccttaaatgataagaagcagtggataaataaggctgttggagataaacttcctgaatgtgaagcagtatgtgggaagcccaagaatccggcaaacccagtgcagcggatcctgggaggacacctggtacgcggctgggatcctaagctttga

SEQ ID NO: 11150 - DNA, 1188 bp, synthetic construct
  misc_feature 1..1188: note = Synthetic polypeptide
  source 1..1188: mol_type = other DNA
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtggcccagctgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaa

SEQ ID NO: 11151 - DNA, 636 bp, synthetic construct
  misc_feature 1..636: note = Synthetic polypeptide
  source 1..636: mol_type = other DNA
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtggcccagctgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctga

SEQ ID NO: 11152 - DNA, 452 bp, synthetic construct
  misc_feature 1..452: note = Synthetic polypeptide
  source 1..452: mol_type = other DNA
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtggcccagctgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaa

SEQ ID NO: 11153 - DNA, 729 bp, synthetic construct
  misc_feature 1..729: note = Synthetic polypeptide
  source 1..729: mol_type = other DNA
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtggcccagctgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaagatctttgataccatactttaatctgtatcttcagtttctgaacataagtatgcaaaatctttttaaggtgcatactctgctgcgtccctgctattttctaggacaaaaataa

SEQ ID NO: 11154 - DNA, 1224 bp, synthetic construct
  misc_feature 1..1224: note = Synthetic polypeptide
  source 1..1224: mol_type = other DNA
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtggcccagctgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggctggtagcaagttctggatcttatacccaacacacagcaacatccagaaataa

SEQ ID NO: 11155 - DNA, 1143 bp, synthetic construct
  misc_feature 1..1143: note = Synthetic polypeptide
  source 1..1143: mol_type = other DNA
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtggcccagctgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatgaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaa

SEQ ID NO: 11156 - DNA, 906 bp, synthetic construct
  misc_feature 1..906: note = Synthetic polypeptide
  source 1..906: mol_type = other DNA
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtggcccagctgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggtctgggagaactgatcttgctgaaaatacaacaggaagcagtatcgtgccaggcaaggcaaaccctcgtcagtgtgaagcaatggccatcgttgcagcccaagtcatggggttttgtgtggcagtaa

SEQ ID NO: 11157 - DNA, 822 bp, synthetic construct
  misc_feature 1..822: note = Synthetic polypeptide
  source 1..822: mol_type = other DNA
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtggcccagctgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggctgctgggggatgcttcagtttccttcacagaaaactaaatag

SEQ ID NO: 11158 - DNA, 885 bp, synthetic construct
  misc_feature 1..885: note = Synthetic polypeptide
  source 1..885: mol_type = other DNA
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtggcccagctgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggtctgggagaactgatcttgctgaaaatacaacaggaagcagtatcgtgccaggcaaggcaaaccctcgtcagtgtgaagcaatggccatcgttgcagcccaagtcatggggttttgtgtggcagtaaccgttggaggcggcaatggccattttgagttggatgttttcaagccaatgatgattaaaaatttatgttacactcaggctgctgggggatgcttcagtttccttcacagaaaactaaatagtgggaatccggaccaataa

SEQ ID NO: 11159 - DNA, 153 bp, synthetic construct
  misc_feature 1..153: note = Synthetic polypeptide
  source 1..153: mol_type = other DNA
taggcacatcctcaccctcggagcctccttctcctcacctgcaagacagaggtgacagggctcacctctcaaggctgctgagcgggctggacgctactgcttagatgcaacctccttgcaaactgtagagtgctctgagaaggtccgctgcca

SEQ ID NO: 11160 - DNA, 1608 bp, synthetic construct
  misc_feature 1..1608: note = Synthetic polypeptide
  source 1..1608: mol_type = other DNA
taggcacatcctcaccctcggagcctccttctcctcacctgcaagacagaggtgacagggctcacctctcaaggctgctgagcgggctggacgctactgcttagatgcaacctccttgcaaactgtagagtgctctgagaaggtccgctgccagccccaagccccccaccagccatgagctcctccagaaaggaccacctcggcgccagcagctcagagcccctcccggtcatcattgtgggtaacggcccctctggtatctgcctgtcctacctgctctccggctacacaccctacacgaagccagatgccatccacccacaccccctgctgcagaggaagctcaccgaggccccgggggtctccatcctggaccaggacctggactacctgtccgaaggcctcgaaggccgatcccaaagccccgtggccctgctctttgatgcccttctacgcccagacacagactttgggggaaacatgaagtcggtcctcacctggaagcaccggaaggagcacgccatcccccacgtggttctgggccggaacctccccgggggagcctggcactccatcgaaggctccatggtgatcctgagccaaggccagtggatggggctcccggacctggaggtcaaggactggatgcagaagaagcgaagaggtcttcgcaacagccgggccactgccggggacatcgcccactactacagggactacgtggtcaagaagggtctggggcataactttgtgtccggtgctgtagtcacagccgtggagtgggggacccccgatcccagcagctgtggggcccaggactccagccccctcttccaggtgagcggcttcctgaccaggaaccaggcccagcagcccttctcgctgtgggcccgcaacgtggtcctcgccacaggcacgttcgacagcccggcccggctgggcatccccggggaggccctgcccttcatccaccatgagctgtctgccctggaggccgccacaagggtgggtgcggtgaccccggcctcagaccctgtcctcatcattggcgcggggctgtcagcggccgacgcggtcctctacgcccgccactacaacatcccggtgatccatgccttccgccgggccgtggacgaccctggcctggtgttcaaccagctgcccaagatgctgtaccccgagtaccacaaggtgcaccagatgatgcgggagcagtccatcctgtcgcccagcccctatgagggttaccgcagcctccccaggcaccagctgctgtgcttcaaggaagactgccaggccgtgttccaggacctcgagggtgtcgagaaggtgtttggggtctccctggtgctggtcctcatcggctcccaccccgacctctccttcctgcctggggcaggggctgactttgcagtggatcctgaccagccgctgagcgccaagaggaaccccattgacgtggaccccttcacctaccagagcacccgccaggagggcctgtacgccatggggccgctggccggggacaacttcgtgaggtttgtgcaggggggcgccttggctgtggccagctccctgctaaggaaggagaccaggaagccaccctaa

SEQ ID NO: 11161 - DNA, 1025 bp, synthetic construct; identical to SEQ ID NO: 7599
  misc_feature 1..1025: note = Synthetic polypeptide
  source 1..1025: mol_type = other DNA

SEQ ID NO: 11162 - DNA, 871 bp, synthetic construct; identical to SEQ ID NO: 437
  misc_feature 1..871: note = Synthetic polypeptide
  source 1..871: mol_type = other DNA

SEQ ID NO: 11163 - DNA, 421 bp, synthetic construct; identical to SEQ ID NO: 441
  misc_feature 1..421: note = Synthetic polypeptide
  source 1..421: mol_type = other DNA

SEQ ID NO: 11164 - DNA, 638 bp, synthetic construct; identical to SEQ ID NO: 442
  misc_feature 1..638: note = Synthetic polypeptide
  source 1..638: mol_type = other DNA

SEQ ID NO: 11165 - DNA, 337 bp, synthetic construct; identical to SEQ ID NO: 443
  misc_feature 1..337: note = Synthetic polypeptide
  source 1..337: mol_type = other DNA

SEQ ID NO: 11166 - DNA, 261 bp, synthetic construct
  misc_feature 1..261: note = Synthetic polypeptide
  source 1..261: mol_type = other DNA
ggccaggcgcagtggctcacacctgttatcccagcagtttggaaggctgaggcaggaggattgcttgagctcaggagttggagaccagccagggcaacacagtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaa

SEQ ID NO: 11167 - DNA, 527 bp, synthetic construct; identical to SEQ ID NO: 7665
  misc_feature 1..527: note = Synthetic polypeptide
  source 1..527: mol_type = other DNA

SEQ ID NO: 11168 - DNA, 939 bp, synthetic construct
  misc_feature 1..939: note = Synthetic polypeptide
  source 1..939: mol_type = other DNA
tgtagtggatccttatagatttatgttgcctcggcatccatgttgaatacaagtttaactctctcataccagcggcagggctcggtcacgctggacacagtttccagatctacaccacaccgagatggctcaagccaagtggccagagctatgccctttgccttctgtacgagagagaagcttccttggacagaatttgctgagtcagcagaggatgggcccaccaccagattctgtcagaagctggcgaagaaccatgacatggtggtggtgtctcccatcctggaacgagacagcgagcatggggatgttttgtggaatacagccgtggtgatctccaattccggagcagtcctgggaaagaccaggaaaaaccacatccccagagtgggtgatttcaacgagtcaacttactacatggagggaaacctgggccaccccgtgttccagacgcagttcggaaggatcgcggtgaacatttgctacgggcggcaccaccccctcaactggcttatgtacagcatcaacggggctgagatcatcttcaacccctcggccacgataggagcactcagcgagtccctgtggcccatcgaggccagaaacgcagccattgccaatcactgcttcacctgcgccatcaatcgagtgggcaccgagcacttcccgaacgagtttacctcgggagatggaaagaaagctcaccaggactttggctacttttatggctcgagctatgtggcagcccctgacagcagccggactcctgggctgtcccgtagccgggatggactgctagttgctaagctcgacctaaacctctgccagcaggtgaatgatgtctggaacttcaagatgacgggcaggtatgagatgtacgcacgggagctcgccgaagctgtcaagtccaactacagccccaccatcgtgaaagagtag

SEQ ID NO: 11169 - DNA, 935 bp, synthetic construct; identical to SEQ ID NO: 10282
  misc_feature 1..935: note = Synthetic polypeptide
  source 1..935: mol_type = other DNA

SEQ ID NO: 11170 - DNA, 383 bp, synthetic construct; identical to SEQ ID NO: 10283
  misc_feature 1..383: note = Synthetic polypeptide
  source 1..383: mol_type = other DNA

SEQ ID NO: 11171 - DNA, 199 bp, synthetic construct; identical to SEQ ID NO: 10284
  misc_feature 1..199: note = Synthetic polypeptide
  source 1..199: mol_type = other DNA

SEQ ID NO: 11172 - DNA, 476 bp, synthetic construct; identical to SEQ ID NO: 10285
  misc_feature 1..476: note = Synthetic polypeptide
  source 1..476: mol_type = other DNA

SEQ ID NO: 11173 - DNA, 971 bp, synthetic construct; identical to SEQ ID NO: 10286
  misc_feature 1..971: note = Synthetic polypeptide
  source 1..971: mol_type = other DNA

SEQ ID NO: 11174 - DNA, 890 bp, synthetic construct; identical to SEQ ID NO: 10287
  misc_feature 1..890: note = Synthetic polypeptide
  source 1..890: mol_type = other DNA

SEQ ID NO: 11175 - DNA, 653 bp, synthetic construct; identical to SEQ ID NO: 10288
  misc_feature 1..653: note = Synthetic polypeptide
  source 1..653: mol_type = other DNA

SEQ ID NO: 11176 - DNA, 569 bp, synthetic construct; identical to SEQ ID NO: 10289
  misc_feature 1..569: note = Synthetic polypeptide
  source 1..569: mol_type = other DNA

SEQ ID NO: 11177 - DNA, 632 bp, synthetic construct; identical to SEQ ID NO: 10290
  misc_feature 1..632: note = Synthetic polypeptide
  source 1..632: mol_type = other DNA

SEQ ID NO: 11178 - DNA, 3609 bp, synthetic construct
  misc_feature 1..3609: note = Synthetic polypeptide
  source 1..3609: mol_type = other DNA
tgatcttcagactggagctttctgggagtccagcagaaatttccagggttacgatgcaggcagtttctgtatctttagcttttagatgcattctttcctaaaatcgatttgctggagaaagtatgggtattctacctacaggttttccttcactgttgcccttttcaggaacaagacttatctctcacctagcctaagttaagggaagaaagtcggaggctggctttggctgcgaaaagagaaaaaagaaaagagaagagaaggaagaaaaaggaagaacaaagaaggaaactagaagaaattgaagccaaaaataaagagaactttgaactccaagctgctcaagaaaaagaaaagcttaaagttgaagatgagcctgaagtcttgacagaacctccaagtgccacaaccactactaccataggtatatctgcaacctggacaactttggcaggttctcatggtaaaagaaataataccataactacaaccagttcaaagaggaaaaacaggaaaaataaaattactccagaaaacgttcaaattatatttgatgatccactaccaatttcatacagtcagccagagaaggtgaatggagagtccaagagcagcagtaccagcgagagtggggacagtgataacatgaggatttccagctgcagcgatgaaagtagtaacagcaacagcagtcgtaagagtgacaatcattcaccagctgtggtcactaccactgtgagcagcaaaaagcagccatcagttcttgttacatttccaaaggaagagagaaaatctgtttctggcaaggcttcaataaaattgtcagaaactatcagtgaagggaccagtaattctctatctacttgtacaaaatctggtccatctcccctttcttctccaaatgggaagttaacagtagcaagtcctaagcgtgggcaaaagagggaagaaggatggaaagaagttgtaagaaggtcaaagaaagtatctgttccatcaactgtgatatccagagtgattggaagaggaggctgtaatatcaatgctattcgggagtttactggtgcacacatagatattgataaacagaaagacaagactggagaccggataatcactataaggggtggcactgaatcaacaagacaagcaactcaattgattaatgctttgatcaaggatccagacaaagaaattgatgaacttattccaaagaatcgtttgaaaagctcctcagcaaattccaaaatagggtcatcagcacctaccaccactgctgctaacacttccttaatgggaattaaaatgacaactgtagctctgtcatcaacatctcaaactgccacagcactcactgtgcctgcaatttcttctgcatccactcacaaaaccattaagaacccagtgaataatgtgaggcctggttttccagtttctcttccattagcatatcctcctccacagtttgcacatgctttgcttgctgctcagactttccagcagatccgtccaccaaggttgcccatgacccactttggaggtacttttccaccagctcaatccacttggggtccgtttcctgtcaggcctttgagccctgccagagctactaactcgcctaagcctcacatggtgcctcgccatagcaatcagaatagcagtggttctcaggtgaattcagcaggttctttaacttcaagcccaacaactacaaccagttcatcagcttcaacggtgcctggtacatctacaaatggcagtccaagttcaccttctgtccgaaggcagctttttgtcacagttgtgaagacatccaatgccaccacaacaacagtcacaaccacggcaagcaacaacaacactgcacccacaaatgccacatatcctatgcctactgccaaagaacactatccagtatcatccccatcttccccatcaccaccagcccagccaggaggggtttctagaaacagccctttggattgtggatcagcatctccaaataaagtggcatcttcctccgaacaggaagcaggtagtccaccagtagtagaaacaacaaacactagacctccaaacagcagcagttcttctgggagttcatcagctcattctaatcagcaacaacctccgggatctgtttctcaggaaccaagaccacctcttcagcagtctcaggttcctcccccggaagttagaatgactgttcctcctttagcaacaagttctgctccagtggcggtgccttctactgccccagtgacttaccctatgcctcagacaccaatgggatgcccccagcctactcctaaaatggaaacccctgctattagaccaccccctcatggcacaactgcccctcacaagaattcagcttcagtgcaaaattcatctgttgcagtcctcagtgtcaatcacattaaaagacctcacagtgttccctcttctgtccagctaccttcgaccttaagtacacaaagtgcttgtcagaattcagtacatccagcaaataagcctattgctcccaatttcagtgcccccttaccatttgggccctttagcacattgtttgaaaacagccctacttctgctcatgccttctggggaggatctgttgtttcatctcagtcaacaccagaatctatgctatcaggaaaatcctcatatttgccaaattcagatcctttacatcagtctgatacttccaaagctccaggttttagaccaccattacagagacctgctccaagtccctcaggtattgtcaatatggactcgccatatggttctgtaacaccttcttcaacacatttgggaaactttgcttcaaacatttcaggaggtcagatgtacggacctggggcaccccttggaggagcacccgcagctgctaactttaacagacaacatttttccccgcttagtttgttgactccgtgttcatcagcatcaaatgattcttctgcacagtcagtatcctcgggagttcgtgcaccatctcctgccccatcatcagtaccgttagggtcagaaaagcccagcaatgtgtctcaggacaggaaagttccagtccctattgggactgaacgttctgcacgtatcaggcaaactggaacgtcagctccatctgttattgggagcaatttgtctacatcagtaggacatagtggcatctggtcctttgaagggattggtggcaatcaagacaaagtagactggtgtaaccctgggatgggaaatcctatgatccacagaccgatgtctgacccaggagtattttcacaacatcaagcaatggagcgagatagtacaggaattgtaactccttctggtacattccatcagcatgttcctgcaggctacatggactttcctaaagttgggggtatgcctttttctgtgtatgggaatgcaatgattcctccagtagcacctatccctgatggtgctggaggacccatatttaatggccctcatgctgcagacccttcttggaactcactgataaagatggtttccagctccacggaaaataatggccctcaaacggtgtggactggaccctgggcacctcacatgaacagtgtgcatatgaaccagcttggctga

SEQ ID NO: 11179 - DNA, 283 bp, synthetic construct
  misc_feature 1..283: note = Synthetic polypeptide
  source 1..283: mol_type = other DNA
tgatcttcagactggagctttctgggagtccagcagaaatttccagggttacgatgcaggcagtttctgtatctttagcttttagatgcattctttcctaaaatcgatttgctggagaaagtatgggtattctacctacaggttttccttcactgttgcccttttcaggaacaagacttatctctcacctagcctaagttaagggaagaaagtcggaggctggctttggctgcgaaaagagaaaaaagaaaagagaagagaaggaagaaaaaggaagaacaaa

SEQ ID NO: 11180 - DNA, 523 bp, synthetic construct
  misc_feature 1..523: note = Synthetic polypeptide
  source 1..523: mol_type = other DNA
agtatggtgatttctcaaaaaactaaacagaactaccatatgatccagcaatcccactactgggtatttatccaaaggaaaagaaatcagcatatcaaaaagatgtctacactcccatgttaattgcagcactattcacaatacgaagatatgggatcaacctaagtatccaatggatgaaaggataaataatatgtggtatatatacacaatggaatactatttggcattaaaaaagagtgaaatcatgtcatctgcagcaacatggagagaactggaggtcattatgttaactgaagtggtgaaggcatttgtgatcctggcctcgcagttcctatcccatgacccagaacagctcaccaaggagctgcagcagcatgtgaagtcagtgacagccccatacaagtacccaagaaagatagagtttgtcttgaacctgcccaagactgtcacagggaaaattcaacgaaccaaacttcgagacaaggagtggaagatgtccggaaaagcccgtgcgcagtga

SEQ ID NO: 11181 - DNA, 1426 bp, synthetic construct
  misc_feature 1..1426: note = Synthetic polypeptide
  source 1..1426: mol_type = other DNA
tgatacagaaagcgggaagggaagtgctggctagaggaggacgtggtccctggctacggctccaccgcctcggacctaggtgaggacaggcatttttgttttcctgcccaaaagttgcatttcccaagaccaccctggcctgccatgcccccatcctgtgcctataaaaaccccaaatcctaacaaggcagagacagaaccgggtggactttgagaggatcacatcggcagaggaatacacaggtggctagacatctagagaaatgcaccgaaaggcaccagtacgccagcgggccacctactggcagaagcagaatgacgctgagtttggctggggcagtcagaagacagtccaggctgctgagcagccggactctaggggaaaacgttcctactccatccccttctgacttccccccaagctacctccactcaatgaaaccctgcactcattcaccaagcccaggtgtgatccgatccttccggtaaaccaaagcaagaactcaggatacagaaagccctctgtccttgccataaggttccgaggaacagagctgtagaggtcaccaaattagcaatagaagctggcttccgccatattgattctgcttatttatacaataatgaggagcaggttggactggccatccgaagcaagattgcagatggcagtgtgaagagagaagacatattctacacttcaaagctttggtgcactttctttcaaccacagatggtccaaccagccttggaaagctcactgaaaaaacttcaactggactatgttgacctctatcttcttcatttcccaatggctctcaagccaggtgagacgccactaccaaaagatgaaaatggaaaagtaatattcgacacagtggatctctctgccacatgggaggtcatggagaagtgtaaggatgcaggattggccaagtccatcggggtgtcaaacttcaactgcaggcagctggagatgatcctcaacaagccaggactcaagtacaagcctgtctgcaaccaggtagaatgtcatccttacctcaaccagagcaaactgctggatttctgcaagtcaaaagacattgttctggttgcccacagtgctctgggaacccaacgacataaactatgggtggacccaaactccccagttcttttggaggacccagttctttgtgccttagcaaagaaacacaaacaaaccccagccctgattgccctgcgctaccagctgcagcgtggggttgtggtcctggccaagagctacaatgagcagcggatcagagagaacatccaggtttttgaattccagttgacatcagaggatatgaaagttctagatggtctaaacagaaattatcgatatgttgtcatggattttcttatggaccatcctgattatccattttcagatgaatattag

SEQ ID NO: 11182 - DNA, 2751 bp, synthetic construct
  misc_feature 1..2751: note = Synthetic polypeptide
  source 1..2751: mol_type = other DNA
gcatgggctctggtgtcaggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccatcaactggaccctcattcacggagataagaaaggggggttttccatcttctgggcggatgatggtctggacaccggagacctgctgctgcagaaggagtgtgaggtgctcccggacgacaccgtgagcacgctgtacaaccgcttcctcttccctgaaggcatcaaagggatggtgcaggccgtgaggctgatcgctgagggcaaagcccccagactccctcagcctgaggaaggagccacctatgaggggattcagaagaaggagacagccaagatcaactgggaccagccggcagaggccattcacaactggatccgcgggaacgacaaggtgccgggagcctggacagaggcctgtgaacagaaactgacatttttcaactcaacgctgaacacttcaggcctggtgcccgagggagacgctttgcccatcccaggagcccatcggccaggggtggtcaccaaagcaggactcatcctctttgggaatgatgacaaaatgctgctggtgaagaatattcagctggaggatggcaaaatgatcctggcctcgaacttctttaagggggcagccagcagtgtccttgagctgacagaggcagagctggttactgcggaggctgtgcggagtgtttggcagcggatcctccccaaagtcctggaggttgaagactccactgatttcttcaagtcaggggccgcgtctgtggacgttgtgaggctggtggaggaagtgaaggagctgtgtgatggcctggagttagaaaatgaagatgtgtacatggcatccacctttggggacttcatccagctgttagtgaggaagctgcgaggggacgatgaggagggcgagtgcagcattgactacgtggaaatggcagtgaacaagcgcactgtccgcatgccccaccagctcttcattgggggggagttcgtggatgccgagggcgccaagacctctgagaccatcaatcccaccgatggaagtgtcatctgccaggtatccctggcccaagtcaccgacgtcgacaaggcagtggccgcagccaaggatgcctttgagaatggacggtgggggaagatcagtgcgcgggaccggggccggctgatgtacaggttggcagatctcatggagcagcaccaggaggagctggccaccattgaggccctggatgcgggtgccgtctacacgctggccctgaagacccacgtgggcatgtccatccagaccttccgctactttgctggctggtgtgacaagatccagggctccaccatccccatcaaccaggccagacccaaccgcaacctgaccttgaccaggaaggagcctgttggggtttgtggcatcatcatcccctggaactatcccctgatgatgctgtcctggaagacagctgcctgcctggctgccgggaacacagtggtgatcaagcctgctcaggtgaccccactcacagccttgaagtttgcagagctgacattaaaggccggcattcccaaaggtgtggttaacgtcctcccaggatctggctccctggtcggccagagactctcagaccatcctgatgtgaggaaaatcgggttcacaggctccacagaggtgggcaagcacatcatgaaaagctgtgccataagtaacgtgaagaaggtgtccctggaactgggcgggaagtcacccctcatcatctttgctgactgtgacctcaacaaggctgtgcagatggggatgagttctgttttcttcaacaaaggagagaattgcattgcagcaggccgactctttgtggaggactccattcatgatgagttcgtgcggagagtggtagaagaggtgcggaagatgaaggtgggcaacccgctggacagggacaccgaccacgggccgcagaatcaccatgcccaccttgtgaagctgatggagtactgccagcatggcgtgaaggaaggggccacactggtctgcggcgggaatcaggtccctcggccagggttcttctttgagccaactgttttcacagacgtggaagaccacatgttcatagccaaggaggagtccttcgggcctgtcatgatcatctctcggtttgctgatggggacttggatgccgtgctgtctcgggccaatgccacggaatttggcctggcttctggtgtcttcaccagggacatcaacaaggccctgtatgtcagtgacaagctccaggcaggcactgtgtttgtcaacacgtacaacaagaccgacgtggccgctcccttcggaggattcaaacagtctggatttggcaaagatctaggagaggcggctctgaacgagtacctgcgggtcaagacagtgaccttcgaatactga

SEQ ID NO: 11183 - DNA, 294 bp, synthetic construct; identical to SEQ ID NO: 6413
  misc_feature 1..294: note = Synthetic polypeptide
  source 1..294: mol_type = other DNA

SEQ ID NO: 11184 - DNA, 462 bp, synthetic construct; identical to SEQ ID NO: 6414
  misc_feature 1..462: note = Synthetic polypeptide
  source 1..462: mol_type = other DNA

SEQ ID NO: 11185 - DNA, 522 bp, synthetic construct; identical to SEQ ID NO: 6415
  misc_feature 1..522: note = Synthetic polypeptide
  source 1..522: mol_type = other DNA

SEQ ID NO: 11186 - DNA, 414 bp, synthetic construct; identical to SEQ ID NO: 6416
  misc_feature 1..414: note = Synthetic polypeptide
  source 1..414: mol_type = other DNA

SEQ ID NO: 11187 - DNA, 405 bp, synthetic construct; identical to SEQ ID NO: 6417
  misc_feature 1..405: note = Synthetic polypeptide
  source 1..405: mol_type = other DNA

SEQ ID NO: 11188 - DNA, 61 bp, synthetic construct
  misc_feature 1..61: note = Synthetic polypeptide
  source 1..61: mol_type = other DNA
tctcttaattatctcacaaagccagaccagagttggagccacccaggggaatgatctctga

SEQ ID NO: 11189 - DNA, 186 bp, synthetic construct; identical to SEQ ID NO: 7638
  misc_feature 1..186: note = Synthetic polypeptide
  source 1..186: mol_type = other DNA

SEQ ID NO: 11190 - DNA, 1354 bp, synthetic construct
  misc_feature 1..1354: note = Synthetic polypeptide
  source 1..1354: mol_type = other DNA
tgatacagaaagcgggaagggaagtgctggctagaggaggacgtggtccctggctacggctccaccgcctcggacctaggtgaggacaggcatttttgttttcctgcccaaaagttgcatttcccaagaccaccctggcctgccatgcccccatcctgtgcctataaaaaccccaaatcctaacaaggcagagacagaaccgggtggactttgagaggatcacatcggcagaggaatacacaggtggctagacatctagagaaatgcaccgaaaggcaccagtacgccagcgggccacctactggcagaagcagaatgacgctgagtttggctggggcagtcagaagacagtccaggctgctgagcagccggactctaggggaaaacgttcctactccatccccttctgacttccccccaagctacctccactcaatgaaaccctgcactcattcaccaagcccaggttccgaggaacagagctgtagaggtcaccaaattagcaatagaagctggcttccgccatattgattctgcttatttatacaataatgaggagcaggttggactggccatccgaagcaagattgcagatggcagtgtgaagagagaagacatattctacacttcaaagctttggtgcactttctttcaaccacagatggtccaaccagccttggaaagctcactgaaaaaacttcaactggactatgttgacctctatcttcttcatttcccaatggctctcaagccaggtgagacgccactaccaaaagatgaaaatggaaaagtaatattcgacacagtggatctctctgccacatgggaggtcatggagaagtgtaaggatgcaggattggccaagtccatcggggtgtcaaacttcaactgcaggcagctggagatgatcctcaacaagccaggactcaagtacaagcctgtctgcaaccaggtagaatgtcatccttacctcaaccagagcaaactgctggatttctgcaagtcaaaagacattgttctggttgcccacagtgctctgggaacccaacgacataaactatgggtggacccaaactccccagttcttttggaggacccagttctttgtgccttagcaaagaaacacaaacaaaccccagccctgattgccctgcgctaccagctgcagcgtggggttgtggtcctggccaagagctacaatgagcagcggatcagagagaacatccaggtttttgaattccagttgacatcagaggatatgaaagttctagatggtctaaacagaaattatcgatatgttgtcatggattttcttatggaccatcctgattatccattttcagatgaatattag

SEQ ID NO: 11191 - DNA, 372 bp, synthetic construct
  misc_feature 1..372: note = Synthetic polypeptide
  source 1..372: mol_type = other DNA
gagctcaagagcacggacatgaagtaccggaaccgcgtgcgcagccgcataagcaacctcaaggaccccaggaaccccggcctgcggcggaacgtgctcagtggggccatctccgcagggcttatagccaagatgacggcagaggaaatggccagtgatgaactgagggagttgaggaatgccatgacccaggaggccatccgtgagcaccagatggccaagactggcggcaccaccactgacctcttccagtgcagcaaatgcaagaagaagaactgcacctataaccaggtgcagacacgcagtgctgatgagcccatgactacctttgtcttatgcaatgaatgtggcaatcgctggaagttctgctga

SEQ ID NO: 11192 - DNA, 270 bp, synthetic construct
  misc_feature 1..270: note = Synthetic polypeptide
  source 1..270: mol_type = other DNA
agcgggctgtgtctggctgtccctgataaaactgtgagatggtgtgcagtgtcggagcatgaggccactaagtgccagagtttccgcgaccatatgaaaagcgtcattccatccgatggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaa

SEQ ID NO: 11193 - DNA, 2058 bp, synthetic construct
  misc_feature 1..2058: note = Synthetic polypeptide
  source 1..2058: mol_type = other DNA
agcgggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgtctgaaggatggtgctggggatgtggcctttgtcaagcactcgactatatttgagaacttggcaaacaaggctgacagggaccagtatgagctgctttgcctggacaacacccggaagccggtagatgaatacaaggactgccacttggcccaggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaaggactctgcccacgggtttttaaaagtcccccccaggatggatgccaagatgtacctgggctatgagtatgtcactgccatccggaatctacgggaaggcacatgcccagaagccccaacagatgaatgcaagcctgtgaagtggtgtgcgctgagccaccacgagaggctcaagtgtgatgagtggagtgttaacagtgtagggaaaatagagtgtgtatcagcagagaccaccgaagactgcatcgccaagatcatgaatggagaagctgatgccatgagcttggatggagggtttgtctacatagcgggcaagtgtggtctggtgcctgtcttggcagaaaactacaataagagcgataattgtgaggatacaccagaggcagggtattttgctatagcagtggtgaagaaatcagcttctgacctcacctgggacaatctgaaaggcaagaagtcctgccatacggcagttggcagaaccgctggctggaacatccccatgggcctgctctacaataagatcaaccactgcagatttgatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaa

SEQ ID NO: 11194 - DNA, 324 bp, synthetic construct
  misc_feature 1..324: note = Synthetic polypeptide
  source 1..324: mol_type = other DNA
agcgggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggactttctattatgctgttgctgtggtgaagaaggatag

SEQ ID NO: 11195 - DNA, 309 bp, synthetic construct
  misc_feature 1..309: note = Synthetic polypeptide
  source 1..309: mol_type = other DNA
agcgggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggtaagtcgctgctgcctaaaagagagtggaagaaagccatactttctctgtttccagtcactttggaacaattctttactcacaggcaaacgaagcggatgctgtgacactggatgcaggtttggtgtatga

SEQ ID NO: 11196 - DNA, 80 bp, synthetic construct; identical to SEQ ID NO: 6364
  misc_feature 1..80: note = Synthetic polypeptide
  source 1..80: mol_type = other DNA

SEQ ID NO: 11197 - DNA, 217 bp, synthetic construct; identical to SEQ ID NO: 6365
  misc_feature 1..217: note = Synthetic polypeptide
  source 1..217: mol_type = other DNA

SEQ ID NO: 11198 - DNA, 201 bp, synthetic construct; identical to SEQ ID NO: 6463
  misc_feature 1..201: note = Synthetic polypeptide
  source 1..201: mol_type = other DNA

SEQ ID NO: 11199 - DNA, 159 bp, synthetic construct; identical to SEQ ID NO: 6464
  misc_feature 1..159: note = Synthetic polypeptide
  source 1..159: mol_type = other DNA

SEQ ID NO: 11200 - DNA, 953 bp, synthetic construct
  misc_feature 1..953: note = Synthetic polypeptide
  source 1..953: mol_type = other DNA
gcttcagtctcagctccaccacttaatatcatgtgtcctggggcaatttacttcacatcccatgcctctgtttcctcatctgtaaaatggggataataatagcacttatgtcctagtgttgttattaggactaaatacggtgaaatatatggaaaccactttgaagagagctgggcacatggaatgagtttgaaaaaatctgcagaaaggaggtgaaaccattaggattaacagtaatgagagatgtgaccatttcgaaatccgaatatgctccaagtgagaagatgatcacgaaggtccaggatttccaggaagataaggagctcttcagatactgcactctccccgagattctgaaatatgtggagtgcttcactggacctaatattatggccatgcacacaatgttgataaacaaacctccagattctggcaagaagacgtcccgtcaccccctgcaccaggacctgcactatttccccttcaggcccagcgatctcatcgtttgcgcctggacggcgatggagcacatcagccggaacaacggctgtctggttgtgctcccaggcacacacaagggctccctgaagccccacgattaccccaagtgggaggggggagttaacaaaatgttccacgggatccaggactacgaggaaaacaaggcccgggtgcacctggtgatggagaagggcgacactgttttcttccatcctttgctcatccacggatctggtcagaataaaacccagggattccggaaggcaatttcctgccatttcgccagtgccgattgccactacattgacgtgaagggcaccagtcaagaaaacatcgagaaggaagttgtaggaatagcacataaattctttggagctgaaaatagcgtgaacttgaaggatatttggatgtttcgagctcgacttgtgaaaggagaaagaaccaatctttga

SEQ ID NO: 11201 - DNA, 959 bp, synthetic construct
  misc_feature 1..959: note = Synthetic polypeptide
  source 1..959: mol_type = other DNA
gcttcagtctcagctccaccacttaatatcatgtgtcctggggcaatttacttcacatcccatgcctctgtttcctcatctgtaaaatggggataataatagcacttatgtcctagtgttgttattaggactaaatacggtgaaatatatggaaaccactttgaagagagctgggcacatggaatgagtttgaaaaaatctgcagaaaggaggtgaaaccattaggattaacagtaatgagagatgtgaccatttcgaaatccgaatatgctccaagtgagaagatgatcacgaaggtccaggatttccaggaagataaggagctcttcagatactgcactctccccgagattctgaaatatgtggagtgcttcactggacctaatattatggccatgcacacaatgttgataaacaaacctccagattctggtaattgcaagaagacgtcccgtcaccccctgcaccaggacctgcactatttccccttcaggcccagcgatctcatcgtttgcgcctggacggcgatggagcacatcagccggaacaacggctgtctggttgtgctcccaggcacacacaagggctccctgaagccccacgattaccccaagtgggaggggggagttaacaaaatgttccacgggatccaggactacgaggaaaacaaggcccgggtgcacctggtgatggagaagggcgacactgttttcttccatcctttgctcatccacggatctggtcagaataaaacccagggattccggaaggcaatttcctgccatttcgccagtgccgattgccactacattgacgtgaagggcaccagtcaagaaaacatcgagaaggaagttgtaggaatagcacataaattctttggagctgaaaatagcgtgaacttgaaggatatttggatgtttcgagctcgacttgtgaaaggagaaagaaccaatctttga

SEQ ID NO: 11202 - DNA, 568 bp, synthetic construct
  misc_feature 1..568: note = Synthetic polypeptide
  source 1..568: mol_type = other DNA
gcttcagtctcagctccaccacttaatatcatgtgtcctggggcaatttacttcacatcccatgcctctgtttcctcatctgtaaaatggggataataatagcacttatgtcctagtgttgttattaggactaaatacggtgaaatatatggaaaccactttgaagagagctgggcacatggaatgagtttgaaaaaatctgcagaaaggaggtgaaaccattaggattaacagtaatgagagatgtgaccatttcgaaatccgaatatgctccaagtgagaagatgatcacgaaggtccaggatttccaggaagataaggagctcttcagatactgcactctccccgagattctgaaatatgtggagtgcttcactggacctaatattatggccatgcacacaatgttgataaacaaacctccagattctggtaattgcaagaagacgtcccgtcaccccctgcaccaggacctgcactatttccccttcaggcccagcgatctcatcgtttgcgcctggacggcgatggagcacatcagccggaacaacggctgtctggttgtgct

SEQ ID NO: 11203 - DNA, 330 bp, synthetic construct; identical to SEQ ID NO: 6490
  misc_feature 1..330: note = Synthetic polypeptide
  source 1..330: mol_type = other DNA

SEQ ID NO: 11204 - DNA, 575 bp, synthetic construct
  misc_feature 1..575: note = Synthetic polypeptide
  source 1..575: mol_type = other DNA
gctggcaagatggcggaatagaaacagctccgttctgcagctcccagtgagatcgacagagaaggcaggtgatttctgcatttccaactgaggcaccacctacctatgatgccgtggtacagatggagtaccttgacatggtggtgaatgaaacactcagattattcccagttgctattagacttgagaggacttgcaagaaagatgttgaaatcaatggggtattcattcccaaagggtcaatggtggtgattccaacttatgctcttcaccatgacccaaagtactggacagagcctgaggagttccgccctgaaaggttcagtaagaagaaggacagcatagatccttacatatacacaccctttggaactggacccagaaactgcattggcatgaggtttgctctcatgaacatgaaacttgctctaatcagagtccttcagaacttctccttcaaaccttgtaaagaaacacagatccccttgaaattagacacgcaaggacttcttcaaccagaaaaacccattgttctaaaggtggattcaagagatggaaccctaagtggagaatga

SEQ ID NO: 11205 - DNA, 782 bp, synthetic construct
  misc_feature 1..782: note = Synthetic polypeptide
  source 1..782: mol_type = other DNA
taagtcagcagatttctgactgatgcaattaactacatacatgatgcaattaagttaggaaccaagaacaaacaactgaaaaatagaaatacgtttgaagactaaaactcacttctgaataatctatggtccaaagaagaaatcaaagggtgggctttgacagcgagaatcccggggacgacgggcagatgcacaaggggctgtcagaacggagccaggcagtcggcgcggtgctcagcctgctgctggtggcgctcacctgctgcctgctggccctgttgctctacaagaaggagaggagggaaacagtgataagtaagctgaccacttgctgtaggagaagttccaacgtgtcctacaaatactcaaaggtgaataaggaagaagagacagatgagaatgaaacagagtggctgatggaagagatccagctgcctcctccacggcagggaaaggaagggcaggagaacggccatattaccaccaagtcagtgaaagccctcagctccctgcatggggatgaccaggacagtgaggatgaggttctgaccatcccagaggtgaaagttcactcgggcaggggagctggggcagagagctcccacccagtgagaaacgcacagagcaatgcccttcaggagcgtgaggacgatagggtggggctggtcaggggtgagaaggcgaggaaagggaagtccagctctgcacagcagaagacagtgagctccaccaagctggtgtccttccatgacgacagcgacgaggacctcttacacatctga

SEQ ID NO: 11206 - DNA, 2533 bp, synthetic construct; identical to SEQ ID NO: 6495
  misc_feature 1..2533: note = Synthetic polypeptide
  source 1..2533: mol_type = other DNA

SEQ ID NO: 11207 - DNA, 967 bp, synthetic construct
  misc_feature 1..967: note = Synthetic polypeptide
  source 1..967: mol_type = other DNA
tgatacagaaagcgggaagggaagtgctggctagaggaggacgtggtccctggctacggctccaccgcctcggacctaggttccgaggaacagagctgtagaggtcaccaaattagcaatagaagctggcttccgccatattgattctgcttatttatacaataatgaggagcaggttggactggccatccgaagcaagattgcagatggcagtgtgaagagagaagacatattctacacttcaaagctttggtgcactttctttcaaccacagatggtccaaccagccttggaaagctcactgaaaaaacttcaactggactatgttgacctctatcttcttcatttcccaatggctctcaagccaggtgagacgccactaccaaaagatgaaaatggaaaagtaatattcgacacagtggatctctctgccacatgggaggtcatggagaagtgtaaggatgcaggattggccaagtccatcggggtgtcaaacttcaactgcaggcagctggagatgatcctcaacaagccaggactcaagtacaagcctgtctgcaaccaggtagaatgtcatccttacctcaaccagagcaaactgctggatttctgcaagtcaaaagacattgttctggttgcccacagtgctctgggaacccaacgacataaactatgggtggacccaaactccccagttcttttggaggacccagttctttgtgccttagcaaagaaacacaaacaaaccccagccctgattgccctgcgctaccagctgcagcgtggggttgtggtcctggccaagagctacaatgagcagcggatcagagagaacatccaggtttttgaattccagttgacatcagaggatatgaaagttctagatggtctaaacagaaattatcgatatgttgtcatggattttcttatggaccatcctgattatccattttcagatgaatattag

SEQ ID NO: 11208 - DNA, 336 bp, synthetic construct
  misc_feature 1..336: note = Synthetic polypeptide
  source 1..336: mol_type = other DNA
gcacagtggctcacacagatttttacataccgttgctcaaaagagggctgcaagaagaaagagatgctgcagatggtatgtgcccaatgtcacggcaacttctgtatccagcacagacaccctttggaccacagctgcagacacgggagtcgccccaccatcaaagctgggtgagaagagactccgctgcgatggctcggagcacgcagtagcatgcgtggaagcagcttacactctagtgggaagtggagccccattgagcaccatcccacactggctgctgatcttgtttgttgagggagatgggactataataaaattgaatgctgaagttga

SEQ ID NO: 11209 - DNA, 174 bp, synthetic construct
  misc_feature 1..174: note = Synthetic polypeptide
  source 1..174: mol_type = other DNA
gcacagtggctcacacagatttttacataccgttgctcaaaagagggctgcaagaagaaagagatgctgcagatggtatgtgcccaatgtcacggcaacttctgtatccagcacagacaccctttggaccacagctgcagacacgggagtcgccccaccatcaaagctgggtga

SEQ ID NO: 11210 - DNA, 279 bp, synthetic construct
  misc_feature 1..279: note = Synthetic polypeptide
  source 1..279: mol_type = other DNA
gcacagtggctcacacagatttttacataccgttgctcaaaagagggctgcaagaagaaagagatgctgcagatggtatgtgcccaatgtcacggcaacttctgtatccagcacagacaccctttggaccacagctgcagacacgggagtcgccccaccatcaaagctgggtgctcacccatgacagtctctgaatccaggccgttgggagatttcctcaccctggctcctggcgggctggcccagcgactcgggtactggttcacccggctcatgtga

SEQ ID NO: 11211 - DNA, 796 bp, synthetic construct
  misc_feature 1..796: note = Synthetic polypeptide
  source 1..796: mol_type = other DNA
cccagaaattatttctaacccaaaacaattgaaaacagccaccacaagggcccgggccaccaggaagagcctgctgcatgtcccctatggagacggcgaaggggagaaagtggacatttacttccccgacgagtcgtctgaagccttgcctttcttcctgttctttcacggaggatactggcagagcggaagtaaggatgagtctgccttcatggtccacccgctgacggcacagggagtggccgtggtaatagtggcttacggcatcgcccccaaaggcaccctggaccacatggtagaccaggtgacccgcagcgttgcgtttgtccagaagcggtatccaagcaacaagggaatttacctgtgtggacactcagccggggcccacctggctgccatgatgctcctggccgactggaccaagcatggggtcacgcccaacctcagaggctttttcctggtgagtggggtctttgacctggagcccatcgtgtatacttcacagaacgttgctctccagctgaccctggaggacgctcagaggaatagcccccagctgaaggtggcccaggcacagccggtggaccccacctgccgtgtgctggtggtcgtgggccagttcgactcccccgaattccaccgacagtcctgggagttttaccagaccctgtgtcaaggagagtggaaagcctcatttgaagagctccacgatgtggaccactttgaaattgttgagaatctgacccagaaggacaacgtgctcacccagattatcttgaaaacaatcttccagtag

SEQ ID NO: 11212 - DNA, 502 bp, synthetic construct
  misc_feature 1..502: note = Synthetic polypeptide
  source 1..502: mol_type = other DNA
cccagaaattatttctaacccaaaacaattgaaaacagccaccacaagggcccgggccaccaggaagagcctgctgcatgtcccctatggagacggcgaaggggagaaagtggacatttacttccccgacgagtcgtctgaagccttgcctttcttcctgttctttcacggaggatactggcagagcggaagtaaggatgagtctgccttcatggtccacccgctgacggcacagggagtggccgtggtaatagtggcttacggcatcgcccccaaaggcaccctggaccacatggtagaccaggtgacccgcagcgttgcgtttgtccagaagcggtatccaagcaacaagtgggtgttgccagtagattttcttcctgttggacctcagtgggtgggaggacagtgcaatcagtacctaggatacagccaagctgcccctctggcctgtggagcagaaagcaaattgggactcttcgaagggggcctgatgttgtgggga

SEQ ID NO: 11213 - DNA, 220 bp, synthetic construct
  misc_feature 1..220: note = Synthetic polypeptide
  source 1..220: mol_type = other DNA
cccagaaattatttctaacccaaaacaattgaaaacagccaccacaagggcccgggccaccaggaagagcctgctgcatgtcccctatggagacggcgaaggggagaaagtggacatttacttccccgacgagtcgtctgaagccttgcctttcttcctgttctttcacggaggatactggcagagcggaaggctttttcctggtgagtggggtctttga

SEQ ID NO: 11214 - DNA, 811 bp, synthetic construct
  misc_feature 1..811: note = Synthetic polypeptide
  source 1..811: mol_type = other DNA
cccagaaattatttctaacccaaaacaattgaaaacagccaccacaagggcccgggccaccaggaagagcctgctgcatgtcccctatggagacggcgaaggggagaaagtggacatttacttccccgacgagtcgtctgaagccttgcctttcttcctgttctttcacggaggatactggcagagcggaagtaaggatgagtctgccttcatggtccacccgctgacggcacagggagtggccgtggtaatagtggcttacggcatcgcccccaaaggcaccctggaccacatggtagaccaggtgacccgcagcgttgcgtttgtccagaagcggtatccaagcaacaagggaatttacctgtgtggacactcagccggggcccacctggctgccatgatgctcctggccgactggaccaagcatggggtcacgcccaacctcagaggctttttcctggtgagtggggtctttgacctggagcccatcgtgtatacttcacagaacgttgctctccagctgaccctggaggacgctcagaggaatagcccccagctgaaggtggcccaggcacagccggtggaccccacctgccgtgtgctggtggtcgtgggccagttcgactcccccgaattccaccgacagtcctgggagttttaccaggtactcccagtgcagaccctgtgtcaaggagagtggaaagcctcatttgaagagctccacgatgtggaccactttgaaattgttgagaatctgacccagaaggacaacgtgctcacccagattatcttgaaaacaatcttccagtag

SEQ ID NO: 11215 - DNA, 446 bp, synthetic construct
  misc_feature 1..446: note = Synthetic polypeptide
  source 1..446: mol_type = other DNA
cccagaaattatttctaacccaaaacaattgaaaacagccaccacaagggcccgggccaccaggaagagcctgctgcatgtcccctatggagacggcgaaggggagaaagtggacatttacttccccgacgagtcgtctgaagccttgcctttcttcctgttctttcacggaggatactggcagagcggaaggcaccctggaccacatggtagaccaggtgacccgcagcgttgcgtttgtccagaagcggtatccaagcaacaagtgggtgttgccagtagattttcttcctgttggacctcagtgggtgggaggacagtgcaatcagtacctaggatacagccaagctgcccctctggcctgtggagcagaaagcaaattgggactcttcgaagggggcctgatgttgtggggaaactgcgtgcaaatccagctctctgctctg

SEQ ID NO: 11216 - DNA, 581 bp, synthetic construct
  misc_feature 1..581: note = Synthetic polypeptide
  source 1..581: mol_type = other DNA
gggggcagagccaagatggccaaataggaacagctccagtctacagctcccagtgtgagtgacgcagaagacgaatcatttctgcatttccaactgaggcaccacctacctatgatgccgtggtacagatggagtaccttgacatggtggtgaatgaaacactcagattattcccagttgctattagacttgagaggacttgcaagaaagatgttgaaatcaatggggtattcattcccaaagggtcaatggtggtgattccaacttatgctcttcaccatgacccaaagtactggacagagcctgaggagttccgccctgaaaggttcagtaagaagaaggacagcatagatccttacatatacacaccctttggaactggacccagaaactgcattggcatgaggtttgctctcatgaacatgaaacttgctctaatcagagtccttcagaacttctccttcaaaccttgtaaagaaacacagatccccttgaaattagacacgcaaggacttcttcaaccagaaaaacccattgttctaaaggtggattcaagagatggaaccctaagtggagaatga

SEQ ID NO: 11217 - DNA, 1918 bp, synthetic construct
  misc_feature 1..1918: note = Synthetic polypeptide
  source 1..1918: mol_type = other DNA
ggccgggcgcagtggctcatgcctgtaatcccagcactttgggaggccaaggtggatggatcatgagctgctggtgaagaatattcagctggaggatggcaaaatgatcctggcctcgaacttctttaagggggcagccagcagtgtccttgagctgacagaggcagagctggttactgcggaggctgtgcggagtgtttggcagcggatcctccccaaagtcctggaggttgaagactccactgatttcttcaagtcaggggccgcgtctgtggacgttgtgaggctggtggaggaagtgaaggagctgtgtgatggcctggagttagaaaatgaagatgtgtacatggcatccacctttggggacttcatccagctgttagtgaggaagctgcgaggggacgatgaggagggcgagtgcagcattgactacgtggaaatggcagtgaacaagcgcactgtccgcatgccccaccagctcttcattgggggggagttcgtggatgccgagggcgccaagacctctgagaccatcaatcccaccgatggaagtgtcatctgccaggtatccctggcccaagtcaccgacgtcgacaaggcagtggccgcagccaaggatgcctttgagaatggacggtgggggaagatcagtgcgcgggaccggggccggctgatgtacaggttggcagatctcatggagcagcaccaggaggagctggccaccattgaggccctggatgcgggtgccgtctacacgctggccctgaagacccacgtgggcatgtccatccagaccttccgctactttgctggctggtgtgacaagatccagggctccaccatccccatcaaccaggccagacccaaccgcaacctgaccttgaccaggaaggagcctgttggggtttgtggcatcatcatcccctggaactatcccctgatgatgctgtcctggaagacagctgcctgcctggctgccgggaacacagtggtgatcaagcctgctcaggtgaccccactcacagccttgaagtttgcagagctgacattaaaggccggcattcccaaaggtgtggttaacgtcctcccaggatctggctccctggtcggccagagactctcagaccatcctgatgtgaggaaaatcgggttcacaggctccacagaggtgggcaagcacatcatgaaaagctgtgccataagtaacgtgaagaaggtgtccctggaactgggcgggaagtcacccctcatcatctttgctgactgtgacctcaacaaggctgtgcagatggggatgagttctgttttcttcaacaaaggagagaattgcattgcagcaggccgactctttgtggaggactccattcatgatgagttcgtgcggagagtggtagaagaggtgcggaagatgaaggtgggcaacccgctggacagggacaccgaccacgggccgcagaatcaccatgcccaccttgtgaagctgatggagtactgccagcatggcgtgaaggaaggggccacactggtctgcggcgggaatcaggtccctcggccagggttcttctttgagccaactgttttcacagacgtggaagaccacatgttcatagccaaggaggagtccttcgggcctgtcatgatcatctctcggtttgctgatggggacttggatgccgtgctgtctcgggccaatgccacggaatttggcctggcttctggtgtcttcaccagggacatcaacaaggccctgtatgtcagtgacaagctccaggcaggcactgtgtttgtcaacacgtacaacaagaccgacgtggccgctcccttcggaggattcaaacagtctggatttggcaaagatctaggagaggcggctctgaacgagtacctgcgggtcaagacagtgaccttcgaatactga

SEQ ID NO: 11218 - DNA, 727 bp, synthetic construct
  misc_feature 1..727: note = Synthetic polypeptide
  source 1..727: mol_type = other DNA
ggccgggcgcagtggctcatgcctgtaatcccagcactttgggaggccaaggtggatggatcatgagctgctggtgaagaatattcagctggaggatggcaaaatgatcctggcctcgaacttctttaagggggcagccagcagtgtccttgagctgacagaggcagagctggttactgcggaggctgtgcggagtgtttggcagcggatcctccccaaagtcctggaggttgaagactccactgatttcttcaagtcaggggccgcgtctgtggacgttgtgaggctggtggaggaagtgaaggagctgtgtgatggcctggagttagaaaatgaagatgtgtacatggcatccacctttggggacttcatccagctgttagtgaggaagctgcgaggggacgatgaggagggcgagtgcagcattgactacgtggaaatggcagtgaacaagcgcactgtccgcatgccccaccagctcttcattgggggggagttcgtggatgccgagggcgccaagacctctgagaccatcaatcccaccgatggaagtgtcatctgccaggtatccctggcccaagtcaccgacgtcgacaaggcagtggccgcagccaaggatgcctttgagaatggacggtgggggaagatcagtgcgcgggaccggggccggctgatgtacagggctccaccatccccatcaaccaggccagacccaaccgcaacctga

SEQ ID NO: 11219 - DNA, 1631 bp, synthetic construct; identical to SEQ ID NO: 7615
  misc_feature 1..1631: note = Synthetic polypeptide
  source 1..1631: mol_type = other DNA

SEQ ID NO: 11220 - DNA, 1167 bp, synthetic construct; identical to SEQ ID NO: 6316
  misc_feature 1..1167: note = Synthetic polypeptide
  source 1..1167: mol_type = other DNA

SEQ ID NO: 11221 - DNA, 1266 bp, synthetic construct; identical to SEQ ID NO: 6317
  misc_feature 1..1266: note = Synthetic polypeptide
  source 1..1266: mol_type = other DNA

SEQ ID NO: 11222 - DNA, 274 bp, synthetic construct; identical to SEQ ID NO: 7601
  misc_feature 1..274: note = Synthetic polypeptide
  source 1..274: mol_type = other DNA

SEQ ID NO: 11223 - DNA, 418 bp, synthetic construct
  misc_feature 1..418: note = Synthetic polypeptide
  source 1..418: mol_type = other DNA
ctgggcaccacagtgagggttatgggataatccagctgcctgggcaccatagtgaagtggccagccccccaactatgagatgctcaaggaggagcacgaggtggctgtgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcgtcatcccagtgctgatcttccaggcctatggatag

SEQ ID NO: 11224 - DNA, 386 bp, synthetic construct
  misc_feature 1..386: note = Synthetic polypeptide
  source 1..386: mol_type = other DNA
cagctgcctgggcaccatagtgaagtggccagccccccaactatgagatgctcaaggaggagcacgaggtggctgtgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcgtcatcccagtgctgatcttccaggcctatggatag

SEQ ID NO: 11225 - DNA, 457 bp, synthetic construct
  misc_feature 1..457: note = Synthetic polypeptide
  source 1..457: mol_type = other DNA
ctgggcaccacagtgagggttatgggataatccagctgcctgggcaccatagtgaaggtaatgggataatccagctgcctgggcaccatagtgaagtggccagccccccaactatgagatgctcaaggaggagcacgaggtggctgtgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcgtcatcccagtgctgatcttccaggcctatggatag

SEQ ID NO: 11226 - DNA, 496 bp, synthetic construct
  misc_feature 1..496: note = Synthetic polypeptide
  source 1..496: mol_type = other DNA
ctgggcaccacagtgagggttatgggataatccagctgcctgggcaccatagtgaaggtaatgggataatccagctgcctgggcaccatagtgaaggtaatgggataatccagctgcctgggcaccatagtgaagtggccagccccccaactatgagatgctcaaggaggagcacgaggtggctgtgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcgtcatcccagtgctgatcttccaggcctatggatag

SEQ ID NO: 11227 - DNA, 418 bp, synthetic construct; identical to SEQ ID NO: 11223
  misc_feature 1..418: note = Synthetic polypeptide
  source 1..418: mol_type = other DNA

SEQ ID NO: 11228 - DNA, 418 bp, synthetic construct; identical to SEQ ID NO: 11223
  misc_feature 1..418: note = Synthetic polypeptide
  source 1..418: mol_type = other DNA

SEQ ID NO: 11229 - DNA, 385 bp, synthetic construct
  misc_feature 1..385: note = Synthetic polypeptide
  source 1..385: mol_type = other DNA
agctgcctgggcaccatagtgaagtggccagccccccaactatgagatgctcaaggaggagcacgaggtggctgtgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcgtcatcccagtgctgatcttccaggcctatggatag

SEQ ID NO: 11230 - DNA, 385 bp, synthetic construct; identical to SEQ ID NO: 11229
  misc_feature 1..385: note = Synthetic polypeptide
  source 1..385: mol_type = other DNA

SEQ ID NO: 11231 - DNA, 385 bp, synthetic construct; identical to SEQ ID NO: 11229
  misc_feature 1..385: note = Synthetic polypeptide
  source 1..385: mol_type = other DNA

SEQ ID NO: 11232 - DNA, 418 bp, synthetic construct; identical to SEQ ID NO: 11223
  misc_feature 1..418: note = Synthetic polypeptide
  source 1..418: mol_type = other DNA

SEQ ID NO: 11233 - DNA, 418 bp, synthetic construct; identical to SEQ ID NO: 11223
  misc_feature 1..418: note = Synthetic polypeptide
  source 1..418: mol_type = other DNA

SEQ ID NO: 11234 - DNA, 418 bp, synthetic construct; identical to SEQ ID NO: 11223
  misc_feature 1..418: note = Synthetic polypeptide
  source 1..418: mol_type = other DNA

SEQ ID NO: 11235 - DNA, 1146 bp, synthetic construct
  misc_feature 1..1146: note = Synthetic polypeptide
  source 1..1146: mol_type = other DNA
gaaagcagctgggagggaggctgtaccctgcaaagccacagaggcagcgctgcccaagaccatgggaacccacctcttgcatcagtgtgacttggatatgagacctggagtcaaaggaggtcattttggagctttaaaatttgattgccttgctggattttggacttgcctgggccctgaaactcctttgttttggccaatttctcctggaatggctgagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatgagaaccactggatatctgtatattccggctttggcagcgttgcactctcccagttctctactctcccctcaggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactga

SEQ ID NO: 11236 - DNA, 1074 bp, synthetic construct
  misc_feature 1..1074: note = Synthetic polypeptide
  source 1..1074: mol_type = other DNA
gaaagcagctgggagggaggctgtaccctgcaaagccacagaggcagcgctgcccaagaccatgggaacccacctcttgcatcagtgtgacttggatatgagacctggagtcaaaggaggtcattttggagctttaaaatttgattgccttgctggattttggacttgcctgggccctgaaactcctttgttttggccaatttctcctggaatggctgagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactga

SEQ ID NO: 11237 - DNA, 942 bp, synthetic construct
  misc_feature 1..942: note = Synthetic polypeptide
  source 1..942: mol_type = other DNA
gaaagcagctgggagggaggctgtaccctgcaaagccacagaggcagcgctgcccaagaccatgggaacccacctcttgcatcagtgtgacttggatatgagacctggagtcaaaggaggtcattttggagctttaaaatttgattgccttgctggattttggacttgcctgggccctgaaactcctttgttttggccaatttctcctggaatggctgagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacagtgggggaaatag

SEQ ID NO: 11238 - DNA, 7991 bp, synthetic construct
  misc_feature 1..7991: note = Synthetic polypeptide
  source 1..7991: mol_type = other DNA
aatttggtggcccatacagggaaaacattgtcctccgggaaagggtctttgatcacctcttgtgaggagacacatcccactgccttgttgcagtggcctcatgagtaaggaatcgagacccacctggtctgatgaataaccccagactctcaacaacgtggggagaaaaagacttgcaacactatggtggccaggtaactctgtgcgcagaccaaggtaagaaatgtcgcaggagtgacaaagtacttccttggtggtcactatattctggtggctgaaagttcatgaatggtaacaagtgctactgctgtgtggagtgaatgagtccaatctgtgggtctatggttacctcatacggcttagccttctctgaaggatcctgatgttggggtttatatagtcctcccaatgctaagcgggacttaaaatattcctaggaggaaagtggccagagtggatgaagcaaaaggagaagagtgtgaagaacctccaggaggtggggctaaaagataggcaagaaatctctaatacgagggattgagccacagaaagctccagacagataaaaaagaaattcctaatatgaggaactgagccacagcaagcctccagcaggcaacaaatccctaatatgagggattgagcctagctaagacccaatatgggaaataccccaagaaagacagagaataagaaggatgaaaatagtaacaaggatataccccttgatagtcccctaggtttcatgttaaaatactggaaagataatgagaggactaagcataagaagaaggagcaaatgataaaatattgctgtttcatttggacccaaggtcccatcctcaaaccctcaatcttctggccaaagtatgggtcgaatgagggtgtaatgagtcaactcctaatccaatatgttaatgataaaagtctggtttctcaagaagaactagactatgctctttgttggaagcagggacctgtcctcctctttcccttaaagacaactagggaagaatccgatccagcatctcaaattgagaagtcagacaagccgactcccacacctaaagtcagcacatgggatcccctagactgtcttcctttgcttactgccccaatcctaacccccctactcctcaggcagctgctgctgccccagatcccatcccagattcttccccaactcatgatgttcctcccgcttacaaccctgactctcaggggcagtcgtcccaagagcctgttcattgccaacctaaatatccttccttaaaagggctccaacatgaaatagagcagtgtaaaaaggacattcagaactccccttttctttccacacctaaggagtcagccataactttcttccctttaaaaggggtatcacaaggaggggaagtcattggttttgtaaatgctctcttgactatttcagaagtctgaggtctgaagaaagaacttaagccactgctagatgacccctatggagtggcagatcaagttgatcaattcttaggacctcagttatacacttgggtcgagcaaatgtctatcctaggcatcttcttttcaggggaggaaagaagcatgatccgtagggctgctatggcaatttgggaacatgaacaccctcctggtcaaaacgttcctactgtggaccaaacatttgctgcccaagcaagactcctggtgggacaacagcaatgcagcccactgagaaaacatgcaggacctaagggaaataataataaaaggaatcagtgaatccatacccagaactcaaaagctctctaaagcatttgatatacaacaggagaaagatgagggacctataagattcctagacagactaaaggagcaaatgaagcaatatacaggtctgaatttagaagatccccttgggcaaaggatgttaaagatccattttgtcactaaaggctggccagatgtttcaaaaaagttacaaaaattggaggactgagaaaaccgacctctaagagaacttctcagagaagctcaaaaggtgtatgtgaggagggacagggaaaaacaaaaacagaagtcaaaaccaatgttatctactttccagcaggtggctccaaacccatatgctactaaatgaggcttccagggagccagaaactataaaaggtcccaagcctcccaaacccagtttagagaaaccaaaccttcagctagaggacccaagtctacatttcccaggccccctaaagagcatagaaaagcaagaccaaaaaatcccaaaactgagagaggggaaggacaagataagtgttacaaatgtggaaggacagcccccttcaaaagagaatgtcccaaattagaaaaggagagagaagcccttccactcacgacctttgaagaggaacagggaagtcaggggctctgtctatattatcttgagtcccaccaggagcccttgataaatttggaggtgggacctacacatgagcttatcacatttttggttgattcaggagcggcctgttcctctgtttgtttcccctcatctaatgttgcctgctcttcagaagaacttatagtctctgagataaaaggggaaggatttacggtgagaatcttagaaaatacagaagtcaagtaccaagactaaacaacccaggttcaatttttgttaatccctgaagcagcaactagtttgttaggaagagacttaatgttaaagttaggcataggcctacaagtcagcccaaagggattccttacttcattaaacttactcaccacggcggatgagaaatacattcatcctgatgtttggtcaagggaagaaaactgaggaaagcttcgaattctcccaatccacatcaagctaaacaccccgcactgggaagtagtgaggaggaagcaattccccattcccttagagggcatgctagggctaaaacctataattgaaagtctcattaatgatgggcttcttgaaccctgtatgtctccttataacaccccaatactgcctgtcaaaaaatcagatgggtcataccggctggtgaaagacctcagagccattaaccaaacagtccagaccactaaccctgttgtccccaacccttacaccattctcagcaaaattccatataatcatcaatggtttactgtaatagatttaaaggatgctttttgggcatgtccctggctgaagagagccgagacacatttgcctttgagtgggaagatccccagttagggtgaaaacaatggtatcaatggacagtcttgcctcaggggttcatggattcacccaacctttttggtcaaattttagaacaagtgctagacaaagtttctgttccaaaacaattatgcctgcttcaatatgtcgatgatattctcatatctggtgaggatatagagaaagaagctggcttctctacacatatttttgaccatctacagttcgaggggttacgggtctcaaagggaaagcttcagtgtatggagcctaaagttaaatatttaggccgcttaataagtgcgggcaagcgaaggatagggcctgaatgggtcgaaggaatcgtgtccttacccttgcctcagactaaacaggaactcaggaaatttttagggttagttggatactgccgcttaaggattaactcacatgccctaaacagtaaacttttataccaaaaacttgcccagggaaaacctgagcatctcctgtggacttctaaagaggtcgatcaggtcaaagagctaaaaggaatagcttataactgctcttgccctagccttaccttccctagaaaatacacttcaccttttcgtcagcgtgaaaaatggggtggctttaggggtgcttatccaagagcacagaggctgctggcagcccatggccttcctgtcaaaaattttggacctggtcacctgtggatggcctcagtgcatccaatccattgcagctacagcagtattagttgaagagagtagaaaattaacctttgggtggagattaacagtaagcacaccccaccaagttagagagctattttaaataaaaaagcaggaaggtgactaactgactccagaatcttaaaatatggggctattctactaaaaaaagatgagagaacacctatgtctagatttaattgactaccaaacaaaactcaggccagatctaggaaagatccctttcaaaacaggacggcacttatttatagatggttcctcccagctgattgagggaaaaagacacaacgggtatccagtaatcgatggagaaattctctatgtataagaacagagtcaagaaaattgcctaataattggtctgcccaaacttgtgaactgtttgcactcagccaagccttaaagcacttgcaaaaccaggaaggaaccatctatactgattctaagtatgcctttggagtggctcatacatttggaaaaagttggactgaatgtggcctcactaatagtaaaggtcatgaccttgttcataaggagttaatcatccaagtactggataaccttcagttgccagaagaaatagctattgtccgtgtacccgggcaccagaaaagcctttcttttgaaagtcgaggaaataacctaacaaaccagatagccaaacaagctgctgtttcctccgaaacacctatgtttcacttaactccttgtcttccttcccctactgcaatttcctttttctcttccattgaaaaagaagaataaagataggagccaaaggagaagaccagaatgaaaacggctgttactagaccaaaaggaaatgttatccaagcccgttatgtggaagatctagtctcaactatatctgaggacacactggggatcccaagccatgtgcgatgcagttctcagggtctatggatgtataagaatttacaccctagccaaacaagttacagatagttgcttaatatgtaaaaagactagtaagcagattctaagaaaaccgccccttggagaaagagattcagggctaagaccatttccaagtgttcaattaattatactgaaatgcccccaattggtcatttaaaatacttattagtaataatagaccactttacctactgggtagagactatcccacactcaaatgcaaccaccagtaacgtagttaaggcattaattgaaaacattgtacccagatttggactaatacaaagcactgattcagacaatggaacccatttcactgcatatgtcattaaaaagttagcccaggtactagacataaaatggaaaaaccatatcccttggcatctctcctcctcaagaagagtagaaaggatgaatcagactctaaaaagccacttaactaaattagttctagaaacttgattgccatggactaaatgtcttcctattgccttgttaagaatccgaactgctcctcagagagatactggcctttccccttatgagatgctctatggattgccctatttatactccactgctaacattcctacattcaaaataaaagatcagttcctcaaaaattatatacttggtccatactctactttctcttcccttaagactaaaggtctcctagcacaggcgccaccgctggagtttccagcacattagcgtcagcctggagaccatgtcctcataaaagggtggaaggaaggcaaactcaaaccagcttgggaaggaccctacttggtgctcctaaatactaagactgcagtccgaacagcagaatgaggatggactgatcacacccgcgtcaaaaaggcgctgccacctccaggatcataaaccgtcactccagggctcaccccaaccaaattaactctaaaaagggcttaataatcacttgtttattttttcttttctttccaacagaaggtcatcttgtcatcaatgtaacttgggctaaccatcctttaatccttcagtttgatgcttgttcagtcatcctgtgtggagacaagcaagctcaaaggaagctgtctcatgtagataagtacctatgtccataccataaaaagtcaaccaagtataagtatagaaccttaaaaagtccctgtggtgactggacagatgtttggaaaccactcagtatggagggtggacagccaggccccctttttcaaataagttatggggactaaaacagaaactccaactaattcatggtcccaccccaccaaactgtaagccactgcagtgtaacccctcattgctaattatagctaacccccaaacaatggcccaagaacccactatattcaaacagtatggattaggagcaaatgttacaaaacaaaatcccataaaaatcttcaaccactggttaacaatgataattaaaaaaaaatccacacccagagtctgggaaacgagtggaatctaacactctctccaagtatagcgagctcagcgtcctcctcccatctccaaaacaacccaactaaagtaacggttgtaaaggtaaaaaatttaaagcagactatagccctagagacaggatgtcaagatgcaaatgcttggctaaaatggattaaatattccatctgcactttaaacaaatatgaatgttatgcttgtgctcacggtagaccagaggcccagattgtcccctttccactcagatggtcttctaactgaccgggcataagctgtatggtagttctcttccaagatcacacagcctggggtgacaaatcatgtcaagctctttctctgctgttccctgaagctcaacaccctgagggtcagcccccgagggccatcagcttccgtttcccaatgccaattttactttgtgtctctcacaacagggagaaaacttggtgttccttggagccttaatgggatgcagtgagcttaagtccttccaagagcttacccatcagtctgcccttagtcatcctcgagcggatgtatggtggtattgtggtggaccattactggacactgccgatgacctgggagctgtcatttccctcctgctctggggacgacagctttttgcactgtactcaggcaatgatgtcacggatatttcagatgaccgcttcccgaagccccctgagattgcaaatggctatgtggagcacttgtttcgctaccagtgtaagaactactacagactgcgcacagaaggagatggagtatacaccttaaatgataagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggggccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggtggttctacaccctaactaccaccaggtagatattgggctcatcaaactcaaacagaaggtgcttgttaatgagagagtgatgcccatctgcctaccttcaaagaattatgcagaagtagggcgtgtgggttacgtgtctggctggggacaaagtgacaactttaaacttactgaccatctgaagtatgtcatgctgcctgtggctgaccaatacgattgcataacgcattatgaaggcagcacatgccccaaatggaaggcaccgaagagccctgtaggggtgcagcccatactgaacgaacacaccttctgtgtcggcatgtctaagtaccaggaagacacctgctatggcgatgcgggcagtgcctttgccgttcacgacctggaggaggacacctggtacgcggctgggatcctaagctttgataagagctgtgctgtggctgagtatggtgtgtatgtgaaggtgacttccatccagcactgggttcagaagaccatagctgagaactaa

SEQ ID NO: 11239 - DNA, 7298 bp, synthetic construct
  misc_feature 1..7298: note = Synthetic polypeptide
  source 1..7298: mol_type = other DNA
aatttggtggcccatacagggaaaacattgtcctccgggaaagggtctttgatcacctcttgtgaggagacacatcccactgccttgttgcagtggcctcatgagtaaggaatcgagacccacctggtctgatgaataaccccagactctcaacaacgtggggagaaaaagacttgcaacactatggtggccaggtaactctgtgcgcagaccaaggtaagaaatgtcgcaggagtgacaaagtacttccttggtggtcactatattctggtggctgaaagttcatgaatggtaacaagtgctactgctgtgtggagtgaatgagtccaatctgtgggtctatggttacctcatacggcttagccttctctgaaggatcctgatgttggggtttatatagtcctcccaatgctaagcgggacttaaaatattcctaggaggaaagtggccagagtggatgaagcaaaaggagaagagtgtgaagaacctccaggaggtggggctaaaagataggcaagaaatctctaatacgagggattgagccacagaaagctccagacagataaaaaagaaattcctaatatgaggaactgagccacagcaagcctccagcaggcaacaaatccctaatatgagggattgagcctagctaagacccaatatgggaaataccccaagaaagacagagaataagaaggatgaaaatagtaacaaggatataccccttgatagtcccctaggtttcatgttaaaatactggaaagataatgagaggactaagcataagaagaaggagcaaatgataaaatattgctgtttcatttggacccaaggtcccatcctcaaaccctcaatcttctggccaaagtatgggtcgaatgagggtgtaatgagtcaactcctaatccaatatgttaatgataaaagtctggtttctcaagaagaactagactatgctctttgttggaagcagggacctgtcctcctctttcccttaaagacaactagggaagaatccgatccagcatctcaaattgagaagtcagacaagccgactcccacacctaaagtcagcacatgggatcccctagactgtcttcctttgcttactgccccaatcctaacccccctactcctcaggcagctgctgctgccccagatcccatcccagattcttccccaactcatgatgttcctcccgcttacaaccctgactctcaggggcagtcgtcccaagagcctgttcattgccaacctaaatatccttccttaaaagggctccaacatgaaatagagcagtgtaaaaaggacattcagaactccccttttctttccacacctaaggagtcagccataactttcttccctttaaaaggggtatcacaaggaggggaagtcattggttttgtaaatgctctcttgactatttcagaagtctgaggtctgaagaaagaacttaagccactgctagatgacccctatggagtggcagatcaagttgatcaattcttaggacctcagttatacacttgggtcgagcaaatgtctatcctaggcatcttcttttcaggggaggaaagaagcatgatccgtagggctgctatggcaatttgggaacatgaacaccctcctggtcaaaacgttcctactgtggaccaaacatttgctgcccaagcaagactcctggtgggacaacagcaatgcagcccactgagaaaacatgcaggacctaagggaaataataataaaaggaatcagtgaatccatacccagaactcaaaagctctctaaagcatttgatatacaacaggagaaagatgagggacctataagattcctagacagactaaaggagcaaatgaagcaatatacaggtctgaatttagaagatccccttgggcaaaggatgttaaagatccattttgtcactaaaggctggccagatgtttcaaaaaagttacaaaaattggaggactgagaaaaccgacctctaagagaacttctcagagaagctcaaaaggtgtatgtgaggagggacagggaaaaacaaaaacagaagtcaaaaccaatgttatctactttccagcaggtggctccaaacccatatgctactaaatgaggcttccagggagccagaaactataaaaggtcccaagcctcccaaacccagtttagagaaaccaaaccttcagctagaggacccaagtctacatttcccaggccccctaaagagcatagaaaagcaagaccaaaaaatcccaaaactgagagaggggaaggacaagataagtgttacaaatgtggaaggacagcccccttcaaaagagaatgtcccaaattagaaaaggagagagaagcccttccactcacgacctttgaagaggaacagggaagtcaggggctctgtctatattatcttgagtcccaccaggagcccttgataaatttggaggtgggacctacacatgagcttatcacatttttggttgattcaggagcggcctgttcctctgtttgtttcccctcatctaatgttgcctgctcttcagaagaacttatagtctctgagataaaaggggaaggatttacggtgagaatcttagaaaatacagaagtcaagtaccaagactaaacaacccaggttcaatttttgttaatccctgaagcagcaactagtttgttaggaagagacttaatgttaaagttaggcataggcctacaagtcagcccaaagggattccttacttcattaaacttactcaccacggcggatgagaaatacattcatcctgatgtttggtcaagggaagaaaactgaggaaagcttcgaattctcccaatccacatcaagctaaacaccccgcactgggaagtagtgaggaggaagcaattccccattcccttagagggcatgctagggctaaaacctataattgaaagtctcattaatgatgggcttcttgaaccctgtatgtctccttataacaccccaatactgcctgtcaaaaaatcagatgggtcataccggctggtgaaagacctcagagccattaaccaaacagtccagaccactaaccctgttgtccccaacccttacaccattctcagcaaaattccatataatcatcaatggtttactgtaatagatttaaaggatgctttttgggcatgtccctggctgaagagagccgagacacatttgcctttgagtgggaagatccccagttagggtgaaaacaatggtatcaatggacagtcttgcctcaggggttcatggattcacccaacctttttggtcaaattttagaacaagtgctagacaaagtttctgttccaaaacaattatgcctgcttcaatatgtcgatgatattctcatatctggtgaggatatagagaaagaagctggcttctctacacatatttttgaccatctacagttcgaggggttacgggtctcaaagggaaagcttcagtgtatggagcctaaagttaaatatttaggccgcttaataagtgcgggcaagcgaaggatagggcctgaatgggtcgaaggaatcgtgtccttacccttgcctcagactaaacaggaactcaggaaatttttagggttagttggatactgccgcttaaggattaactcacatgccctaaacagtaaacttttataccaaaaacttgcccagggaaaacctgagcatctcctgtggacttctaaagaggtcgatcaggtcaaagagctaaaaggaatagcttataactgctcttgccctagccttaccttccctagaaaatacacttcaccttttcgtcagcgtgaaaaatggggtggctttaggggtgcttatccaagagcacagaggctgctggcagcccatggccttcctgtcaaaaattttggacctggtcacctgtggatggcctcagtgcatccaatccattgcagctacagcagtattagttgaagagagtagaaaattaacctttgggtggagattaacagtaagcacaccccaccaagttagagagctattttaaataaaaaagcaggaaggtgactaactgactccagaatcttaaaatatggggctattctactaaaaaaagatgagagaacacctatgtctagatttaattgactaccaaacaaaactcaggccagatctaggaaagatccctttcaaaacaggacggcacttatttatagatggttcctcccagctgattgagggaaaaagacacaacgggtatccagtaatcgatggagaaattctctatgtataagaacagagtcaagaaaattgcctaataattggtctgcccaaacttgtgaactgtttgcactcagccaagccttaaagcacttgcaaaaccaggaaggaaccatctatactgattctaagtatgcctttggagtggctcatacatttggaaaaagttggactgaatgtggcctcactaatagtaaaggtcatgaccttgttcataaggagttaatcatccaagtactggataaccttcagttgccagaagaaatagctattgtccgtgtacccgggcaccagaaaagcctttcttttgaaagtcgaggaaataacctaacaaaccagatagccaaacaagctgctgtttcctccgaaacacctatgtttcacttaactccttgtcttccttcccctactgcaatttcctttttctcttccattgaaaaagaagaataaagataggagccaaaggagaagaccagaatgaaaacggctgttactagaccaaaaggaaatgttatccaagcccgttatgtggaagatctagtctcaactatatctgaggacacactggggatcccaagccatgtgcgatgcagttctcagggtctatggatgtataagaatttacaccctagccaaacaagttacagatagttgcttaatatgtaaaaagactagtaagcagattctaagaaaaccgccccttggagaaagagattcagggctaagaccatttccaagtgttcaattaattatactgaaatgcccccaattggtcatttaaaatacttattagtaataatagaccactttacctactgggtagagactatcccacactcaaatgcaaccaccagtaacgtagttaaggcattaattgaaaacattgtacccagatttggactaatacaaagcactgattcagacaatggaacccatttcactgcatatgtcattaaaaagttagcccaggtactagacataaaatggaaaaaccatatcccttggcatctctcctcctcaagaagagtagaaaggatgaatcagactctaaaaagccacttaactaaattagttctagaaacttgattgccatggactaaatgtcttcctattgccttgttaagaatccgaactgctcctcagagagatactggcctttccccttatgagatgctctatggattgccctatttatactccactgctaacattcctacattcaaaataaaagatcagttcctcaaaaattatatacttggtccatactctactttctcttcccttaagactaaaggtctcctagcacaggcgccaccgctggagtttccagcacattagcgtcagcctggagaccatgtcctcataaaagggtggaaggaaggcaaactcaaaccagcttgggaaggaccctacttggtgctcctaaatactaagactgcagtccgaacagcagaatgaggatggactgatcacacccgcgtcaaaaaggcgctgccacctccaggatcataaaccgtcactccagggctcaccccaaccaaattaactctaaaaagggcttaataatcacttgtttattttttcttttctttccaacagaaggtcatcttgtcatcaatgtaacttgggctaaccatcctttaatccttcagtttgatgcttgttcagtcatcctgtgtggagacaagcaagctcaaaggaagctgtctcatgtagataagtacctatgtccataccataaaaagtcaaccaagtataagtatagaaccttaaaaagtccctgtggtgactggacagatgtttggaaaccactcagtatggagggtggacagccaggccccctttttcaaataagttatggggactaaaacagaaactccaactaattcatggtcccaccccaccaaactgtaagccactgcagtgtaacccctcattgctaattatagctaacccccaaacaatggcccaagaacccactatattcaaacagtatggattaggagcaaatgttacaaaacaaaatcccataaaaatcttcaaccactggttaacaatgataattaaaaaaaaatccacacccagagtctgggaaacgagtggaatctaacactctctccaagtatagcgagctcagcgtcctcctcccatctccaaaacaacccaactaaagtaacggttgtaaaggtaaaaaatttaaagcagactatagccctagagacaggatgtcaagatgcaaatgcttggctaaaatggattaaatattccatctgcactttaaacaaatatgaatgttatgcttgtgctcacggtagaccagaggcccagattgtcccctttccactcagatggtcttctaactgaccgggcataagctgtatggtagttctcttccaagatcacacagcctggggtgacaaatcatgtcaagctctttctctgctgttccctgaagctcaacaccctgagggtcagcccccgagggccatcagcttccgtttcccaatgccaattttactttgtgtctctcacaacagggagaaaacttggtgttccttggagccttaatgggatgcagtgagcttaagtccttccaagagcttacccatcagtctgcccttagtcatcctcgagcggatgtatggtggtattgtggtggaccattactggacactgccgatgacctgggagctgtcatttccctcctgctctggggacgacagctttttgcactgtactcaggcaatgatgtcacggatatttcagatgaccgcttcccgaagccccctgagattgcaaatggctatgtggagcacttgtttcgctaccagtgtaagaactactacagactgcgcacagaaggagatggagtatacaccttaaatgataagaagcagtggataaataaggctgttggagataaacttcctgaatgtgaagcagtatgtgggaagcccaagaatccggcaaacccagtgcagcggatcctgggaggacacctggtacgcggctgggatcctaagctttga

SEQ ID NO: 11240 - DNA, 1639 bp, synthetic construct
  misc_feature 1..1639: note = Synthetic polypeptide
  source 1..1639: mol_type = other DNA
ccacagaatggaagctccatgagggcagggctgtgactgtcctattggttgatgtgtactgagcacccgacagtgcctgtcatatggtaactgtgctgagggtctgggtacgaactaccgagggcatgtgaacatcacccggtcaggcattgagtgccagctatggaggagtcgctacccacataagcctgaaatcaactccactacccatcctggggccgacctacaggagaatttctgccgcaaccccgacagcagcaccacgggaccctggtgctacactacagaccccaccgtgaggaggcaggaatgcagcatccctgtctgtggccaggatcaagtcactgtagcgatgactccacgctccgaaggctccagtgtgaatctgtcacctccattggagcagtgtgtccctgatcgggggcagcagtaccaggggcgcctggcggtgaccacacatgggctcccctgcctggcctgggccagcgcacaggccaaggccctgagcaagcaccaggacttcaactcagctgtgcagctggtggagaacttctgccgcaacccagacggggatgaggagggcgtgtggtgctatgtggccgggaagcctggcgactttgggtactgcgacctcaactattgtgaggaggccgtggaggaggagacaggagatgggctggatgaggactcagacagggccatcgaagggcgtaccgccaccagtgagtaccagactttcttcaatccgaggacctttggctcgggagaggcagactgtgggctgcgacctctgttcgagaagaagtcgctggaggacaaaaccgaaagagagctcctggaatcctacatcgacgggcgcattgtggagggctcggatgcagagatcggcatgtcaccttggcaggtgatgcttttccggaagagtccccaggagctgctgtgtggggccagcctcatcagtgaccgctgggtcctcaccgccgcccactgcctcctgtacccgccctgggacaagaacttcaccgagaatgaccttctggtgcgcattggcaagcactcccgcaccaggtacgagcgaaacattgaaaagatatccatgttggaaaagatctacatccaccccaggtacaactggcgggagaacctggaccgggacattgccctgatgaagctgaagaagcctgttgccttcagtgactacattcaccctgtgtgtctgcccgacagggagacggcagccagcttgctccaggctggatacaaggggcgggtgacaggctggggcaacctgaaggagacgtggacagccaacgttggtaaggggcagcccagtgtcctgcaggtggtgaacctgcccattgtggagcggccggtctgcaaggactccacccggatccgcatcactgacaacatgttctgtgctggttacaagcctgatgaagggaaacgaggggatgcctgtgaaggtgacagtgggggaccctttgtcatgaagagcccctttaacaaccgctggtatcaaatgggcatcgtctcatggggtgaaggctgtgaccgggatgggaaatatggcttctacacacatgtgttccgcctgaagaagtggatacagaaggtcattgatcagtttggagagtag

SEQ ID NO: 11241 - DNA, 1522 bp, synthetic construct
  misc_feature 1..1522: note = Synthetic polypeptide
  source 1..1522: mol_type = other DNA
ccacagaatggaagctccatgagggcagggctgtgactgtcctattggttgatgtgtactgagcacccgacagtgcctgtcatatggtaactgtgctgagggtctgggtacgaactaccgagggcatgtgaacatcacccggtcaggcattgagtgccagctatggaggagtcgctacccacataagcctgaaatcaactccactacccatcctggggccgacctacaggagaatttctgccgcaaccccgacagcagcaccacgggaccctggtgctacactacagaccccaccgtgaggaggcaggaatgcagcatccctgtctgtggccaggatcaagtcactgtagcgatgactccacgctccgaaggctccagtgtgaatctgtcacctccattggagcagtgtgtccctgatcgggggcagcagtaccaggggcgcctggcggtgaccacacatgggctcccctgcctggcctgggccagcgcacaggccaaggccctgagcaagcaccaggacttcaactcagctgtgcagctggtggagaacttctgccgcaacccagacggggatgaggagggcgtgtggtgctatgtggccgggaagcctggcgactttgggtactgcgacctcaactattgtgaggaggccgtggaggaggagacaggagatgggctggatgaggactcagacagggccatcgaagggcgtaccgccaccagtgagtaccagactttcttcaatccgaggacctttggctcgggagaggcagactgtgggctgcgacctctgttcgagaagaagtcgctggaggacaaaaccgaaagagagctcctggaatcctacatcgacgggcgcattgtggagggctcggatgcagagatcggcatgtcaccttggcaggtgatgcttttccggaagagtccccaggagctgctgtgtggggccagcctcatcagtgaccgctgggtcctcaccgccgcccactgcctcctgtacccgccctgggacaagaacttcaccgagaatgaccttctggtgcgcattggcaagcactcccgcaccaggtacgagcgaaacattgaaaagatatccatgttggaaaagatctacatccaccccagcttgctccaggctggatacaaggggcgggtgacaggctggggcaacctgaaggagacgtggacagccaacgttggtaaggggcagcccagtgtcctgcaggtggtgaacctgcccattgtggagcggccggtctgcaaggactccacccggatccgcatcactgacaacatgttctgtgctggttacaagcctgatgaagggaaacgaggggatgcctgtgaaggtgacagtgggggaccctttgtcatgaagagcccctttaacaaccgctggtatcaaatgggcatcgtctcatggggtgaaggctgtgaccgggatgggaaatatggcttctacacacatgtgttccgcctgaagaagtggatacagaaggtcattgatcagtttggagagtag

SEQ ID NO: 11242 - DNA, 773 bp, synthetic construct
  misc_feature 1..773: note = Synthetic polypeptide
  source 1..773: mol_type = other DNA
ccacagaatggaagctccatgagggcagggctgtgactgtcctattggttgatgtgtactgagcacccgacagtgcctgtcatatggtaactgtgctgagggtctgggtacgaactaccgagggcatgtgaacatcacccggtcaggcattgagtgccagctatggaggagtcgctacccacataagcctgaaatcaactccactacccatcctggggccgacctacaggagaatttctgccgcaaccccgacagcagcaccacgggaccctggtgctacactacagaccccaccgtgaggaggcaggaatgcagcatccctgtctgtggccaggatcaagtcactgtagcgatgactccacgctccgaaggctccagtgtgaatctgtcacctccattggagcagtgtgtccctgatcgggggcagcagtaccaggggcgcctggcggtgaccacacatgggctcccctgcctggcctgggccagcgcacaggccaaggccctgagcaagcaccaggacttcaactcagctgtgcagctggtggagaacttctgccgcaacccagacggggatgaggagggcgtgtggtgctatgtggccgggaagcctggcgactttgggtactgcgacctcaactattgtgaggaggccgtggaggaggagacaggagatgggctggatgaggactcagacagggccatcgaagggcgtaccgccaccagtgagtaccagactttcttcaatccgaggacctttggctcgggagaggcag

SEQ ID NO: 11243 - DNA, 1570 bp, synthetic construct
  misc_feature 1..1570: note = Synthetic polypeptide
  source 1..1570: mol_type = other DNA
tacaggaagtttaaaccagaaaataataagattagttacctacagggggtgggtaggaatggggtggaaagaatgtgggaatgggaccatggtagtaggaagaaatgacacttctctgagtatacctttttatataactataactcttagaattattgtcatgcctcatgtccctgataccccgataaaataggtgatagataaccaggatatatgtgtatgttggcatgggcaaaatgaaatgcacacagtaaaaactgaacctactgtattacaaagggggttgggaaaagaaaagaaaggaaaagaaaaaagaaaagaacctaagtaaatttgggaaagaatattttgactatatgccatatggctaaagagaaaaataaccatacataaatattatactctaattggtaaatctgtttttcataggtgtatatgttagctatagtgacaactctttatgtgtatgctacagttgagtgaagaaatcaatatattgtggataataagagccaggttcctcacaaatgggaaaaggagaaggttagaatgaacctcatggtgtcaatatcaacttatgattttatatatatatatatatatatatatatatatatatacacacacacacacacacacagctggatataaatataagtaaatatagatatgtatattcatgcatgaatatacatgcatatactccctaggtctctctgctgagatggcttggaagcaatgacacgatagtagcaatgtgtgtacctagctcacaggtactgtattctaagtaccattctcccatttctccaataaaagtaatcaggacttcttagaaagatggctgagtctacgctgcggcagtaaaattatggtgccagaaagaaaaaagttactcaacaaggaattgtcaagatgccagagtatatatgcatatttgaacagtcacctggatctgattaagaaggctcagcctgtgggtttccttactgttgatttacatgtttggccagatttccatggcaaccggtctcccttagcagatctgacactaaagggcatgagaaccactggatatctgtatattccggctttggcagcgttgcactctcccagttctctactctcccctcaggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactga

SEQ ID NO: 11244 - DNA, 1498 bp, synthetic construct
  misc_feature 1..1498: note = Synthetic polypeptide
  source 1..1498: mol_type = other DNA
tacaggaagtttaaaccagaaaataataagattagttacctacagggggtgggtaggaatggggtggaaagaatgtgggaatgggaccatggtagtaggaagaaatgacacttctctgagtatacctttttatataactataactcttagaattattgtcatgcctcatgtccctgataccccgataaaataggtgatagataaccaggatatatgtgtatgttggcatgggcaaaatgaaatgcacacagtaaaaactgaacctactgtattacaaagggggttgggaaaagaaaagaaaggaaaagaaaaaagaaaagaacctaagtaaatttgggaaagaatattttgactatatgccatatggctaaagagaaaaataaccatacataaatattatactctaattggtaaatctgtttttcataggtgtatatgttagctatagtgacaactctttatgtgtatgctacagttgagtgaagaaatcaatatattgtggataataagagccaggttcctcacaaatgggaaaaggagaaggttagaatgaacctcatggtgtcaatatcaacttatgattttatatatatatatatatatatatatatatatatatacacacacacacacacacacagctggatataaatataagtaaatatagatatgtatattcatgcatgaatatacatgcatatactccctaggtctctctgctgagatggcttggaagcaatgacacgatagtagcaatgtgtgtacctagctcacaggtactgtattctaagtaccattctcccatttctccaataaaagtaatcaggacttcttagaaagatggctgagtctacgctgcggcagtaaaattatggtgccagaaagaaaaaagttactcaacaaggaattgtcaagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactga

SEQ ID NO: 11245 - DNA, 1366 bp, synthetic construct
  misc_feature 1..1366: note = Synthetic polypeptide
  source 1..1366: mol_type = other DNA
tacaggaagtttaaaccagaaaataataagattagttacctacagggggtgggtaggaatggggtggaaagaatgtgggaatgggaccatggtagtaggaagaaatgacacttctctgagtatacctttttatataactataactcttagaattattgtcatgcctcatgtccctgataccccgataaaataggtgatagataaccaggatatatgtgtatgttggcatgggcaaaatgaaatgcacacagtaaaaactgaacctactgtattacaaagggggttgggaaaagaaaagaaaggaaaagaaaaaagaaaagaacctaagtaaatttgggaaagaatattttgactatatgccatatggctaaagagaaaaataaccatacataaatattatactctaattggtaaatctgtttttcataggtgtatatgttagctatagtgacaactctttatgtgtatgctacagttgagtgaagaaatcaatatattgtggataataagagccaggttcctcacaaatgggaaaaggagaaggttagaatgaacctcatggtgtcaatatcaacttatgattttatatatatatatatatatatatatatatatatatacacacacacacacacacacagctggatataaatataagtaaatatagatatgtatattcatgcatgaatatacatgcatatactccctaggtctctctgctgagatggcttggaagcaatgacacgatagtagcaatgtgtgtacctagctcacaggtactgtattctaagtaccattctcccatttctccaataaaagtaatcaggacttcttagaaagatggctgagtctacgctgcggcagtaaaattatggtgccagaaagaaaaaagttactcaacaaggaattgtcaagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacagtgggggaaatag

SEQ ID NO: 11246 - DNA, 1044 bp, synthetic construct
  misc_feature 1..1044: note = Synthetic polypeptide
  source 1..1044: mol_type = other DNA
taatatggtttggctgtgtccccacttaaatctcatcttgaattcccacatgctgtgggagggacccagtgggaggtaattgaatcatgggggcaggtgtttcctgtgctgttctcgtgatagtgaataagtctcatgagatctggtggttttaaaaaggggaatttccctgcacaagctgtcttctcttgtctgccaccatgtgagatgtgcctttcatcttctgccatgattgtgaggcctccccacccacgcggaactgacctgaatgagaagttctacagcttcatgcagaagatggtcaaggagcactacaaaacctttgagaagggccacatccgggacatcacagacagcctgattgagcactgtcaggagaagcagctggatgagaacgccaatgtccagctgtcagatgagaagatcattaacatcgtcttggacctctttggagctgggtttgacacagtcacaactgctatctcctggagcctcatgtatttggtgatgaaccccagggtacagagaaagatccaagaggagctagacacagtgattggcaggtcacggcggccccggctctctgacagatcccatctgccctatatggaggccttcatcctggagaccttccgacactcttccttcgtccccttcaccatcccccacagcacaacaagagacacaagtttgaaaggcttttacatccccaaggggcgttgtgtctttgtaaaccagtggcagatcaaccatgaccagaagctatgggtcaacccatctgagttcctacctgaacggtttctcacccctgatggtgctatcgacaaggtgttaagtgagaaggtgattatctttggcatgggcaagcggaagtgtatcggtgagaccattgcccgctgggaggtctttctcttcctggctatcctgctgcaacgggtggaattcagcgtgccactgggcgtgaaggtggacatgacccccatctatgggctaaccatgaagcatgcctgctgtgagcacttccaaatgcagctgcgctcttag

SEQ ID NO: 11247 - DNA, 957 bp, synthetic construct
  misc_feature 1..957: note = Synthetic polypeptide
  source 1..957: mol_type = other DNA
taatatggtttggctgtgtccccacttaaatctcatcttgaattcccacatgctgtgggagggacccagtgggaggtaattgaatcatgggggcaggtgtttcctgtgctgttctcgtgatagtgaataagtctcatgagatctggtggttttaaaaaggggaatttccctgcacaagctgtcttctcttgtctgccaccatgtgagatgtgcctttcatcttctgccatgattgtgaggcctccccacccacgcggaactgacctgaatgagaagttctacagcttcatgcagaagatggtcaaggagcactacaaaacctttgagaagggccacatccgggacatcacagacagcctgattgagcactgtcaggagaagcagctggatgagaacgccaatgtccagctgtcagatgagaagatcattaacatcgtcttggacctctttggagctgggtttgacacagtcacaactgctatctcctggagcctcatgtatttggtgatgaaccccagggtacagagaaagatccaagaggagctagacacagtgattggcaggtcacggcggccccggctctctgacagatcccatctgccctatatggaggccttcatcctggagaccttccgacactcttccttcgtccccttcaccatcccccacaggaagctatgggtcaacccatctgagttcctacctgaacggtttctcacccctgatggtgctatcgacaaggtgttaagtgagaaggtgattatctttggcatgggcaagcggaagtgtatcggtgagaccattgcccgctgggaggtctttctcttcctggctatcctgctgcaacgggtggaattcagcgtgccactgggcgtgaaggtggacatgacccccatctatgggctaaccatgaagcatgcctgctgtgagcacttccaaatgcagctgcgctcttag

SEQ ID NO: 11248 - DNA, 268 bp, synthetic construct
  misc_feature 1..268: note = Synthetic polypeptide
  source 1..268: mol_type = other DNA
taatatggtttggctgtgtccccacttaaatctcatcttgaattcccacatgctgtgggagggacccagtgggaggtaattgaatcatgggggcaggtgtttcctgtgctgttctcgtgatagtgaataagtctcatgagatctggtggttttaaaaaggggaatttccctgcacaagctgtcttctcttgtctgccaccatgtgagatgtgcctttcatcttctgccatgattgtgaggcctccccacccacgcggaactgacctga

SEQ ID NO: 11249 - DNA, 1635 bp, synthetic construct
  misc_feature 1..1635: note = Synthetic polypeptide
  source 1..1635: mol_type = other DNA
gatctacttctggccaccagagctgtgagagaataaatttcagttgttttaagccacccaatttgaggatcagatttgcaagtatgtctccctaagggcccaacatgctgctcaagaaagatggaagaaaaataccaactaacagcacgattgaacatggaacagctgcttcagtctgcaagtatggagctcaagttcttaattattcagaatgctgcggttttccaagaggcctttgaaattgttgttcgccatgccaagaactacaccaatgccatgttcaagaacaactacccaagcctgactccacaagcttttgagtttgtgggtgaatttttcacagatgtgtctctctacatcttgggttctgacatcaatgtagatgacatggtcaatgaattgtttgacagcctgtttccagtcatctatacccagctaatgaacccaggcctgcctgattcagccttggacatcaatgagtgcctccgaggagcaagacgtgacctgaaagtatttgggaatttccccaagcttattatgacccaggtttccaagtcactgcaagtcactaggatcttccttcaggctctgaatcttggaattgaagtgatcaacacaactgatcacctgaagttcagtaaggactgtggccgaatgctcaccagaatgtggtactgctcttactgccagggactgatgatggttaaaccctgtggcggttactgcaatgtggtcatgcaaggctgtatggcaggtgtggtggagattgacaagtactggagagaatacattctgtcccttgaagaacttgtgaatggcatgtacagaatctatgacatggagaacgtactgcttggtctcttttcaacaatccatgattctatccagtatgtccagaagaatgcaggaaagctgaccaccactattggcaagttatgtgcccattctcaacaacgccaatatagatctgcttattatcctgaagatctctttattgacaagaaagtattaaaagttgctcatgtagaacatgaagaaaccttatccagccgaagaagggaactaattcagaagttgaagtctttcatcagcttctatagtgctttgcctggctacatctgcagccatagccctgtggcggaaaacgacaccctttgctggaatggacaagaactcgtggagagatacagccaaaaggcagcaaggaatggaatgaaaaaccagttcaatctccatgagctgaaaatgaagggccctgagccagtggtcagtcaaattattgacaaactgaagcacattaaccagctcctgagaaccatgtctatgcccaaaggtagagttctggataaaaacctggatgaggaagggtttgaaagtggagactgcggtgatgatgaagatgagtgcattggaggctctggtgatggaatgataaaagtgaagaatcagctccgcttccttgcagaactggcctatgatctggatgtggatgatgcgcctggaaacagtcagcaggcaactccgaaggacaacgagataagcacctttcacaacctcgggaacgttcattccccgctgaagcttctcaccagcatggccatctcggtggtgtgcttcttcttcctggtgcactga

SEQ ID NO: 11250 - DNA, 1704 bp, synthetic construct
  misc_feature 1..1704: note = Synthetic polypeptide
  source 1..1704: mol_type = other DNA
gatctacttctggccaccagagctgtgagagaataaatttcagttgttttaagccacccaatttgaggatcagatttgcaagtatgtctccctaagggcccaacatgctgctcaagaaagatggaagaaaaataccaactaacagcacgattgaacatggaacagctgcttcagtctgcaagtatggagctcaagttcttaattattcagaatgctgcggttttccaagaggcctttgaaattgttgttcgccatgccaagaactacaccaatgccatgttcaagaacaactacccaagcctgactccacaagcttttgagtttgtgggtgaatttttcacagatgtgtctctctacatcttgggttctgacatcaatgtagatgacatggtcaatgaattgtttgacagcctgtttccagtcatctatacccagctaatgaacccaggcctgcctgattcagccttggacatcaatgagtgcctccgaggagcaagacgtgacctgaaagtatttgggaatttccccaagcttattatgacccaggtttccaagtcactgcaagtcactaggatcttccttcaggctctgaatcttggaattgaagtgatcaacacaactgatcacctgaagttcagtaaggactgtggccgaatgctcaccagaatgtggtactgctcttactgccagggactgatgatggttaaaccctgtggcggttactgcaatgtggtcatgcaaggctgtatggcaggtgtggtggagattgacaagtactggagagaatacattctgtcccttgaagaacttgtgaatggcatgtacagaatctatgacatggagaacgtactgcttggtctcttttcaacaatccatgattctatccagtatgtccagaagaatgcaggaaagctgaccaccactgaaactgagaagaaaatatggcacttcaaatatcctatcttcttcctgtgtatagggctagacttacagattggcaagttatgtgcccattctcaacaacgccaatatagatctgcttattatcctgaagatctctttattgacaagaaagtattaaaagttgctcatgtagaacatgaagaaaccttatccagccgaagaagggaactaattcagaagttgaagtctttcatcagcttctatagtgctttgcctggctacatctgcagccatagccctgtggcggaaaacgacaccctttgctggaatggacaagaactcgtggagagatacagccaaaaggcagcaaggaatggaatgaaaaaccagttcaatctccatgagctgaaaatgaagggccctgagccagtggtcagtcaaattattgacaaactgaagcacattaaccagctcctgagaaccatgtctatgcccaaaggtagagttctggataaaaacctggatgaggaagggtttgaaagtggagactgcggtgatgatgaagatgagtgcattggaggctctggtgatggaatgataaaagtgaagaatcagctccgcttccttgcagaactggcctatgatctggatgtggatgatgcgcctggaaacagtcagcaggcaactccgaaggacaacgagataagcacctttcacaacctcgggaacgttcattccccgctgaagcttctcaccagcatggccatctcggtggtgtgcttcttcttcctggtgcactga

SEQ ID NO: 11251 - DNA, 852 bp, synthetic construct; identical to SEQ ID NO: 753
  misc_feature 1..852: note = Synthetic polypeptide
  source 1..852: mol_type = other DNA

SEQ ID NO: 11252 - DNA, 772 bp, synthetic construct
  misc_feature 1..772: note = Synthetic polypeptide
  source 1..772: mol_type = other DNA
ctgtctttgtccttgttcccaacagtgcattctctacatagcaggcacagtactctttttgaaactagttggattatgtcactattcactcaagacatccaatggctccccatctcaaatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgaccgacctggagttacccagagagatgagattgatcagctgcaagaggagatggcactgactctgcaaagctacatcaagggccagcagcgaaggccccgggatcgctcacctggaacaccctggatacactggagtgggaaaatgctgggaccaaagattgggccgggttcaaagggagcccagtggttgcaatga

SEQ ID NO: 11253 - DNA, 955 bp, synthetic construct
  misc_feature 1..955: note = Synthetic polypeptide
  source 1..955: mol_type = other DNA
ctgtctttgtccttgttcccaacagtgcattctctacatagcaggcacagtactctttttgaaactagttggattatgtcactattcactcaagacatccaatggctccccatctcaaatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtatctcccacagtggggttccaggtagagtttttggagttgctctttcacttccatggaacactacgaaaactgcagctccaagagcctgagtatgtgctcttggctgccatggccctcttctctcctgctccctatcttacagaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctga

SEQ ID NO: 11254 - DNA, 928 bp, synthetic construct
  misc_feature 1..928: note = Synthetic polypeptide
  source 1..928: mol_type = other DNA
ctgtctttgtccttgttcccaacagtgcattctctacatagcaggcacagtactctttttgaaactagttggattatgtcactattcactcaagacatccaatggctccccatctcaaatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtggggttccaggtagagtttttggagttgctctttcacttccatggaacactacgaaaactgcagctccaagagcctgagtatgtgctcttggctgccatggccctcttctctcctgaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctga

SEQ ID NO: 11255 - DNA, 889 bp, synthetic construct
  misc_feature 1..889: note = Synthetic polypeptide
  source 1..889: mol_type = other DNA
ctgtctttgtccttgttcccaacagtgcattctctacatagcaggcacagtactctttttgaaactagttggattatgtcactattcactcaagacatccaatggctccccatctcaaatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtggggttccaggtagagtttttggagttgctctttcacttccatggaacactacgaaaactgcagctccaagagcctgagtatgtgctcttggctgccatggccctcttctctcctgaccgacctggagttacccagagagatgagattgatcagctgcaagaggagatggcactgactctgcaaagctacatcaagggccagcagcgaaggccccgggatcgctcacctggaacaccctggatacactggagtgggaaaatgctgggaccaaagattgggccgggttcaaagggagcccagtggttgcaatga

SEQ ID NO: 11256 - DNA, 916 bp, synthetic construct
  misc_feature 1..916: note = Synthetic polypeptide
  source 1..916: mol_type = other DNA
ctgtctttgtccttgttcccaacagtgcattctctacatagcaggcacagtactctttttgaaactagttggattatgtcactattcactcaagacatccaatggctccccatctcaaatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtatctcccacagtggggttccaggtagagtttttggagttgctctttcacttccatggaacactacgaaaactgcagctccaagagcctgagtatgtgctcttggctgccatggccctcttctctcctgctccctatcttacagaccgacctggagttacccagagagatgagattgatcagctgcaagaggagatggcactgactctgcaaagctacatcaagggccagcagcgaaggccccgggatcgctcacctggaacaccctggatacactggagtgggaaaatgctgggaccaaagattgggccgggttcaaagggagcccagtggttgcaatga

SEQ ID NO: 11257 - DNA, 904 bp, synthetic construct
  misc_feature 1..904: note = Synthetic polypeptide
  source 1..904: mol_type = other DNA
ctgtctttgtccttgttcccaacagtgcattctctacatagcaggcacagtactctttttgaaactagttggattatgtcactattcactcaagacatccaatggctccccatctcaaatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtggggttccaggtagagtttttggagttgctctttcacttccatggaacactacgaaaactgcagctccaagagcctgagtatgtgctcttggctgccatggccctcttctctcctgctccctatcttacagaccgacctggagttacccagagagatgagattgatcagctgcaagaggagatggcactgactctgcaaagctacatcaagggccagcagcgaaggccccgggatcgctcacctggaacaccctggatacactggagtgggaaaatgctgggaccaaagattgggccgggttcaaagggagcccagtggttgcaatga

SEQ ID NO: 11258 - DNA, 901 bp, synthetic construct
  misc_feature 1..901: note = Synthetic polypeptide
  source 1..901: mol_type = other DNA
ctgtctttgtccttgttcccaacagtgcattctctacatagcaggcacagtactctttttgaaactagttggattatgtcactattcactcaagacatccaatggctccccatctcaaatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtatctcccacagtggggttccaggtagagtttttggagttgctctttcacttccatggaacactacgaaaactgcagctccaagagcctgagtatgtgctcttggctgccatggccctcttctctcctgaccgacctggagttacccagagagatgagattgatcagctgcaagaggagatggcactgactctgcaaagctacatcaagggccagcagcgaaggccccgggatcgctcacctggaacaccctggatacactggagtgggaaaatgctgggaccaaagattgggccgggttcaaagggagcccagtggttgcaatga

SEQ ID NO: 11259 - DNA, 940 bp, synthetic construct
  misc_feature 1..940: note = Synthetic polypeptide
  source 1..940: mol_type = other DNA
ctgtctttgtccttgttcccaacagtgcattctctacatagcaggcacagtactctttttgaaactagttggattatgtcactattcactcaagacatccaatggctccccatctcaaatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtatctcccacagtggggttccaggtagagtttttggagttgctctttcacttccatggaacactacgaaaactgcagctccaagagcctgagtatgtgctcttggctgccatggccctcttctctcctgaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctga

SEQ ID NO: 11260 - DNA, 793 bp, synthetic construct
  misc_feature 1..793: note = Synthetic polypeptide
  source 1..793: mol_type = other DNA
ctgtctttgtccttgttcccaacagtgcattctctacatagcaggcacagtactctttttgaaactagttggattatgtcactattcactcaagacatccaatggctccccatctcaaatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtatctcccacagtggggttccaggtagagtttttggagttgctctttcacttccatggaacactacgaaaactgcagctccaagagcctgagtatgtgctcttggctgccatggccctcttctctcctggtgagcacctcccaaagcccagagccttttgctgcaccacctctgcccaaatactcagctccttgagtccatccacccaggccttctag

SEQ ID NO: 11261 - DNA, 943 bp, synthetic construct
  misc_feature 1..943: note = Synthetic polypeptide
  source 1..943: mol_type = other DNA
ctgtctttgtccttgttcccaacagtgcattctctacatagcaggcacagtactctttttgaaactagttggattatgtcactattcactcaagacatccaatggctccccatctcaaatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtggggttccaggtagagtttttggagttgctctttcacttccatggaacactacgaaaactgcagctccaagagcctgagtatgtgctcttggctgccatggccctcttctctcctgctccctatcttacagaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctga

SEQ ID NO: 11262 - DNA, 811 bp, synthetic construct
  misc_feature 1..811: note = Synthetic polypeptide
  source 1..811: mol_type = other DNA
ctgtctttgtccttgttcccaacagtgcattctctacatagcaggcacagtactctttttgaaactagttggattatgtcactattcactcaagacatccaatggctccccatctcaaatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctga

SEQ ID NO: 11263 - DNA, 826 bp, synthetic construct
  misc_feature 1..826: note = Synthetic polypeptide
  source 1..826: mol_type = other DNA
ctgtctttgtccttgttcccaacagtgcattctctacatagcaggcacagtactctttttgaaactagttggattatgtcactattcactcaagacatccaatggctccccatctcaaatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgctccctatcttacagaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctga

SEQ ID NO: 11264 - DNA, 862 bp, synthetic construct
  misc_feature 1..862: note = Synthetic polypeptide
  source 1..862: mol_type = other DNA
ctgtctttgtccttgttcccaacagtgcattctctacatagcaggcacagtactctttttgaaactagttggattatgtcactattcactcaagacatccaatggctccccatctcaaatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtggggttccaggtagagtttttggagttgctctttcacttccatggaacactacgaaaactgcagctccaagagcctgagtatgtgctcttggctgccatggccctcttctctcctgaccgacctggagttacccagagagatgagattgatcagctgcaagaggagatggcactgactctgcaaagctacatcaagggccagcagcgaaggccccgggatcggtacggtgggacactgagggcttggaggccacaccagggcaggaaggggttggtgaaacattga

SEQ ID NO: 11265 - DNA, 598 bp, synthetic construct
  misc_feature 1..598: note = Synthetic polypeptide
  source 1..598: mol_type = other DNA
ctgtctttgtccttgttcccaacagtgcattctctacatagcaggcacagtactctttttgaaactagttggattatgtcactattcactcaagacatccaatggctccccatctcaaatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtggtgagatggtgctagagcaatag

SEQ ID NO: 11266 - DNA, 215 bp, synthetic construct
  misc_feature 1..215: note = Synthetic polypeptide
  source 1..215: mol_type = other DNA
cttaatcagggatcaagtttgtggttctagcagatcctaggcaagctggaatagattctcttctccgaaagatttatgagatttactcagactttgccctcaagaatccattctattccttagaaatgcctatcaggtgtgagctctttgaccagaacctgaagctagctctggaggtggcagagaaggctggaacttttggacctgggtcatag

SEQ ID NO: 11267 - DNA, 329 bp, synthetic construct
  misc_feature 1..329: note = Synthetic polypeptide
  source 1..329: mol_type = other DNA
cttaatcagggatcaagtttgtggttctagcagatcctaggcaagctggaatagattctcttctccgaaagatttatgagatttactcagactttgccctcaagaatccattctattccttagaaatgcctatcagagcgtgcagggggaaggccaccgtgggatggtgctccggaacctggactctcttcactcagccttcttggacactcggcccatcttggtgcggatgtttcgtaggaggaagaaggcagccgtgctggccgcacaaatcacttcagccacccagaaggctgtgctccaactgtagtgcttggcaatggtgctga

SEQ ID NO: 11268 - DNA, 40 bp, synthetic construct
  misc_feature 1..40: note = Synthetic polypeptide
  source 1..40: mol_type = other DNA
cttaatcagggatcaagtttgtggttctagcagatcctag

SEQ ID NO: 11269 - DNA, 369 bp, synthetic construct; identical to SEQ ID NO: 6492
  misc_feature 1..369: note = Synthetic polypeptide
  source 1..369: mol_type = other DNA

SEQ ID NO: 11270 - DNA, 1542 bp, synthetic construct
  misc_feature 1..1542: note = Synthetic polypeptide
  source 1..1542: mol_type = other DNA
gggtaaaagccagggaaagacagattttggctcagtatagtgaagactttggtaacttggcagcccaaaggttgaagggcagttgttagaatcagtgaatttttggccatcggaggtatgtattcgagcagaggctgggaaggcaggggagccttcagacatctgatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaa

SEQ ID NO: 11271 - DNA, 987 bp, synthetic construct
  misc_feature 1..987: note = Synthetic polypeptide
  source 1..987: mol_type = other DNA
gggtaaaagccagggaaagacagattttggctcagtatagtgaagactttggtaacttggcagcccaaaggttgaagggcagttgttagaatcagtgaatttttggccatcggaggtatgtattcgagcagaggctgggaaggcaggggagccttcagacatctgatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggtatggtccaagcctgaggctcctggcaccaccgggtgctgtcaagggaacaggccaagagcaccaggggcagggctgccactag

SEQ ID NO: 11272 - DNA, 273 bp, synthetic construct
  misc_feature 1..273: note = Synthetic polypeptide
  source 1..273: mol_type = other DNA
gggtaaaagccagggaaagacagattttggctcagtatagtgaagactttggtaacttggcagcccaaaggttgaagggcagttgttagaatcagtgaatttttggccatcggaggtatgtattcgagcagaggctgggaaggcaggggagccttcagacatctgatcaagcgtttcctggaggacaccacggatgatggagaactgagcaagatgacaaggagtatgtgggctttgcaaccctccccaaccaagtccaccgaaagtccgtga

SEQ ID NO: 11273 - DNA, 767 bp, synthetic construct
  misc_feature 1..767: note = Synthetic polypeptide
  source 1..767: mol_type = other DNA
gggtaaaagccagggaaagacagattttggctcagtatagtgaagactttggtaacttggcagcccaaaggttgaagggcagttgttagaatcagtgaatttttggccatcggaggtatgtattcgagcagaggctgggaaggcaggggagccttcagacatctgatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtg

SEQ ID NO: 11274 - DNA, 379 bp, synthetic construct
  misc_feature 1..379: note = Synthetic polypeptide
  source 1..379: mol_type = other DNA
gggtaaaagccagggaaagacagattttggctcagtatagtgaagactttggtaacttggcagcccaaaggttgaagggcagttgttagaatcagtgaatttttggccatcggaggtatgtattcgagcagaggctgggaaggcaggggagccttcagacatctgatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagt

SEQ ID NO: 11275 - DNA, 361 bp, synthetic construct
  misc_feature 1..361: note = Synthetic polypeptide
  source 1..361: mol_type = other DNA
acagaaaaccagaggccccgatgtaatcctgggtctgccttcatctttctgtgtggccttaggactggactcgggccatatccgtggtgccgtcaacatgcctttcatggacttcctgactgaggatggcttcgagaagggcccagaagagctccgtgctctgttccagaccaagaaggtggatctctcgcagcctctcattgccacgtgccgcaagggagtcaccgcctgccacgtggccttggctgcctacctctgcggcaagcctgatgtggccgtgtacgatggctcctggtccgagtggtttcgccgggcccccccagagagccgtgtgtcccagggaaagtctgagaaggcctga

SEQ ID NO: 11276 - DNA, 444 bp, synthetic construct
  misc_feature 1..444: note = Synthetic polypeptide
  source 1..444: mol_type = other DNA
tcccggttcaaaaccaccacttgctggttgaggagtcgtcagtaagtggctgcgcccccaccctgaggcttgtttctccatctgtacaatggaaatgatgaagatgcccacctgatagggtttttgtggcaaataacatgccagccagaggcccaggaaggaaccctgagccccccaccaaagctaaagatgagtcgctggagcctggtgaggggcaggatgaaggagctgctggagacagtggtgaacaggaccagagacgggtggcaatggttctggagcccgagcaccttccggggcttcatgcagacctactatgacgaccacctgagggacctgggtccgctcaccaaggcctggttcctcgaatccaaagacagcctcttgaagaagacccacagcctgtgccccaggcttgtctgtggggacaaggaccagggttaa

SEQ ID NO: 11277 - DNA, 597 bp, synthetic construct
  misc_feature 1..597: note = Synthetic polypeptide
  source 1..597: mol_type = other DNA
tcccggttcaaaaccaccacttgctggttgaggagtcgtcagtaagtggctgcgcccccaccctgaggcttgtttctccatctgtacaatggaaatgatgaagatgcccacctgatagggtttttgtggcaaataacatgccagccagaggcccaggaaggaaccctgagccccccaccaaagctaaagatgagtcgctggagcctggtgaggggcaggatgaaggagctgctggagacagtggtgaacaggaccagagacgggtggcaatggttctggtctctggacactatgggcacacgactcctcccagctctgtttcttgtcctcctggtattgggatttgaggtccaggggacccaacagccccagcaagatgagatgcctagcccgaccttcctcacccaggtgaaggaatctctctccagttactgggagtcagcaaagacagccgcccagaacctgtacgagaagacatacctgcccgctgtagatgagaaactcagggacttgtacagcaaaagcacagcagccatgagcacttacacaggcatttttactgaccaagttctttctgtgctgaagggagaggagtaa

SEQ ID NO: 11278 - DNA, 282 bp, synthetic construct
  misc_feature 1..282: note = Synthetic polypeptide
  source 1..282: mol_type = other DNA
tcccggttcaaaaccaccacttgctggttgaggagtcgtcagtaagtggctgcgcccccaccctgaggcttgtttctccatctgtacaatggaaatgatgaagatgcccacctgatagggtttttgtggcaaataacatgccagccagaggcccaggaaggaaccctgagccccccaccaaagctaaagatgagtcgctggagcctggtgaggggcaggatgaaggagctgctggagacagtggtgaacaggaccagagacgggtggcaatggttctggtga

SEQ ID NO: 11279 - DNA, 784 bp, synthetic construct; identical to SEQ ID NO: 6798
  misc_feature 1..784: note = Synthetic polypeptide
  source 1..784: mol_type = other DNA

SEQ ID NO: 11280 - DNA, 1530 bp, synthetic construct
  misc_feature 1..1530: note = Synthetic polypeptide
  source 1..1530: mol_type = other DNA
gctgggcacgatggttctcacctgcaatcccagcactttaggaggccaagacaggaggatcgcttgaggccaggaattcaaggcaacacggtgcacctgggaactggagacccctacacacctggcttcccttccttcaatcaaacccagttccctccagttgcatcatcaggccttcccagcatcccagcccagcccatcagtgcagacattgcctcccgcctgctgaggaagctcaaaggccctgtggccccccaagaatggcaggggagcctcctaggctccccttatcacctgggccccgggccacgactgcggctagtggtcaacaatcacaggacctccacccccatcaacaacatcttcggctgcatcgaaggccgctcagagccagatcactacgttgtcatcggggcccagagggatgcatggggcccaggagcagctaaatccgctgtggggacggctatactcctggagctggtgcggaccttttcctccatggtgagcaacggcttccggccccgcagaagtctcctcttcatcagctgggacggtggtgactttggaagcgtgggctccacggagtggctagagggctacctcagcgtgctgcacctcaaagccgtagtgtacgtgagcctggacaacgcagtgctgggggatgacaagtttcatgccaagaccagcccccttctgacaagtctcattgagagtgtcctgaagcaggtggattctcccaaccacagtgggcagactctctatgaacaggtggtgttcaccaatcccagctgggatgctgaggtgatccggcccctacccatggacagcagtgcctattccttcacggcctttgtgggagtccctgccgtcgagttctcctttatggaggacgaccaggcctacccattcctgcacacaaaggaggacacttatgagaacctgcataaggtgctgcaaggccgcctgcccgccgtggcccaggccgtggcccagctcgcagggcagctcctcatccggctcagccacgatcgcctgctgcccctcgacttcggccgctacggggacgtcgtcctcaggcacatcgggaacctcaacgagttctctggggacctcaaggcccgcgggctgaccctgcagtgggtgtactcggcgcggggggactacatccgggcggcggaaaagctgcggcaggagatctacagctcggaggagagagacgagcgactgacacgcatgtacaacgtgcgcataatgcgggtggagttctacttcctttcccagtacgtgtcgccagccgactccccgttccgccacatcttcatgggccgtggagaccacacgctgggcgccctgctggaccacctgcggctgctgcgctccaacagctccgggacccccggggccacctcctccactggcttccaggagagccgtttccggcgtcagctagccctgctcacctggacgctgcaaggggcagccaatgcgcttagcggggatgtctggaacattgataacaacttctga

SEQ ID NO: 11281 - DNA, 378 bp, synthetic construct
  misc_feature 1..378: note = Synthetic polypeptide
  source 1..378: mol_type = other DNA
gctgggcacgatggttctcacctgcaatcccagcactttaggaggccaagacaggaggatcgcttgaggccaggaattcaaggcaacacggtgcacctgggaactggagacccctacacacctggcttcccttccttcaatcaaacccagttccctccagttgcatcatcaggccttcccagcatcccagcccagcccatcagtgcagacattgcctcccgcctgctgaggctggagtgcagtggtgcaatcttggctcactgcaacctccacctcccgggttcaagtgattcttctgcctcagactccagagtatctaggattacaggaagctcaaaggccctgtggccccccaagaatggcaggggagcctcctag

SEQ ID NO: 11282 - DNA, 1327 bp, synthetic construct; identical to SEQ ID NO: 6801
  misc_feature 1..1327: note = Synthetic polypeptide
  source 1..1327: mol_type = other DNA

SEQ ID NO: 11283 - DNA, 183 bp, synthetic construct
  misc_feature 1..183: note = Synthetic polypeptide
  source 1..183: mol_type = other DNA
ccgctcccttcctgtgtgcgcctggcaaggtacttcaaacacagtgatggcagcttctccaacaagcagtggatcttcttctggtttggcctggctgatatccgggactcctatgagttggtcaaccacgccaagggactgccagactcctttcacaagccagcttctgacccaggcagctga

SEQ ID NO: 11284 - DNA, 535 bp, synthetic construct; identical to SEQ ID NO: 10018
  misc_feature 1..535: note = Synthetic polypeptide
  source 1..535: mol_type = other DNA

SEQ ID NO: 11285 - DNA, 686 bp, synthetic construct
  misc_feature 1..686: note = Synthetic polypeptide
  source 1..686: mol_type = other DNA
tgatattgtttggctctgtccccacccgaatctcacatggaattttcagccccatgtgttggaggcgggtcctgctgggaggtgattgtatcacggggctggtttctaatggtttagccccacctcccaggtgctgtttctcacaaggtctcattgtttaaaagtgtgtagcacctcccccttcgctctgtctctcctgctgtcttgtgaagaagggacttgcttcctctttgccttccaccatgattgtaagtttcctgaggcctcccagccatgcttcctctgaagcctgcggaactacagaggacacgatctttctcagagagtaccagacccgccagaaccagtgcttctataactccagttacctgaatgtccagcgggagaatgggaccgtctccagatacgagggaggccgagaacatgttgctcacctgctgttccttagggacaccaagaccttgatgtttggttcctacctggacgatgagaagaactgggggctgtctttctatgctgacaagccagagacgaccaaggagcaactgggagagttctacgaagctctcgactgcttgtgcattcccaggtcagatgtcatgtacaccgactggaaaaaggataagtgtgagccactggagaagcagcacgagaaggagaggaaacaggaggagggggaatcctag

SEQ ID NO: 11286 - DNA, 1206 bp, synthetic construct
  misc_feature 1..1206: note = Synthetic polypeptide
  source 1..1206: mol_type = other DNA
gagctgtaagttccacaaggatggggaccacatctgcccttatgtttgcccagcacctagcccaatgcttggctcaaattagcatatcgcacggatgactgccatccctgggttttgccagtagtgaagaaagtggagcagaagattgctaatgacaatagcctaaatcacgagtatctgccaatcctgggcctggctgagttccggagctgtgcttctcgtcttgcccttggggatgacagcccagcactcaaggagaagcgggtaggaggtgtgcaatctttggggggaacaggtgcacttcgaattggagctgatttcttagcgcgttggtacaatggaacaaacaacaagaacacacctgtctatgtgtcctcaccaacctgggagaatcacaatgctgtgttttccgctgctggttttaaagacattcggtcctatcgctactgggatgcagagaagagaggattggacctccagggcttcctgaatgatctggagaatgctcctgagttctccattgttgtcctccacgcctgtgcacacaacccaactgggattgacccaactccggagcagtggaagcagattgcttctgtcatgaagcaccggtttctgttccccttctttgactcagcctatcagggcttcgcatctggaaacctggagagagatgcctgggccattcgctattttgtgtctgaaggcttcgagttcttctgtgcccagtccttctccaagaacttcgggctctacaatgagagagtcgggaatctgactgtggttggaaaagaacctgagagcatcctgcaagtcctttcccagatggagaagatcgtgcggattacttggtccaatccccccgcccagggagcacgaattgtggccagcaccctctctaaccctgagctctttgaggaatggacaggtaatgtgaagacaatggctgaccggattctgaccatgagatctgaactcagggcacgactagaagccctcaaaacccctgggacctggaaccacatcactgatcaaattggcatgttcagcttcactgggttgaaccccaagcaggttgagtatctggtcaatgaaaagcacatctacctgctgccaagtggtcgaatcaacgtgagtggcttaaccaccaaaaatctagattacgtggccacctccatccatgaagcagtcaccaaaatccagtga

SEQ ID NO: 11287 - DNA, 494 bp, synthetic construct; identical to SEQ ID NO: 10040
  misc_feature 1..494: note = Synthetic polypeptide
  source 1..494: mol_type = other DNA

SEQ ID NO: 11288 - DNA, 804 bp, synthetic construct; identical to SEQ ID NO: 10041
  misc_feature 1..804: note = Synthetic polypeptide
  source 1..804: mol_type = other DNA

SEQ ID NO: 11289 - DNA, 1911 bp, synthetic construct; identical to SEQ ID NO: 10042
  misc_feature 1..1911: note = Synthetic polypeptide
  source 1..1911: mol_type = other DNA

SEQ ID NO: 11290 - DNA, 531 bp, synthetic construct; identical to SEQ ID NO: 10043
  misc_feature 1..531: note = Synthetic polypeptide
  source 1..531: mol_type = other DNA

SEQ ID NO: 11291 - DNA, 1288 bp, synthetic construct
  misc_feature 1..1288: note = Synthetic polypeptide
  source 1..1288: mol_type = other DNA
gaaagcagctgggagggaggctgtaccctgcaaagccacagaggcagcgctgcccaagaccatgggaacccacctcttgcatcagtgtgacttggatatgagacctggagtcaaaggaggtcattttggagctttaaaatttgattgccttgctggattttggacttgcctgggccctgaaactcctttgttttggccaatttctcctggaatggctgtatgtacctaatacctgtacccgcattgtatctaggaagtaactgacttgttttttattttacaggctcatgggtggaagggacttgacttgtctcagatgagactttggactgtggacttttggattaattctgaaatgagagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatgagaaccactggatatctgtatattccggctttggcagcgttgcactctcccagttctctactctcccctcaggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactga

SEQ ID NO: 11292 - DNA, 1216 bp, synthetic construct
  misc_feature 1..1216: note = Synthetic polypeptide
  source 1..1216: mol_type = other DNA
gaaagcagctgggagggaggctgtaccctgcaaagccacagaggcagcgctgcccaagaccatgggaacccacctcttgcatcagtgtgacttggatatgagacctggagtcaaaggaggtcattttggagctttaaaatttgattgccttgctggattttggacttgcctgggccctgaaactcctttgttttggccaatttctcctggaatggctgtatgtacctaatacctgtacccgcattgtatctaggaagtaactgacttgttttttattttacaggctcatgggtggaagggacttgacttgtctcagatgagactttggactgtggacttttggattaattctgaaatgagagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactga

SEQ ID NO: 11293 - DNA, 1084 bp, synthetic construct
  misc_feature 1..1084: note = Synthetic polypeptide
  source 1..1084: mol_type = other DNA
gaaagcagctgggagggaggctgtaccctgcaaagccacagaggcagcgctgcccaagaccatgggaacccacctcttgcatcagtgtgacttggatatgagacctggagtcaaaggaggtcattttggagctttaaaatttgattgccttgctggattttggacttgcctgggccctgaaactcctttgttttggccaatttctcctggaatggctgtatgtacctaatacctgtacccgcattgtatctaggaagtaactgacttgttttttattttacaggctcatgggtggaagggacttgacttgtctcagatgagactttggactgtggacttttggattaattctgaaatgagagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacagtgggggaaatag

SEQ ID NO: 11294 - DNA, 1819 bp, synthetic construct
  misc_feature 1..1819: note = Synthetic polypeptide
  source 1..1819: mol_type = other DNA
tgatatggttcagttgtgtctccacccaaatcccatcttgaattgtaatccccataatccccacgtgtcatgggagggacctggtgggaggtgattggatcatgggagcagtttcccccatgctgctctcgtgatagtgagtgagttctcacgagatctgatggttttataagcgtctgtcatttcccctgctaatgctcattctcctgccaccctgtgaagaggagccttccaccatgattgtaagtttcctgaggcctctccagccatgaggaactctgagaaacatgctggagtttcctgcgttacagcctcagtggatgacatacagtttgaggagacagctagagttggacaagttataaccatcaaagcaaaagttactagagcattcagcacaagcatggagatcagtatcaaggtcatggtacaggatatgctcactggcattgagaagcttgttagtgtggctttctccacatttgtagccaaaccagttggaaaagaaaagattcatttaaaaccagtcacacttctaactgaacaagatcatgtggaacataatctggctgctgagagaaggaaagttcgattacaacatgaagatacctttaacaatttaatgaaggaaagtagcaaatttgatgatctcatttttgatgaagaggaaggagcggtttccacaaggggcacctccgttcagagcattgaactggtcctcccaccccatgcaaaccatcacggaaatacatttggtggccagattatggcgtggatggagacagtggctactatttctgcaagccgcctgtgttgggctcatccctttctgaagtccgtagatatgtttaagttccggggaccatctacagttggagatcgtcttgtcttcactgccattgtcaacaatacatttcagacctgtgttgaagttggagttcgcgtggaggcctttgactgtcaggaatgggccgagggccgagggcgtcacatcaacagtgcttttctcatttacaatgctgctgatgataaggaaaatctcatcacgtttcccagaatccaacccatttcaaaggatgatttcagacgctatcggggagctattgcacgcaagcgaattcgcctaggcagaaaatatgttatttcccacaaagaagaggttccactttgcatacactgggatatcagcaagcaggcatccctgagtgacagcaatgtggaggccctcaaaaaactggcagccaaaaggggttgggaggttaccagcactgtggaaaagataaaaatatatactctggaagagcatgatgttttatctgtttgggttgaaaagcacgtgggaagtccagcacatttggcttatcgtctcttgtctgactttacaaagcgacctttgtgggacccccattttgtgtcctgtgaagtcatagactgggtgagtgaagatgatcagctgtatcacatcacctgtcctatactgaatgatgacaaacccaaagacttggtagtactcgtatcacgaagaaaacccctcaaagatggtaacacttacacagtggcagtgaagtcggtcattttgccatcggtccccccgtctccacagtacatcagaagtgaaatcatatgtgccggatttctcatccatgctattgacagcaattcatgcatcgtatcttactttaaccatatgtctgctagcatccttccttactttgctggaaatcttggtggctggtcaaaatccattgaagaaacagcagcctcttgtatacagttcttagagaatcctcctgatgatgggtttgtaagcacattttaa

SEQ ID NO: 11295 - DNA, 655 bp, synthetic construct
  misc_feature 1..655: note = Synthetic polypeptide
  source 1..655: mol_type = other DNA
tgatatggttcagttgtgtctccacccaaatcccatcttgaattgtaatccccataatccccacgtgtcatgggagggacctggtgggaggtgattggatcatgggagcagtttcccccatgctgctctcgtgatagtgagtgagttctcacgagatctgatggttttataagcgtctgtcatttcccctgctaatgctcattctcctgccaccctgtgaagaggagccttccaccatgattgtaagtttcctgaggcctctccagccatgaggaactctgagaaacatgctggagtttcctgcgttacagcctcagtggatgacatacagtttgaggagacagctagagttggacaagttataaccatcaaagcaaaagttactagagcattcagcacaagcatggagatcagtatcaaggtcatggtacaggatatgctcactggcattgagaagcttgttagtgtggctttctccacatttgtagccaaaccagttggaaaagaaaagattcatttaaaaccagtcacacttctaactgaacaagatcatgtggaacataatctggctgctgagagaaggaaagttcgattacaacatgaagatacctttaacaatttaatgaaggaaagtagcaaatttgatggtcagtaa

SEQ ID NO: 11296 - DNA, 1232 bp, synthetic construct; identical to SEQ ID NO: 6566
  misc_feature 1..1232: note = Synthetic polypeptide
  source 1..1232: mol_type = other DNA

SEQ ID NO: 11297 - DNA, 497 bp, synthetic construct; identical to SEQ ID NO: 6567
  misc_feature 1..497: note = Synthetic polypeptide
  source 1..497: mol_type = other DNA

SEQ ID NO: 11298 - DNA, 575 bp, synthetic construct; identical to SEQ ID NO: 6568
  misc_feature 1..575: note = Synthetic polypeptide
  source 1..575: mol_type = other DNA

SEQ ID NO: 11299 - DNA, 928 bp, synthetic construct
  misc_feature 1..928: note = Synthetic polypeptide
  source 1..928: mol_type = other DNA
ggctgggcgcggtggctcacgcctgtaaatcccagcactgtgggatgccgaggcgggtggatcacgaggtcaagagatcaagaccatcctggctaaaacggttctggaggacacgtgccggcggcaggacttcaacccctgtgaatatgatctgaagtttcagaggagcgtgctcgacctttctctccagtggagatttgccaacctgcccaacaatgccaagctggagatggtgcccgcttcccggagccgtgaggggcctgagaacatggttcgcatcgctttgcagctggacgatggctcgaggttgcaggactctttctgttcaggccagaccctctgggagcttctcagccattttccacagatcagggagtgcctgcagcaccccggcggggccaccccagtctgcgtgtacacgagggatgaggtgacgggtgaagctgccctgcggggcacgacgctgcagtcgctgggcctgaccgggggcagcgccaccatcaggtttgtcatgaagtgctacgaccccgtgggcaagaccccaggaagcctgggctcgtcagcgtcggctggccaggcagccgccagcgctccacttcccttggaatctggggagctcagccgcggcgacttgagccgtccggaggacgcggacacctcagggccctgctgcgagcacactcaggagaagcagagcacaagggcacccgcagctgccccctttgttcctttctcgggtgggggacagagactggggggccctcctgggcccacgaggcctctgacatcatcttcagctaagttgccgaagtccctctccagccctggaggcccctccaagccaaagaagtccaagtcgggccaggatccccagcaggagcaggagcaggagcgggagcgggatccccagcaggagcaggagcgggag

SEQ ID NO: 11300 - DNA, 1942 bp, synthetic construct
  misc_feature 1..1942: note = Synthetic polypeptide
  source 1..1942: mol_type = other DNA
ggctgggcgcggtggctcacgcctgtaaatcccagcactgtgggatgccgaggcgggtggatcacgaggtcaagagatcaagaccatcctggctaaaacggttctggaggacacgtgccggcggcaggacttcaacccctgtgaatatgatctgaagtttcagaggagcgtgctcgacctttctctccagtggagatttgccaacctgcccaacaatgccaagctggagatggtgcccgcttcccggagccgtgaggggcctgagaacatggttcgcatcgctttgcagctggacgatggctcgaggttgcaggactctttctgttcaggccagaccctctgggagcttctcagccattttccacagatcagggagtgcctgcagcaccccggcggggccaccccagtctgcgtgtacacgagggatgaggtgacgggtgaagctgccctgcggggcacgacgctgcagtcgctgggcctgaccgggggcagcgccaccatcaggtttgtcatgaagtgctacgaccccgtgggcaagaccccaggaagcctgggctcgtcagcgtcggctggccaggcagccgccagcgctccacttcccttggaatctggggagctcagccgcggcgacttgagccgtccggaggacgcggacacctcagggccctgctgcgagcacactcaggagaagcagagcacaagggcacccgcagctgccccctttgttcctttctcgggtgggggacagagactggggggccctcctgggcccacgaggcctctgacatcatcttcagctaagttgccgaagtccctctccagccctggaggcccctccaagccaaagaagtccaagtcgggccaggatccccagcaggagcaggagcaggagcgggagcgggatccccagcaggagcaggagcgggagcggcccgtggaccgggagcccgtggaccgggagccggtggtgtgccaccccgacctggaggagcggctgcaggcctggccagcggagctgcctgatgagttctttgagctgacggtggacgacgtgagaagacgcttggcccagctcaagagtgagcggaagcgcctggaagaagcccccttggtgaccaaggccttcagggaggcgcagataaaggagaagctggagcgctacccaaaggtggctctgagggtcctgttccccgaccgctacgtcctacagggcttcttccgccccagcgagacagtgggggacttgcgagacttcgtgaggagccacctggggaaccccgagctgtcattttacctgttcatcacccctccaaaaacagtcctggacgaccacacgcagaccctctttcagccccagcttggtgaccgggtggctccattcaccctgggtccctcgctgaaacggtgcctgggaccagagcagagaacacgcttgccagtggtaggagatggaggcgacgtggactctgggaggcttcttttttggggtccatccagaggccgagcctctccaagcactggtcagcctccatgccacccagtctgccgaccctcctctccaccatcccctcgtccgagcagtggcgatccctcccgagtcaaggctgggcacaagcacgtggggacaggccgggcgaacctcttcccggccgctctggtgcacttgggagccgaggagccggcaggtgtctacctggagcctggcctgctggagcatgccatctccccatctgcggccgatgtgctggtggccaggtacatgtccagggccgccgggtccccttccccattgccagcccctgaccctgcacctaagtctgagccagctgctgaggagggggcgctggtcccccctgagcccatcccagggacggcccagcccgtgaagaggagcctgggcaaggtgcccaagtggctgaagctgccggccagcaagaggtga

SEQ ID NO: 11301 - DNA, 1660 bp, synthetic construct
  misc_feature 1..1660: note = Synthetic polypeptide
  source 1..1660: mol_type = other DNA
ggctgggcgcggtggctcacgcctgtaaatcccagcactgtgggatgccgaggcgggtggatcacgaggtcaagagatcaagaccatcctggctaaaacggttctggaggacacgtgccggcggcaggacttcaacccctgtgaatatgatctgaagtttcagaggagcgtgctcgacctttctctccagtggagatttgccaacctgcccaacaatgccaagctggagatggtgcccgcttcccggagccgtgaggggcctgagaacatggttcgcatcgctttgcagctggacgatggctcgaggttgcaggactctttctgttcaggccagaccctctgggagcttctcagccattttccacagatcagggagtgcctgcagcaccccggcggggccaccccagtctgcgtgtacacgagggatgaggtgacgggtgaagctgccctgcggggcacgacgctgcagtcgctgggcctgaccgggggcagcgccaccatcaggtttgtcatgaagtgctacgaccccgtgggcaagaccccaggaagcctgggctcgtcagcgtcggctggccaggcagccgccagcgctccacttcccttggaatctggggagctcagccgcggcgacttgagccgtccggaggacgcggacacctcagggccctgctgcgagcacactcaggagaagcagagcacaagggcacccgcagctgccccctttgttcctttctcgggtgggggacagagactggggggccctcctgggcccacgaggcctctgacatcatcttcagctaagttgccgaagtccctctccagccctggaggcccctccaagccaaagaagtccaagtcgggccaggatccccagcaggagcaggagcaggagcgggagcgggatccccagcaggagcaggagcgggagcggcccgtggaccgggagcccgtggaccgggagccggtggtgtgccaccccgacctggaggagcggctgcaggcctggccagcggagctgcctgatgagttctttgagctgacggtggacgacgtgagaagacgcttggcccagctcaagagtgagcggaagcgcctggaagaagcccccttggtgaccaaggccttcagggaggcgcagataaaggagaagctggagcgctacccaaaggtggctctgagggtcctgttccccgaccgctacgtcctacagggcttcttccgccccagcgagacagtgggggacttgcgagacttcgtgaggagccacctggggaaccccgagctgtcattttacctgttcatcacccctccaaaaacagtcctggacgaccacacgcagaccctctttcaggcgaacctcttcccggccgctctggtgcacttgggagccgaggagccggcaggtgtctacctggagcctggcctgctggagcatgccatctccccatctgcggccgatgtgctggtggccaggtacatgtccagggccgccgggtccccttccccattgccagcccctgaccctgcacctaagtctgagccagctgctgaggagggggcgctggtcccccctgagcccatcccagggacggcccagcccgtgaagaggagcctgggcaaggtgcccaagtggctgaagctgccggccagcaagaggtga

SEQ ID NO: 11302 - DNA, 175 bp, synthetic construct
  misc_feature 1..175: note = Synthetic polypeptide
  source 1..175: mol_type = other DNA
ggctgggcgcggtggctcacgcctgtaaatcccagcactgtgggatgccgaggcgggtggatcacgaggtcaagagatcaagaccatcctggctaaaacggttctggaggacacgtgccggcggcaggacttcaacccctgtgaatatgatctgaaatgcccctgggctgtctga

SEQ ID NO: 11303 - DNA, 547 bp, synthetic construct
  misc_feature 1..547: note = Synthetic polypeptide
  source 1..547: mol_type = other DNA
ggctgggcgcggtggctcacgcctgtaaatcccagcactgtgggatgccgaggcgggtggatcacgaggtcaagagatcaagaccatcctggctaaaacggttctggaggacacgtgccggcggcaggacttcaacccctgtgaatatgatctgaagtttcagaggagcgtgctcgacctttctctccagtggagatttgccaacctgcccaacaatgccaagctggagatggtgcccgcttcccggagccgtgaggggcctgagaacatggttcgcatcgctttgcagctggacgatggctcgaggttgcaggactctttctgttcaggccagaccctctgggagcttctcagccattttccacagatcagggagtgcctgcagcaccccggcggggccaccccagtctgcgtgtacacgagggatgaggtaggcggcctgctcttgctcacccagtccccgctcactttcagcccactttccaactggaaaatctgctgtcccgcagccgtctccagggcagtggcgggagactcgggctcttga

SEQ ID NO: 11304 - DNA, 481 bp, synthetic construct
  misc_feature 1..481: note = Synthetic polypeptide
  source 1..481: mol_type = other DNA
ggctgggcgcggtggctcacgcctgtaaatcccagcactgtgggatgccgaggcgggtggatcacgaggtcaagagatcaagaccatcctggctaaaacggttctggaggacacgtgccggcggcaggacttcaacccctgtgaatatgatctgaagtttcagaggagcgtgctcgacctttctctccagtggagatttgccaacctgcccaacaatgccaagctggagatggtgcccgcttcccggagccgtgaggggcctgagaacatggttcgcatcgctttgcagctggacgatggctcgaggttgcaggactctttctgttcaggccagaccctctgggagcttctcagccattttccacagatcagcccgtggaccgggagcccgtggaccgggagccggtggtgtgccaccccgacctggaggagcggctgcaggcctggccagcggagctgcctgatgagttctttgagctga

SEQ ID NO: 11305 - DNA, 620 bp, synthetic construct
  misc_feature 1..620: note = Synthetic polypeptide
  source 1..620: mol_type = other DNA
ggctgggcgcggtggctcacgcctgtaaatcccagcactgtgggatgccgaggcgggtggatcacgaggtcaagagatcaagaccatcctggctaaaacggttctggaggacacgtgccggcggcaggacttcaacccctgtgaatatgatctgaagtttcagaggagcgtgctcgacctttctctccagtggagatttgccaacctgcccaacaatgccaagctggagatggtgcccgcttcccggagccgtgaggggcctgagaacatggttcgcatcgctttgcagctggacgatggctcgaggttgcaggactctttctgttcaggccagaccctctgggagcttctcagccattttccacagatcagggagtgcctgcagcaccccggcggggccaccccagtctgcgtgtacacgagggatgagccgtctccagggcagtggcgggagactcgggctcttgaaagcacgacgtgtttcatggaaaaagagggagtggccggccctcggagcccgggctgccccgaaacctccctcggcgccctgtttgttttttcagcttctctcaaagcccaagagtcacaaaagtggtttcatttaataaatatttgctttg

SEQ ID NO: 11306 - DNA, 995 bp, synthetic construct
  misc_feature 1..995: note = Synthetic polypeptide
  source 1..995: mol_type = other DNA
tcaagactaagatattcactcaaatgtacaattccacagaaattgaataacctgctcctgaatggcttttgggtaaataatgatattaaggcagaaataaagaaaatgagaacaaagatacaacatactggaatctctggggcacaggaatattaatgcaaaaatgccgtaataaagtcatgaaaaactatggaagatactatattgctgcgtcctatgtaaagtacttggagtctgcaggtgcgagagttgtaccagtaaggctggatcttacagagaaagactatgaaatacttttcaaatctattaatggaatccttttccctggaggaagtgttgacctcagacgctcagattatgctaaagtggccaaaatattttataacttgtccatacagagttttgatgatggagactattttcctgtgtggggcacatgccttggatttgaagagctttcactgctgattagtggagagtgcttattaactgccacagatactgttgacgtggcaatgccgctgaacttcactggaggtcaattgcacagcagaatgttccagaattttcctactgagttgttgctgtcattagcagtagaacctctgactgccaatttccataagtggagcctctccgtgaagaattttacaatgaatgaaaagttaaagaagtttttcaatgtcttaactacaaatacagatggcaagattgagtttatttcaacaatggaaggatataagtatccagtatatggtgtccagtggcatccagagaaagcaccttatgagtggaagaatttggatggcatttcccatgcacctaatgctgtgaaaaccgcattttatttagcagagttttttgttaatgaagctcggaaaaacaaccatcattttaaatctgaatctgaagaggagaaagcattgatttatcagttcagtccaatttatactggaaatatttcttcatttcagcaatgttacatatttgattga

SEQ ID NO: 11307 - DNA, 916 bp, synthetic construct; identical to SEQ ID NO: 7516
  misc_feature 1..916: note = Synthetic polypeptide
  source 1..916: mol_type = other DNA

SEQ ID NO: 11308 - DNA, 157 bp, synthetic construct; identical to SEQ ID NO: 7517
  misc_feature 1..157: note = Synthetic polypeptide
  source 1..157: mol_type = other DNA

SEQ ID NO: 11309 - DNA, 424 bp, synthetic construct; identical to SEQ ID NO: 7518
  misc_feature 1..424: note = Synthetic polypeptide
  source 1..424: mol_type = other DNA

SEQ ID NO: 11310 - DNA, 675 bp, synthetic construct; identical to SEQ ID NO: 7519
  misc_feature 1..675: note = Synthetic polypeptide
  source 1..675: mol_type = other DNA

SEQ ID NO: 11311 - DNA, 732 bp, synthetic construct
  misc_feature 1..732: note = Synthetic polypeptide
  source 1..732: mol_type = other DNA
tacttcaaaggacaccacgaagaaagtgaaagtacaacccacagattgggagacaattactgtaaatcattaatctaataataagggacttgtatctggaatatataaagaactcttacaactcaataacaaaaagacaaattatcccagcaacaactggcaaagggttcgaaaagatatttctccaaggacgatatacaagtggccaatagcacatgaaaagaagctcaacattattactcaccaggtgactgcaaatcaaagccgcatgaggatgaacgtgaagccagagaaaatgtgaagagagagcaagatgaggcctatcgcctttcacttgaggctgacagagcaaagagggaagctcacgagagagagatggcagaacagtttcgtttggagcagattcgcaaagaacaagaagaggaacgtgaggccatccggctgtccttagagcaagccctgcctcctgagccaaaggaagaaaatgctgagcctgtgagcaaactgcggatccggacccccagtggcgagttcttggagcggcgtttcctggccagcaacaagctccagattgtctttgattttgtagcttccaaaggatttccatgggatgagtacaagttactgagcacctttcctaggagagacgtaactcaactggacccaaataaatcattattggaggtaaagttgttccctcaagaaacccttttccttgaagcaaaagagtaa

SEQ ID NO: 11312 - DNA, 756 bp, synthetic construct
  misc_feature 1..756: note = Synthetic polypeptide
  source 1..756: mol_type = other DNA
tacttcaaaggacaccacgaagaaagtgaaagtacaacccacagattgggagacaattactgtaaatcattaatctaataataagggacttgtatctggaatatataaagaactcttacaactcaataacaaaaagacaaattatcccagcaacaactggcaaagggttcgaaaagatatttctccaaggacgatatacaagtggccaatagcacatgaaaagaagctcaacattattactcaccaggtgactgcaaatcaaagccgcatgaggatgaacgtgaagccagagaaaatgtgaagagagagcaagatgaggcctatcgcctttcacttgaggctgacagagcaaagagggaagctcacgagagagagatggcagaacagtttcgtttggagcagattcgcaaagaacaagaagaggaacgtgaggccatccggctgtccttagagcaagccctgcctcctgagccaaaggaagaaaatgctgagcctgtgagcaaactgcggatccggacccccagtggcgagttcttggagcggcgtttcctggccagcaacaagctccagattgtctttgattttgtagcttccaaaggatttccatgggatgagtacaagttactgagcacctttcctaggagagacattccaggactttccaggatggggaaacatgcctgttctcgttctttgtatattcattttatgttctttattctcattctgaagacttggatcatctcctgtttttag

SEQ ID NO: 11313 - DNA, 455 bp, synthetic construct
  misc_feature 1..455: note = Synthetic polypeptide
  source 1..455: mol_type = other DNA
tcccggttcaaaaccaccacttgctggttgaggagtcgtcagtaagtggctgcgcccccaccctgaggcttgtttctccatctgtacaatggaaatgatgaagatgcccacctgatagggtttttgtggcaaataagtctctggacactatgggcacacgactcctcccagctctgtttcttgtcctcctggtattgggatttgaggtccaggggacccaacagccccagcaagatgagatgcctagcccgaccttcctcacccaggtgaaggaatctctctccagttactgggagtcagcaaagacagccgcccagaacctgtacgagaagacatacctgcccgctgtagatgagaaactcagggacttgtacagcaaaagcacagcagccatgagcacttacacaggcatttttactgaccaagttctttctgtgctgaagggagaggagtaa

SEQ ID NO: 11314 - DNA, 108 bp, synthetic construct
  misc_feature 1..108: note = Synthetic polypeptide
  source 1..108: mol_type = other DNA
gccgagcacggtggctcacacctgtaaccccaccactttggaaggccgagggagtggttttcagagacatttcagaaagtgaaggagaaactcaagattgactcatga

SEQ ID NO: 11315 - DNA, 87 bp, synthetic construct
  misc_feature 1..87: note = Synthetic polypeptide
  source 1..87: mol_type = other DNA
gccgagcacggtggctcacacctgtaaccccaccactttggaaggccgagggagtggttttcagagacatttcagaaagtgaaggag

SEQ ID NO: 11316 - DNA, 101 bp, synthetic construct
  misc_feature 1..101: note = Synthetic polypeptide
  source 1..101: mol_type = other DNA
gccgagcacggtggctcacacctgtaaccccaccactttggaaggccgagggagtggttttcagagacatttcagaaagtgaaggagaaactcaagattga

SEQ ID NO: 11317 - DNA, 82 bp, synthetic construct
  misc_feature 1..82: note = Synthetic polypeptide
  source 1..82: mol_type = other DNA
gccgagcacggtggctcacacctgtaaccccaccactttggaaggccgagggagtggttttcagagacatttcagaaagtga

SEQ ID NO: 11318 - DNA, 1131 bp, synthetic construct
  misc_feature 1..1131: note = Synthetic polypeptide
  source 1..1131: mol_type = other DNA
aagagccggggctttggagattatcagaactgggcctcgtcctagctcaggaatttggttatgttatcagctgggtaagtaagttactcaaccttgctgatcttagcttcctgagctgtgaagaggaaggcaattacaataatggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgtgttttccagagcacagaagtgaaacacgtgaccaaggtagaatggatattttcaggacggcgcgcaaaggaggagattgtatttcgttactaccacaaactcaggatgtctgtggagtactcccagagctggggccacttccagaatcgtgtgaacctggtgggggacattttccgcaatgacggttccatcatgcttcaaggagtgagggagtcagatggaggaaactacacctgcagtatccacctagggaacctggtgttcaagaaaaccattgtgctgcatgtcagcccggaagagcctcgaacactggtgaccccggcagccctgaggcctctggtcttgggtggtaatcagttggtgatcattgtgggaattgtctgtgccacaatcctgctgctccctgttctgatattgatcgtgaagaagacctgtggaaataagagttcagtgaattctacagtcttggtgaagaacacgaagaagactaatccagagataaaagaaaaaccctgccattttgaaagatgtgaaggggagaaacacatttactccccaataattgtacgggaggtgatcgaggaagaagaaccaagtgaaaaatcagaggccacctacatgaccatgcacccagtttggccttctctgaggtcagatcggaacaactcacttgaaaaaaagtcaggtgggggaatgccaaaaacacagcaagccttttga

SEQ ID NO: 11319 - DNA, 1098 bp, synthetic construct
  misc_feature 1..1098: note = Synthetic polypeptide
  source 1..1098: mol_type = other DNA
aagagccggggctttggagattatcagaactgggcctcgtcctagctcaggaatttggttatgttatcagctgggtaagtaagttactcaaccttgctgatcttagcttcctgagctgtgaagaggaaggcaattacaataatggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgtgttttccagagcacagaagtgaaacacgtgaccaaggaggagattgtatttcgttactaccacaaactcaggatgtctgtggagtactcccagagctggggccacttccagaatcgtgtgaacctggtgggggacattttccgcaatgacggttccatcatgcttcaaggagtgagggagtcagatggaggaaactacacctgcagtatccacctagggaacctggtgttcaagaaaaccattgtgctgcatgtcagcccggaagagcctcgaacactggtgaccccggcagccctgaggcctctggtcttgggtggtaatcagttggtgatcattgtgggaattgtctgtgccacaatcctgctgctccctgttctgatattgatcgtgaagaagacctgtggaaataagagttcagtgaattctacagtcttggtgaagaacacgaagaagactaatccagagataaaagaaaaaccctgccattttgaaagatgtgaaggggagaaacacatttactccccaataattgtacgggaggtgatcgaggaagaagaaccaagtgaaaaatcagaggccacctacatgaccatgcacccagtttggccttctctgaggtcagatcggaacaactcacttgaaaaaaagtcaggtgggggaatgccaaaaacacagcaagccttttga

SEQ ID NO: 11320 - DNA, 981 bp, synthetic construct
  misc_feature 1..981: note = Synthetic polypeptide
  source 1..981: mol_type = other DNA
aagagccggggctttggagattatcagaactgggcctcgtcctagctcaggaatttggttatgttatcagctgggtaagtaagttactcaaccttgctgatcttagcttcctgagctgtgaagaggaaggcaattacaataatggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgtgttttccagagcacagaagtgaaacacgtgaccaaggtagaatggatattttcaggacggcgcgcaaaggaggagattgtatttcgttactaccacaaactcaggatgtctgtggagtactcccagagctggggccacttccagaatcgtgtgaacctggtgggggacattttccgcaatgacggttccatcatgcttcaaggagtgagggagtcagatggaggaaactacacctgcagtatccacctagggaacctggtgttcaagaaaaccattgtgctgcatgtcagcccggaagagcctcgaacactggtgaccccggcagccctgaggcctctggtcttgggtggtaatcagttggtgatcattgtgggaattgtctgtgccacaatcctgctgctccctgttctgatattgatcgtgaagaagacctgtggaaataagagttcagtgaattctacagtcttggtgaagaacacgaagaagactaatccagagataaaagaaaaaccctgccattttgaaagatgtgaaggggaggtgaacacacgcttcagcctaaaacactaa

SEQ ID NO: 11321 - DNA, 425 bp, synthetic construct
  misc_feature 1..425: note = Synthetic polypeptide
  source 1..425: mol_type = other DNA
aagagccggggctttggagattatcagaactgggcctcgtcctagctcaggaatttggttatgttatcagctgggtaagtaagttactcaaccttgctgatcttagcttcctgagctgtgaagaggaaggcaattacaataatggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgtgttttccagagcac

SEQ ID NO: 11322 - DNA, 239 bp, synthetic construct
  misc_feature 1..239: note = Synthetic polypeptide
  source 1..239: mol_type = other DNA
aagagccggggctttggagattatcagaactgggcctcgtcctagctcaggaatttggttatgttatcagctgggtaagtaagttactcaaccttgctgatcttagcttcctgagctgtgaagaggaaggcaattacaataatggacgaatatgtgctatactattactccaatctcagtgtgcctattgggcgcttccagaaccgcgtacacttgatgggggacatcttatgcaatga

SEQ ID NO: 11323 - DNA, 411 bp, synthetic construct
  misc_feature 1..411: note = Synthetic polypeptide
  source 1..411: mol_type = other DNA
aagagccggggctttggagattatcagaactgggcctcgtcctagctcaggaatttggttatgttatcagctgggtaagtaagttactcaaccttgctgatcttagcttcctgagctgtgaagaggaaggcaattacaataatggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgt

SEQ ID NO: 11324 - DNA, 942 bp, synthetic construct; identical to SEQ ID NO: 10396
  misc_feature 1..942: note = Synthetic polypeptide
  source 1..942: mol_type = other DNA

SEQ ID NO: 11325 - DNA, 390 bp, synthetic construct; identical to SEQ ID NO: 10397
  misc_feature 1..390: note = Synthetic polypeptide
  source 1..390: mol_type = other DNA

SEQ ID NO: 11326 - DNA, 206 bp, synthetic construct; identical to SEQ ID NO: 10398
  misc_feature 1..206: note = Synthetic polypeptide
  source 1..206: mol_type = other DNA

SEQ ID NO: 11327 - DNA, 483 bp, synthetic construct; identical to SEQ ID NO: 10399
  misc_feature 1..483: note = Synthetic polypeptide
  source 1..483: mol_type = other DNA

SEQ ID NO: 11328 - DNA, 978 bp, synthetic construct; identical to SEQ ID NO: 10400
  misc_feature 1..978: note = Synthetic polypeptide
  source 1..978: mol_type = other DNA

SEQ ID NO: 11329 - DNA, 897 bp, synthetic construct; identical to SEQ ID NO: 10401
  misc_feature 1..897: note = Synthetic polypeptide
  source 1..897: mol_type = other DNA

SEQ ID NO: 11330 - DNA, 660 bp, synthetic construct; identical to SEQ ID NO: 10402
  misc_feature 1..660: note = Synthetic polypeptide
  source 1..660: mol_type = other DNA

SEQ ID NO: 11331 - DNA, 576 bp, synthetic construct; identical to SEQ ID NO: 10403
  misc_feature 1..576: note = Synthetic polypeptide
  source 1..576: mol_type = other DNA

SEQ ID NO: 11332 - DNA, 639 bp, synthetic construct; identical to SEQ ID NO: 10404
  misc_feature 1..639: note = Synthetic polypeptide
  source 1..639: mol_type = other DNA

SEQ ID NO: 11333 - DNA, 7888 bp, synthetic construct
  misc_feature 1..7888: note = Synthetic polypeptide
  source 1..7888: mol_type = other DNA
aatttggtggcccatacagggaaaacattgtcctccgggaaagggtctttgatcacctcttgtgaggagacacatcccactgccttgttgcagtggcctcatgagtaaggaatcgagacccacctggtctgatgaataaccccagactctcaacaacgtggggagaaaaagacttgcaacactatggtggccaggtaactctgtgcgcagaccaaggtaagaaatgtcgcaggagtgacaaagtacttccttggtggtcactatattctggtggctgaaagttcatgaatggtaacaagtgctactgctgtgtggagtgaatgagtccaatctgtgggtctatggttacctcatacggcttagccttctctgaaggatcctgatgttggggtttatatagtcctcccaatgctaagcgggacttaaaatattcctaggaggaaagtggccagagtggatgaagcaaaaggagaagagtgtgaagaacctccaggaggtggggctaaaagataggcaagaaatctctaatacgagggattgagccacagaaagctccagacagataaaaaagaaattcctaatatgaggaactgagccacagcaagcctccagcaggcaacaaatccctaatatgagggattgagcctagctaagacccaatatgggaaataccccaagaaagacagagaataagaaggatgaaaatagtaacaaggatataccccttgatagtcccctaggtttcatgttaaaatactggaaagataatgagaggactaagcataagaagaaggagcaaatgataaaatattgctgtttcatttggacccaaggtcccatcctcaaaccctcaatcttctggccaaagtatgggtcgaatgagggtgtaatgagtcaactcctaatccaatatgttaatgataaaagtctggtttctcaagaagaactagactatgctctttgttggaagcagggacctgtcctcctctttcccttaaagacaactagggaagaatccgatccagcatctcaaattgagaagtcagacaagccgactcccacacctaaagtcagcacatgggatcccctagactgtcttcctttgcttactgccccaatcctaacccccctactcctcaggcagctgctgctgccccagatcccatcccagattcttccccaactcatgatgttcctcccgcttacaaccctgactctcaggggcagtcgtcccaagagcctgttcattgccaacctaaatatccttccttaaaagggctccaacatgaaatagagcagtgtaaaaaggacattcagaactccccttttctttccacacctaaggagtcagccataactttcttccctttaaaaggggtatcacaaggaggggaagtcattggttttgtaaatgctctcttgactatttcagaagtctgaggtctgaagaaagaacttaagccactgctagatgacccctatggagtggcagatcaagttgatcaattcttaggacctcagttatacacttgggtcgagcaaatgtctatcctaggcatcttcttttcaggggaggaaagaagcatgatccgtagggctgctatggcaatttgggaacatgaacaccctcctggtcaaaacgttcctactgtggaccaaacatttgctgcccaagcaagactcctggtgggacaacagcaatgcagcccactgagaaaacatgcaggacctaagggaaataataataaaaggaatcagtgaatccatacccagaactcaaaagctctctaaagcatttgatatacaacaggagaaagatgagggacctataagattcctagacagactaaaggagcaaatgaagcaatatacaggtctgaatttagaagatccccttgggcaaaggatgttaaagatccattttgtcactaaaggctggccagatgtttcaaaaaagttacaaaaattggaggactgagaaaaccgacctctaagagaacttctcagagaagctcaaaaggtgtatgtgaggagggacagggaaaaacaaaaacagaagtcaaaaccaatgttatctactttccagcaggtggctccaaacccatatgctactaaatgaggcttccagggagccagaaactataaaaggtcccaagcctcccaaacccagtttagagaaaccaaaccttcagctagaggacccaagtctacatttcccaggccccctaaagagcatagaaaagcaagaccaaaaaatcccaaaactgagagaggggaaggacaagataagtgttacaaatgtggaaggacagcccccttcaaaagagaatgtcccaaattagaaaaggagagagaagcccttccactcacgacctttgaagaggaacagggaagtcaggggctctgtctatattatcttgagtcccaccaggagcccttgataaatttggaggtgggacctacacatgagcttatcacatttttggttgattcaggagcggcctgttcctctgtttgtttcccctcatctaatgttgcctgctcttcagaagaacttatagtctctgagataaaaggggaaggatttacggtgagaatcttagaaaatacagaagtcaagtaccaagactaaacaacccaggttcaatttttgttaatccctgaagcagcaactagtttgttaggaagagacttaatgttaaagttaggcataggcctacaagtcagcccaaagggattccttacttcattaaacttactcaccacggcggatgagaaatacattcatcctgatgtttggtcaagggaagaaaactgaggaaagcttcgaattctcccaatccacatcaagctaaacaccccgcactgggaagtagtgaggaggaagcaattccccattcccttagagggcatgctagggctaaaacctataattgaaagtctcattaatgatgggcttcttgaaccctgtatgtctccttataacaccccaatactgcctgtcaaaaaatcagatgggtcataccggctggtgaaagacctcagagccattaaccaaacagtccagaccactaaccctgttgtccccaacccttacaccattctcagcaaaattccatataatcatcaatggtttactgtaatagatttaaaggatgctttttgggcatgtccctggctgaagagagccgagacacatttgcctttgagtgggaagatccccagttagggtgaaaacaatggtatcaatggacagtcttgcctcaggggttcatggattcacccaacctttttggtcaaattttagaacaagtgctagacaaagtttctgttccaaaacaattatgcctgcttcaatatgtcgatgatattctcatatctggtgaggatatagagaaagaagctggcttctctacacatatttttgaccatctacagttcgaggggttacgggtctcaaagggaaagcttcagtgtatggagcctaaagttaaatatttaggccgcttaataagtgcgggcaagcgaaggatagggcctgaatgggtcgaaggaatcgtgtccttacccttgcctcagactaaacaggaactcaggaaatttttagggttagttggatactgccgcttaaggattaactcacatgccctaaacagtaaacttttataccaaaaacttgcccagggaaaacctgagcatctcctgtggacttctaaagaggtcgatcaggtcaaagagctaaaaggaatagcttataactgctcttgccctagccttaccttccctagaaaatacacttcaccttttcgtcagcgtgaaaaatggggtggctttaggggtgcttatccaagagcacagaggctgctggcagcccatggccttcctgtcaaaaattttggacctggtcacctgtggatggcctcagtgcatccaatccattgcagctacagcagtattagttgaagagagtagaaaattaacctttgggtggagattaacagtaagcacaccccaccaagttagagagctattttaaataaaaaagcaggaaggtgactaactgactccagaatcttaaaatatggggctattctactaaaaaaagatgagagaacacctatgtctagatttaattgactaccaaacaaaactcaggccagatctaggaaagatccctttcaaaacaggacggcacttatttatagatggttcctcccagctgattgagggaaaaagacacaacgggtatccagtaatcgatggagaaattctctatgtataagaacagagtcaagaaaattgcctaataattggtctgcccaaacttgtgaactgtttgcactcagccaagccttaaagcacttgcaaaaccaggaaggaaccatctatactgattctaagtatgcctttggagtggctcatacatttggaaaaagttggactgaatgtggcctcactaatagtaaaggtcatgaccttgttcataaggagttaatcatccaagtactggataaccttcagttgccagaagaaatagctattgtccgtgtacccgggcaccagaaaagcctttcttttgaaagtcgaggaaataacctaacaaaccagatagccaaacaagctgctgtttcctccgaaacacctatgtttcacttaactccttgtcttccttcccctactgcaatttcctttttctcttccattgaaaaagaagaataaagataggagccaaaggagaagaccagaatgaaaacggctgttactagaccaaaaggaaatgttatccaagcccgttatgtggaagatctagtctcaactatatctgaggacacactggggatcccaagccatgtgcgatgcagttctcagggtctatggatgtataagaatttacaccctagccaaacaagttacagatagttgcttaatatgtaaaaagactagtaagcagattctaagaaaaccgccccttggagaaagagattcagggctaagaccatttccaagtgttcaattaattatactgaaatgcccccaattggtcatttaaaatacttattagtaataatagaccactttacctactgggtagagactatcccacactcaaatgcaaccaccagtaacgtagttaaggcattaattgaaaacattgtacccagatttggactaatacaaagcactgattcagacaatggaacccatttcactgcatatgtcattaaaaagttagcccaggtactagacataaaatggaaaaaccatatcccttggcatctctcctcctcaagaagagtagaaaggatgaatcagactctaaaaagccacttaactaaattagttctagaaacttgattgccatggactaaatgtcttcctattgccttgttaagaatccgaactgctcctcagagagatactggcctttccccttatgagatgctctatggattgccctatttatactccactgctaacattcctacattcaaaataaaagatcagttcctcaaaaattatatacttggtccatactctactttctcttcccttaagactaaaggtctcctagcacaggcgccaccgctggagtttccagcacattagcgtcagcctggagaccatgtcctcataaaagggtggaaggaaggcaaactcaaaccagcttgggaaggaccctacttggtgctcctaaatactaagactgcagtccgaacagcagaatgaggatggactgatcacacccgcgtcaaaaaggcgctgccacctccaggatcataaaccgtcactccagggctcaccccaaccaaattaactctaaaaagggcttaataatcacttgtttattttttcttttctttccaacagaaggtcatcttgtcatcaatgtaacttgggctaaccatcctttaatccttcagtttgatgcttgttcagtcatcctgtgtggagacaagcaagctcaaaggaagctgtctcatgtagataagtacctatgtccataccataaaaagtcaaccaagtataagtatagaaccttaaaaagtccctgtggtgactggacagatgtttggaaaccactcagtatggagggtggacagccaggccccctttttcaaataagttatggggactaaaacagaaactccaactaattcatggtcccaccccaccaaactgtaagccactgcagtgtaacccctcattgctaattatagctaacccccaaacaatggcccaagaacccactatattcaaacagtatggattaggagcaaatgttacaaaacaaaatcccataaaaatcttcaaccactggttaacaatgataattaaaaaaaaatccacacccagagtctgggaaacgagtggaatctaacactctctccaagtatagcgagctcagcgtcctcctcccatctccaaaacaacccaactaaagtaacggttgtaaaggtaaaaaatttaaagcagactatagccctagagacaggatgtcaagatgcaaatgcttggctaaaatggattaaatattccatctgcactttaaacaaatatgaatgttatgcttgtgctcacggtagaccagaggcccagattgtcccctttccactcagatggtcttctaactgaccgggcataagctgtatggtagttctcttccaagatcacacagcctggggtgacaaatcatgtcaagctctttctctgctgttccctgaagctcaacaccctgagggtcagcccccgagggccatcagcttccgtttcccaatgccaattttactttgtgtctctcacaacagggagaaaacttggtgttccttggagccttaatgggatgcatgacctgggagctgtcatttccctcctgctctggggacgacagctttttgcactgtactcaggcaatgatgtcacggatatttcagatgaccgcttcccgaagccccctgagattgcaaatggctatgtggagcacttgtttcgctaccagtgtaagaactactacagactgcgcacagaaggagatggagtatacaccttaaatgataagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggggccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggtggttctacaccctaactaccaccaggtagatattgggctcatcaaactcaaacagaaggtgcttgttaatgagagagtgatgcccatctgcctaccttcaaagaattatgcagaagtagggcgtgtgggttacgtgtctggctggggacaaagtgacaactttaaacttactgaccatctgaagtatgtcatgctgcctgtggctgaccaatacgattgcataacgcattatgaaggcagcacatgccccaaatggaaggcaccgaagagccctgtaggggtgcagcccatactgaacgaacacaccttctgtgtcggcatgtctaagtaccaggaagacacctgctatggcgatgcgggcagtgcctttgccgttcacgacctggaggaggacacctggtacgcggctgggatcctaagctttgataagagctgtgctgtggctgagtatggtgtgtatgtgaaggtgacttccatccagcactgggttcagaagaccatagctgagaactaa

SEQ ID NO: 11334 - DNA, 7195 bp, synthetic construct
  misc_feature 1..7195: note = Synthetic polypeptide
  source 1..7195: mol_type = other DNA
aatttggtggcccatacagggaaaacattgtcctccgggaaagggtctttgatcacctcttgtgaggagacacatcccactgccttgttgcagtggcctcatgagtaaggaatcgagacccacctggtctgatgaataaccccagactctcaacaacgtggggagaaaaagacttgcaacactatggtggccaggtaactctgtgcgcagaccaaggtaagaaatgtcgcaggagtgacaaagtacttccttggtggtcactatattctggtggctgaaagttcatgaatggtaacaagtgctactgctgtgtggagtgaatgagtccaatctgtgggtctatggttacctcatacggcttagccttctctgaaggatcctgatgttggggtttatatagtcctcccaatgctaagcgggacttaaaatattcctaggaggaaagtggccagagtggatgaagcaaaaggagaagagtgtgaagaacctccaggaggtggggctaaaagataggcaagaaatctctaatacgagggattgagccacagaaagctccagacagataaaaaagaaattcctaatatgaggaactgagccacagcaagcctccagcaggcaacaaatccctaatatgagggattgagcctagctaagacccaatatgggaaataccccaagaaagacagagaataagaaggatgaaaatagtaacaaggatataccccttgatagtcccctaggtttcatgttaaaatactggaaagataatgagaggactaagcataagaagaaggagcaaatgataaaatattgctgtttcatttggacccaaggtcccatcctcaaaccctcaatcttctggccaaagtatgggtcgaatgagggtgtaatgagtcaactcctaatccaatatgttaatgataaaagtctggtttctcaagaagaactagactatgctctttgttggaagcagggacctgtcctcctctttcccttaaagacaactagggaagaatccgatccagcatctcaaattgagaagtcagacaagccgactcccacacctaaagtcagcacatgggatcccctagactgtcttcctttgcttactgccccaatcctaacccccctactcctcaggcagctgctgctgccccagatcccatcccagattcttccccaactcatgatgttcctcccgcttacaaccctgactctcaggggcagtcgtcccaagagcctgttcattgccaacctaaatatccttccttaaaagggctccaacatgaaatagagcagtgtaaaaaggacattcagaactccccttttctttccacacctaaggagtcagccataactttcttccctttaaaaggggtatcacaaggaggggaagtcattggttttgtaaatgctctcttgactatttcagaagtctgaggtctgaagaaagaacttaagccactgctagatgacccctatggagtggcagatcaagttgatcaattcttaggacctcagttatacacttgggtcgagcaaatgtctatcctaggcatcttcttttcaggggaggaaagaagcatgatccgtagggctgctatggcaatttgggaacatgaacaccctcctggtcaaaacgttcctactgtggaccaaacatttgctgcccaagcaagactcctggtgggacaacagcaatgcagcccactgagaaaacatgcaggacctaagggaaataataataaaaggaatcagtgaatccatacccagaactcaaaagctctctaaagcatttgatatacaacaggagaaagatgagggacctataagattcctagacagactaaaggagcaaatgaagcaatatacaggtctgaatttagaagatccccttgggcaaaggatgttaaagatccattttgtcactaaaggctggccagatgtttcaaaaaagttacaaaaattggaggactgagaaaaccgacctctaagagaacttctcagagaagctcaaaaggtgtatgtgaggagggacagggaaaaacaaaaacagaagtcaaaaccaatgttatctactttccagcaggtggctccaaacccatatgctactaaatgaggcttccagggagccagaaactataaaaggtcccaagcctcccaaacccagtttagagaaaccaaaccttcagctagaggacccaagtctacatttcccaggccccctaaagagcatagaaaagcaagaccaaaaaatcccaaaactgagagaggggaaggacaagataagtgttacaaatgtggaaggacagcccccttcaaaagagaatgtcccaaattagaaaaggagagagaagcccttccactcacgacctttgaagaggaacagggaagtcaggggctctgtctatattatcttgagtcccaccaggagcccttgataaatttggaggtgggacctacacatgagcttatcacatttttggttgattcaggagcggcctgttcctctgtttgtttcccctcatctaatgttgcctgctcttcagaagaacttatagtctctgagataaaaggggaaggatttacggtgagaatcttagaaaatacagaagtcaagtaccaagactaaacaacccaggttcaatttttgttaatccctgaagcagcaactagtttgttaggaagagacttaatgttaaagttaggcataggcctacaagtcagcccaaagggattccttacttcattaaacttactcaccacggcggatgagaaatacattcatcctgatgtttggtcaagggaagaaaactgaggaaagcttcgaattctcccaatccacatcaagctaaacaccccgcactgggaagtagtgaggaggaagcaattccccattcccttagagggcatgctagggctaaaacctataattgaaagtctcattaatgatgggcttcttgaaccctgtatgtctccttataacaccccaatactgcctgtcaaaaaatcagatgggtcataccggctggtgaaagacctcagagccattaaccaaacagtccagaccactaaccctgttgtccccaacccttacaccattctcagcaaaattccatataatcatcaatggtttactgtaatagatttaaaggatgctttttgggcatgtccctggctgaagagagccgagacacatttgcctttgagtgggaagatccccagttagggtgaaaacaatggtatcaatggacagtcttgcctcaggggttcatggattcacccaacctttttggtcaaattttagaacaagtgctagacaaagtttctgttccaaaacaattatgcctgcttcaatatgtcgatgatattctcatatctggtgaggatatagagaaagaagctggcttctctacacatatttttgaccatctacagttcgaggggttacgggtctcaaagggaaagcttcagtgtatggagcctaaagttaaatatttaggccgcttaataagtgcgggcaagcgaaggatagggcctgaatgggtcgaaggaatcgtgtccttacccttgcctcagactaaacaggaactcaggaaatttttagggttagttggatactgccgcttaaggattaactcacatgccctaaacagtaaacttttataccaaaaacttgcccagggaaaacctgagcatctcctgtggacttctaaagaggtcgatcaggtcaaagagctaaaaggaatagcttataactgctcttgccctagccttaccttccctagaaaatacacttcaccttttcgtcagcgtgaaaaatggggtggctttaggggtgcttatccaagagcacagaggctgctggcagcccatggccttcctgtcaaaaattttggacctggtcacctgtggatggcctcagtgcatccaatccattgcagctacagcagtattagttgaagagagtagaaaattaacctttgggtggagattaacagtaagcacaccccaccaagttagagagctattttaaataaaaaagcaggaaggtgactaactgactccagaatcttaaaatatggggctattctactaaaaaaagatgagagaacacctatgtctagatttaattgactaccaaacaaaactcaggccagatctaggaaagatccctttcaaaacaggacggcacttatttatagatggttcctcccagctgattgagggaaaaagacacaacgggtatccagtaatcgatggagaaattctctatgtataagaacagagtcaagaaaattgcctaataattggtctgcccaaacttgtgaactgtttgcactcagccaagccttaaagcacttgcaaaaccaggaaggaaccatctatactgattctaagtatgcctttggagtggctcatacatttggaaaaagttggactgaatgtggcctcactaatagtaaaggtcatgaccttgttcataaggagttaatcatccaagtactggataaccttcagttgccagaagaaatagctattgtccgtgtacccgggcaccagaaaagcctttcttttgaaagtcgaggaaataacctaacaaaccagatagccaaacaagctgctgtttcctccgaaacacctatgtttcacttaactccttgtcttccttcccctactgcaatttcctttttctcttccattgaaaaagaagaataaagataggagccaaaggagaagaccagaatgaaaacggctgttactagaccaaaaggaaatgttatccaagcccgttatgtggaagatctagtctcaactatatctgaggacacactggggatcccaagccatgtgcgatgcagttctcagggtctatggatgtataagaatttacaccctagccaaacaagttacagatagttgcttaatatgtaaaaagactagtaagcagattctaagaaaaccgccccttggagaaagagattcagggctaagaccatttccaagtgttcaattaattatactgaaatgcccccaattggtcatttaaaatacttattagtaataatagaccactttacctactgggtagagactatcccacactcaaatgcaaccaccagtaacgtagttaaggcattaattgaaaacattgtacccagatttggactaatacaaagcactgattcagacaatggaacccatttcactgcatatgtcattaaaaagttagcccaggtactagacataaaatggaaaaaccatatcccttggcatctctcctcctcaagaagagtagaaaggatgaatcagactctaaaaagccacttaactaaattagttctagaaacttgattgccatggactaaatgtcttcctattgccttgttaagaatccgaactgctcctcagagagatactggcctttccccttatgagatgctctatggattgccctatttatactccactgctaacattcctacattcaaaataaaagatcagttcctcaaaaattatatacttggtccatactctactttctcttcccttaagactaaaggtctcctagcacaggcgccaccgctggagtttccagcacattagcgtcagcctggagaccatgtcctcataaaagggtggaaggaaggcaaactcaaaccagcttgggaaggaccctacttggtgctcctaaatactaagactgcagtccgaacagcagaatgaggatggactgatcacacccgcgtcaaaaaggcgctgccacctccaggatcataaaccgtcactccagggctcaccccaaccaaattaactctaaaaagggcttaataatcacttgtttattttttcttttctttccaacagaaggtcatcttgtcatcaatgtaacttgggctaaccatcctttaatccttcagtttgatgcttgttcagtcatcctgtgtggagacaagcaagctcaaaggaagctgtctcatgtagataagtacctatgtccataccataaaaagtcaaccaagtataagtatagaaccttaaaaagtccctgtggtgactggacagatgtttggaaaccactcagtatggagggtggacagccaggccccctttttcaaataagttatggggactaaaacagaaactccaactaattcatggtcccaccccaccaaactgtaagccactgcagtgtaacccctcattgctaattatagctaacccccaaacaatggcccaagaacccactatattcaaacagtatggattaggagcaaatgttacaaaacaaaatcccataaaaatcttcaaccactggttaacaatgataattaaaaaaaaatccacacccagagtctgggaaacgagtggaatctaacactctctccaagtatagcgagctcagcgtcctcctcccatctccaaaacaacccaactaaagtaacggttgtaaaggtaaaaaatttaaagcagactatagccctagagacaggatgtcaagatgcaaatgcttggctaaaatggattaaatattccatctgcactttaaacaaatatgaatgttatgcttgtgctcacggtagaccagaggcccagattgtcccctttccactcagatggtcttctaactgaccgggcataagctgtatggtagttctcttccaagatcacacagcctggggtgacaaatcatgtcaagctctttctctgctgttccctgaagctcaacaccctgagggtcagcccccgagggccatcagcttccgtttcccaatgccaattttactttgtgtctctcacaacagggagaaaacttggtgttccttggagccttaatgggatgcatgacctgggagctgtcatttccctcctgctctggggacgacagctttttgcactgtactcaggcaatgatgtcacggatatttcagatgaccgcttcccgaagccccctgagattgcaaatggctatgtggagcacttgtttcgctaccagtgtaagaactactacagactgcgcacagaaggagatggagtatacaccttaaatgataagaagcagtggataaataaggctgttggagataaacttcctgaatgtgaagcagtatgtgggaagcccaagaatccggcaaacccagtgcagcggatcctgggaggacacctggtacgcggctgggatcctaagctttga

SEQ ID NO: 11335 - DNA, 1019 bp, synthetic construct
  misc_feature 1..1019: note = Synthetic polypeptide
  source 1..1019: mol_type = other DNA
tcaggcagaccctgggccccctcttctgaggcttctgtgctgcttcctggctctgaacagcgatttgacgctctctgggcctcggtttcccccatccttgagataggagatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactga

SEQ ID NO: 11336 - DNA, 713 bp, synthetic construct
  misc_feature 1..713: note = Synthetic polypeptide
  source 1..713: mol_type = other DNA
tcaggcagaccctgggccccctcttctgaggcttctgtgctgcttcctggctctgaacagcgatttgacgctctctgggcctcggtttcccccatccttgagataggagatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctg

SEQ ID NO: 11337 - DNA, 794 bp, synthetic construct
  misc_feature 1..794: note = Synthetic polypeptide
  source 1..794: mol_type = other DNA
tcaggcagaccctgggccccctcttctgaggcttctgtgctgcttcctggctctgaacagcgatttgacgctctctgggcctcggtttcccccatccttgagataggagatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacc

SEQ ID NO: 11338 - DNA, 723 bp, synthetic construct
  misc_feature 1..723: note = Synthetic polypeptide
  source 1..723: mol_type = other DNA
tcaggcagaccctgggccccctcttctgaggcttctgtgctgcttcctggctctgaacagcgatttgacgctctctgggcctcggtttcccccatccttgagataggagatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagc

SEQ ID NO: 11339 - DNA, 543 bp, synthetic construct
  misc_feature 1..543: note = Synthetic polypeptide
  source 1..543: mol_type = other DNA
ggctgggcgtggtggcttacacttgtaatccaaacgctttgggaggccaaggcaaacggatcacttgatgtcaggagttggagaccagcctggccaacatggtgaaaccccgtctctactaaaaatacaaaaattagacaggcatggtggtgcatgcttgtatttccagttactcaggaggctgaggcaggagaatcgctcgaacccggaagacagaggttgcggtctctggacactatgggcacacgactcctcccagctctgtttcttgtcctcctggtattgggatttgaggtccaggggacccaacagccccagcaagatgagatgcctagcccgaccttcctcacccaggtgaaggaatctctctccagttactgggagtcagcaaagacagccgcccagaacctgtacgagaagacatacctgcccgctgtagatgagaaactcagggacttgtacagcaaaagcacagcagccatgagcacttacacaggcatttttactgaccaagttctttctgtgctgaagggagaggagtaa

SEQ ID NO: 11340 - DNA, 1102 bp, synthetic construct; identical to SEQ ID NO: 7760
  misc_feature 1..1102: note = Synthetic polypeptide
  source 1..1102: mol_type = other DNA

SEQ ID NO: 11341 - DNA, 1030 bp, synthetic construct; identical to SEQ ID NO: 7761
  misc_feature 1..1030: note = Synthetic polypeptide
  source 1..1030: mol_type = other DNA

SEQ ID NO: 11342 - DNA, 898 bp, synthetic construct; identical to SEQ ID NO: 7762
  misc_feature 1..898: note = Synthetic polypeptide
  source 1..898: mol_type = other DNA

SEQ ID NO: 11343 - DNA, 1002 bp, synthetic construct; identical to SEQ ID NO: 7528
  misc_feature 1..1002: note = Synthetic polypeptide
  source 1..1002: mol_type = other DNA

SEQ ID NO: 11344 - DNA, 463 bp, synthetic construct
  misc_feature 1..463: note = Synthetic polypeptide
  source 1..463: mol_type = other DNA
agcaaagcggttaagagcaccgactttggagtcggactccgggctgggatcccagctctgtgacccgggacaagtcacttaacctccctgagcctccttttccgcgtctgtgaagtggggaatagagttggagcggtgccagcagcaggcgaacgaggtgacggaaattatgcgtaacaacttcggcaaggtcctggagcgtggtgtgaagctggccgaactgcagcagcgttcagaccaactcctggatatgagctcaaccttcaacaagactacacagaacctggcccagaagaagtgctgggagaacatccgttaccggatctgcgtggggctggtggtggttggtgtcctgctcatcatcctgattgtgctgctggtcgtctttctccctcagagcagtgacagcagtagtgccccacggacccaggatgcaggcattgcctcagggcctgggaactga

SEQ ID NO: 11345 - DNA, 4027 bp, synthetic construct
  misc_feature 1..4027: note = Synthetic polypeptide
  source 1..4027: mol_type = other DNA
ccctgaagagatactccaaaaggttagtccggaaacatgggcagatgggaggccagggaaaacaaaaactgcatctccagtacaagtcaagttttgtgcaggagtggcgctgccaaatctaaagcagcgccctttgagagaaaaggcacagcaatgcatttagcctctgctaatggccttcctgcaatacaggaagaattccttgtttctcatgtaacatacctgtcttgccaggacaaaaacatggaactgaggattattggtttgtacaggatttgagggctactaggcaaattttcaaagccatttatctggtgataactgatgcttatacattattcatgactttaaccagtgagttgtactggtgttcagtcttgaatctgaaggatgccttcatctgtattcccctgagtccagagtcccatgaagtgtttgcctttgaataggaagactctgacactaaagctaaatgatagtattgctggatgatgctccatcaaggcttcaaaaactcactaaccgtccgggggaaatacatgctaaggagttttgggacctccaattgaaaaatgagactttgcttatatatgttgacggcatattagaagccagcacaactatggcaaattgaccagaatattatactggctttacattttttttttgtctggatggggatccaaagtatccaagaaaaaaatcacaaatattgaaaaactcaattatatattttaggtttgaattttctcaggagcagagtaatctgctttcggactggagagaagctcttgtcagggtggccagactcaggacatggcagcagctgtgaggggtttttaggtatggctgaatgttgccatatttcattttcttattttgggcttatagcaaaatgtctctatgaagccctaagaccagacacttgacttctagaatggacaaggaatgtcaaaaggcctttctaaccattaagtaaaaattactaatggatctggctactgagaccccctgaactaagaaagccatttgatttgttcatacatgagagagaagggatgggtttaggagtagtaacccaagacttggggaatatcatgaggcctgtagcctacttttcaaaacagctggacattgttatgatgggttggacttcttatctctgagccactggcaccacttgtgatcttctccaggaggcagaagagttcactttgggttaacctagcactgtacacaccccatactgtgtatgctatttgttggaacagaagtggagctactgacttacctctagaagactgaataggtatcaggtcatcctcctggataatcctagtgttactttgagagctgtttctgctttaaatcctgctaaataaacctatacatgattgcatataaattactgagcaagtgtgttctattcaaccagacatgaccaaaattccctttaaaaacctggacttaaaaatattcactgaggaaagcagctttatgcaccacggacaacagaaggctgagtatgctattgtaaccctgtgacagatcctagatgcagagacactccctctgggttcatcggcacagaaggcagaacttagagtcctaatcagggcatcccaactaggtaaagactcctgagtcaccgattactctgattccagaaacatgttccaaatcaagtatagatattgagaatgggtttatttctgaatctcagtatacatatgccttaaaagaaaaagcgaaatatcaatgcaaactaggatatgtaacagcagatggtgaaacatcaggatcaattacatgtgggaaagatggatggtcagctcaacccacgtgcattaaatcttgtgatatcccagtatttatgaatgccagaactaaaaatgacttcacatggtttaagctgaatgacacattggactatgaatgccatgatggttatgaaagcaatactggaagcaccactggttccatagtgtgtggttacaatggttggtctgatttacccatatgttatgaaagagaatgcgaacttcctaaaatagatgtacacttagttcctgatcgcaagaaagaccagtataaagttggagaggtgttgaaattctcctgcaaaccaggatttacaatagttggacctaattccgttcagtgctaccactttggattgtctcctgacctcccaatatgtaaagagcaagtacaatcatgtggtccacctcctgaactcctcaatgggaatgttaaggaaaaaacgaaagaagaatatggacacagtgaagtggtggaatattattgcaatcctagatttctaatgaagggacctaataaaattcaatgtgttgatggagagtggacaactttaccagtgtgtattgtggaggagagtacctgtggagatatacctgaacttgaacatggctgggcccagctttcttcccctccttattactatggagattcagtggaattcaattgctcagaatcatttacaatgattggacacagatcaattacgtgtattcatggagtatggacccaacttccccagtgtgtggcaatagataaacttaagaagtgcaaatcatcaaatttaattatacttgaggaacatttaaaaaacaagaaggaattcgatcataattctaacataaggtacagatgtagaggaaaagaaggatggatacacacagtctgcataaatggaagatgggatccagaagtgaactgctcaatggcacaaatacaattatgcccacctccacctcagattcccaattctcacaatatgacaaccacactgaattatcgggatggagaaaaagtatctgttctttgccaagaaaattatctaattcaggaaggagaagaaattacatgcaaagatggaagatggcagtcaataccactctgtgttgaaaaaattccatgttcacaaccacctcagatagaacacggaaccattaattcatccaggtcttcacaagaaagttatgcacatgggactaaattgagttatacttgtgagggtggtttcaggatatctgaagaaaatgaaacaacatgctacatgggaaaatggagttctccacctcagtgtgaaggccttccttgtaaatctccacctgagatttctcatggtgttgtagctcacatgtcagacagttatcagtatggagaagaagttacgtacaaatgttttgaaggttttggaattgatgggcctgcaattgcaaaatgcttaggagaaaaatggtctcaccctccatcatgcataaaaacagattgtctcagtttacctagctttgaaaatgccatacccatgggagagaagaaggatgtgtataaggcgggtgagcaagtgacttacacttgtgcaacatattacaaaatggatggagccagtaatgtaacatgcattaatagcagatggacaggaaggccaacatgcagagacacctcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaagattctacaggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatag

SEQ ID NO: 11346 - DNA, 548 bp, synthetic construct
  misc_feature 1..548: note = Synthetic polypeptide
  source 1..548: mol_type = other DNA
gtctccagatgtgtcacctggagaaggacatcatagcacttttgtagtgttacagctggggtccagaacctgaatccaatcatgaagaaatatcagctggtgctcaagaccgaatcggctgggcttttggcctaggattagaaaggctagccatgatcctctacgacatccctgatatccgtctcttctggtgtgaggacgagcgcttcctgaagcagttctgtgtatccaacattaatcagaaggtgaagtttcagcctcttagcaaatatccggctgtgatcaatgatatttcattctggttgccctctgagaattacgcagaaaatgatttctatgacttagtccgaacaattggaggagacctggtggaaaaggttgatctcatagacaagtttgtacatccaaagacgcacaagaccagccactgctaccgcatcacgtaccgccacatggaacggactctgtcccagagagaggtcaggcacatccaccaggccttgcaggaggctgcagtccagctgttgggtgtggagggcaggttctga

SEQ ID NO: 11347 - DNA, 1046 bp, synthetic construct; identical to SEQ ID NO: 631
  misc_feature 1..1046: note = Synthetic polypeptide
  source 1..1046: mol_type = other DNA

SEQ ID NO: 11348 - DNA, 968 bp, synthetic construct; identical to SEQ ID NO: 632
  misc_feature 1..968: note = Synthetic polypeptide
  source 1..968: mol_type = other DNA

SEQ ID NO: 11349 - DNA, 676 bp, synthetic construct; identical to SEQ ID NO: 634
  misc_feature 1..676: note = Synthetic polypeptide
  source 1..676: mol_type = other DNA

SEQ ID NO: 11350 - DNA, 494 bp, synthetic construct; identical to SEQ ID NO: 635
  misc_feature 1..494: note = Synthetic polypeptide
  source 1..494: mol_type = other DNA

SEQ ID NO: 11351 - DNA, 1196 bp, synthetic construct
  misc_feature 1..1196: note = Synthetic polypeptide
  source 1..1196: mol_type = other DNA
tgatatggtttggctgtgtccccacccaaaaaatctcatcttgaatcgtagttcccataatctgcatgttttgtgggagggacccagtgggaagtaattggatcacaggggcagttttccccatgctgttctcatgatactgagagagttctgacaagatcggatggttttataagcacctggcatatcccctgctagcttttctccttcctgctgccttgtgaagaagtgccttgattccctttcaccttgagccatgatagtttcttgaagcctccccagccatgctgaactgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaa

SEQ ID NO: 11352 - DNA, 644 bp, synthetic construct
  misc_feature 1..644: note = Synthetic polypeptide
  source 1..644: mol_type = other DNA
tgatatggtttggctgtgtccccacccaaaaaatctcatcttgaatcgtagttcccataatctgcatgttttgtgggagggacccagtgggaagtaattggatcacaggggcagttttccccatgctgttctcatgatactgagagagttctgacaagatcggatggttttataagcacctggcatatcccctgctagcttttctccttcctgctgccttgtgaagaagtgccttgattccctttcaccttgagccatgatagtttcttgaagcctccccagccatgctgaactgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctga

SEQ ID NO: 11353 - DNA, 460 bp, synthetic construct
  misc_feature 1..460: note = Synthetic polypeptide
  source 1..460: mol_type = other DNA
tgatatggtttggctgtgtccccacccaaaaaatctcatcttgaatcgtagttcccataatctgcatgttttgtgggagggacccagtgggaagtaattggatcacaggggcagttttccccatgctgttctcatgatactgagagagttctgacaagatcggatggttttataagcacctggcatatcccctgctagcttttctccttcctgctgccttgtgaagaagtgccttgattccctttcaccttgagccatgatagtttcttgaagcctccccagccatgctgaactgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaa

SEQ ID NO: 11354 - DNA, 737 bp, synthetic construct
  misc_feature 1..737: note = Synthetic polypeptide
  source 1..737: mol_type = other DNA
tgatatggtttggctgtgtccccacccaaaaaatctcatcttgaatcgtagttcccataatctgcatgttttgtgggagggacccagtgggaagtaattggatcacaggggcagttttccccatgctgttctcatgatactgagagagttctgacaagatcggatggttttataagcacctggcatatcccctgctagcttttctccttcctgctgccttgtgaagaagtgccttgattccctttcaccttgagccatgatagtttcttgaagcctccccagccatgctgaactgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaagatctttgataccatactttaatctgtatcttcagtttctgaacataagtatgcaaaatctttttaaggtgcatactctgctgcgtccctgctattttctaggacaaaaataa

SEQ ID NO: 11355 - DNA, 1232 bp, synthetic construct
  misc_feature 1..1232: note = Synthetic polypeptide
  source 1..1232: mol_type = other DNA
tgatatggtttggctgtgtccccacccaaaaaatctcatcttgaatcgtagttcccataatctgcatgttttgtgggagggacccagtgggaagtaattggatcacaggggcagttttccccatgctgttctcatgatactgagagagttctgacaagatcggatggttttataagcacctggcatatcccctgctagcttttctccttcctgctgccttgtgaagaagtgccttgattccctttcaccttgagccatgatagtttcttgaagcctccccagccatgctgaactgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggctggtagcaagttctggatcttatacccaacacacagcaacatccagaaataa

SEQ ID NO: 11356 - DNA, 1151 bp, synthetic construct
  misc_feature 1..1151: note = Synthetic polypeptide
  source 1..1151: mol_type = other DNA
tgatatggtttggctgtgtccccacccaaaaaatctcatcttgaatcgtagttcccataatctgcatgttttgtgggagggacccagtgggaagtaattggatcacaggggcagttttccccatgctgttctcatgatactgagagagttctgacaagatcggatggttttataagcacctggcatatcccctgctagcttttctccttcctgctgccttgtgaagaagtgccttgattccctttcaccttgagccatgatagtttcttgaagcctccccagccatgctgaactgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatgaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaa

SEQ ID NO: 11357 - DNA, 914 bp, synthetic construct
  misc_feature 1..914: note = Synthetic polypeptide
  source 1..914: mol_type = other DNA
tgatatggtttggctgtgtccccacccaaaaaatctcatcttgaatcgtagttcccataatctgcatgttttgtgggagggacccagtgggaagtaattggatcacaggggcagttttccccatgctgttctcatgatactgagagagttctgacaagatcggatggttttataagcacctggcatatcccctgctagcttttctccttcctgctgccttgtgaagaagtgccttgattccctttcaccttgagccatgatagtttcttgaagcctccccagccatgctgaactgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggtctgggagaactgatcttgctgaaaatacaacaggaagcagtatcgtgccaggcaaggcaaaccctcgtcagtgtgaagcaatggccatcgttgcagcccaagtcatggggttttgtgtggcagtaa

SEQ ID NO: 11358 - DNA, 830 bp, synthetic construct
  misc_feature 1..830: note = Synthetic polypeptide
  source 1..830: mol_type = other DNA
tgatatggtttggctgtgtccccacccaaaaaatctcatcttgaatcgtagttcccataatctgcatgttttgtgggagggacccagtgggaagtaattggatcacaggggcagttttccccatgctgttctcatgatactgagagagttctgacaagatcggatggttttataagcacctggcatatcccctgctagcttttctccttcctgctgccttgtgaagaagtgccttgattccctttcaccttgagccatgatagtttcttgaagcctccccagccatgctgaactgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggctgctgggggatgcttcagtttccttcacagaaaactaaatag

SEQ ID NO: 11359 - DNA, 893 bp, synthetic construct
  misc_feature 1..893: note = Synthetic polypeptide
  source 1..893: mol_type = other DNA
tgatatggtttggctgtgtccccacccaaaaaatctcatcttgaatcgtagttcccataatctgcatgttttgtgggagggacccagtgggaagtaattggatcacaggggcagttttccccatgctgttctcatgatactgagagagttctgacaagatcggatggttttataagcacctggcatatcccctgctagcttttctccttcctgctgccttgtgaagaagtgccttgattccctttcaccttgagccatgatagtttcttgaagcctccccagccatgctgaactgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggtctgggagaactgatcttgctgaaaatacaacaggaagcagtatcgtgccaggcaaggcaaaccctcgtcagtgtgaagcaatggccatcgttgcagcccaagtcatggggttttgtgtggcagtaaccgttggaggcggcaatggccattttgagttggatgttttcaagccaatgatgattaaaaatttatgttacactcaggctgctgggggatgcttcagtttccttcacagaaaactaaatagtgggaatccggaccaataa

SEQ ID NO: 11360 - DNA, 1052 bp, synthetic construct; identical to SEQ ID NO: 447
  misc_feature 1..1052: note = Synthetic polypeptide
  source 1..1052: mol_type = other DNA

SEQ ID NO: 11361 - DNA, 1118 bp, synthetic construct; identical to SEQ ID NO: 448
  misc_feature 1..1118: note = Synthetic polypeptide
  source 1..1118: mol_type = other DNA

SEQ ID NO: 11362 - DNA, 398 bp, synthetic construct
  misc_feature 1..398: note = Synthetic polypeptide
  source 1..398: mol_type = other DNA
aagggctcacgggagagttttccattacaaggtttcacgcatgtgtgctgcagctcccatttcatcagcaagtttggaagaaccccacatttttcctgcgcgtcatctctgacacggcctccctctgctactccatcctgaaagccaagaacgcagggatgtcgctgggggccaagggcgccgccggccctctgccctccgaggccgtgcagtggctgtgccaccaagcattcctgctcaagctgactcgacaccgtgtcacctacgtgccactcctggggtcactcaggacagcccagacgcagctgagtcggaagctcccggggacgacgctgactgccctggaggccgcagccaacccggcactgccctcagacttcaagaccatcctggactga

SEQ ID NO: 11363 - DNA, 1227 bp, synthetic construct
  misc_feature 1..1227: note = Synthetic polypeptide
  source 1..1227: mol_type = other DNA
tgtagaaggcagtttctataatggatctcaatgatccccacccgctatgttcactcccttgtgtgatcttttccctttgaatatggagtggatctaggaacttgcttctaatgcacagaatgcagctaaagtgatggaatggcccttccgagatcagattacaagagtgtggcttctgccttctctctctgtctgattcttctcactggctagatctgatgaagcaagctgctcttgggagctgccctgtgaggaggcccacacagcaaggaacaaaggaggagcaaccggatcctgcaacaaacaagtgactgggctgctgtttccccagggctgctggtgtgcctggcctgcctggcgaagtgcgtgagattctccagatgtgttttactgaactactggaaagttttgccaaagtctttcttgcggtcaatgggacagtgggcagtgatcactggagcaggcgatggaattgggaaagcgtactcgttcgagctagcaaaacgtggactcaatgttgtccttattagccggacgctggaaaaactagaggccattgccacagagatcgagcggactacagggaggagtgtgaagattatacaagcagattttacaaaagatgacatctacgagcatattaaagaaaaacttgcaggcttagaaattggaattttagtcaacaatgtcggaatgcttccaaaccttctcccaagccatttcctgaacgcaccggatgaaatccagagcctcatccattgtaacatcacctccgtagtcaagatgacacagctaattctgaaacatatggaatcaaggcagaaaggtctcatcctgaacatttcttctgggatagccctgtttccttggcctctctactccatgtactcagcttccaaggcgtttgtgtgcgcattttccaaggccctgcaagaggaatataaagcaaaagaagtcatcatccaggtgctgaccccatatgctgtctcgactgcaatgacaaagtatctaaatacaaatgtgataaccaagactgctgatgagtttgtcaaagagtcattgaattatgtcacaattggaggtgaaacctgtggctgccttgcccatgaaatcttggcgggctttctgagcctgatcccggcctgggccttctacagcggtgccttccaaaggctgctcctgacacactatgtggcatacctgaagctcaacaccaaggtcaggtag

SEQ ID NO: 11364 - DNA, 1077 bp, synthetic construct
  misc_feature 1..1077: note = Synthetic polypeptide
  source 1..1077: mol_type = other DNA
tgtagaaggcagtttctataatggatctcaatgatccccacccgctatgttcactcccttgtgtgatcttttccctttgaatatggagtggatctaggaacttgcttctaatgcacagaatgcagctaaagtgatggaatggcccttccgagatcagattacaagagtgtggcttctgccttctctctctgtctgattcttctcactggctagatctgatgaagcaagctgctcttgggagctgccctgtgaggaggcccacacagcaaggaacaaaggaggagcaaccggatcctgcaacaaacaagtgactgggctgctgtttccccagggctgctggtgtgcctggcctgcctggcgaagtgcgtgagattctccagatgtgttttactgaactactggaaagttttgccaaagtctttcttgcggtcaatgggacagtgggcagtgatcactggagcaggcgatggaattgggaaagcgtactcgttcgagctagcaaaacgtggactcaatgttgtccttattagccggacgctggaaaaactagaggccattgccacagagatcgagcggactacagggaggagtgtgaagattatacaagcagattttacaaaagatgacatctacgagcatattaaagaaaaacttgcaggcttagaaattggaattttagtcaacaatgtcggaatgcttccaaaccttctcccaagccatttcctgaacgcaccggatgaaatccagagcctcatccattgtaacatcacctccgtagtcaagatgacacagctaattctgaaacatatggaatcaaggcagaaaggtctcatcctgaacatttcttctgggatagccctgtttccttggcctctctactccatgtactcagcttccaaggcgtttgtgtgcgcattttccaaggccctgcaagaggaatataaagcaaaagaagtcatcatccaggcgggctttctgagcctgatcccggcctgggccttctacagcggtgccttccaaaggctgctcctgacacactatgtggcatacctgaagctcaacaccaaggtcaggtag

SEQ ID NO: 11365 - DNA, 1598 bp, synthetic construct
  misc_feature 1..1598: note = Synthetic polypeptide
  source 1..1598: mol_type = other DNA
gctgggcacgatggttctcacctgcaatcccagcactttaggaggccaagacaggaggatcgcttgaggccaggaattcaaggcaacacgagccagcggacttctcccaggacccacccaagccaagcctgtccagccagcaggcagtgtatggacatgtgcacctgggaactggagacccctacacacctggcttcccttccttcaatcaaacccagttccctccagttgcatcatcaggccttcccagcatcccagcccagcccatcagtgcagacattgcctcccgcctgctgaggaagctcaaaggccctgtggccccccaagaatggcaggggagcctcctaggctccccttatcacctgggccccgggccacgactgcggctagtggtcaacaatcacaggacctccacccccatcaacaacatcttcggctgcatcgaaggccgctcagagccagatcactacgttgtcatcggggcccagagggatgcatggggcccaggagcagctaaatccgctgtggggacggctatactcctggagctggtgcggaccttttcctccatggtgagcaacggcttccggccccgcagaagtctcctcttcatcagctgggacggtggtgactttggaagcgtgggctccacggagtggctagagggctacctcagcgtgctgcacctcaaagccgtagtgtacgtgagcctggacaacgcagtgctgggggatgacaagtttcatgccaagaccagcccccttctgacaagtctcattgagagtgtcctgaagcaggtggattctcccaaccacagtgggcagactctctatgaacaggtggtgttcaccaatcccagctgggatgctgaggtgatccggcccctacccatggacagcagtgcctattccttcacggcctttgtgggagtccctgccgtcgagttctcctttatggaggacgaccaggcctacccattcctgcacacaaaggaggacacttatgagaacctgcataaggtgctgcaaggccgcctgcccgccgtggcccaggccgtggcccagctcgcagggcagctcctcatccggctcagccacgatcgcctgctgcccctcgacttcggccgctacggggacgtcgtcctcaggcacatcgggaacctcaacgagttctctggggacctcaaggcccgcgggctgaccctgcagtgggtgtactcggcgcggggggactacatccgggcggcggaaaagctgcggcaggagatctacagctcggaggagagagacgagcgactgacacgcatgtacaacgtgcgcataatgcgggtggagttctacttcctttcccagtacgtgtcgccagccgactccccgttccgccacatcttcatgggccgtggagaccacacgctgggcgccctgctggaccacctgcggctgctgcgctccaacagctccgggacccccggggccacctcctccactggcttccaggagagccgtttccggcgtcagctagccctgctcacctggacgctgcaaggggcagccaatgcgcttagcggggatgtctggaacattgataacaacttctga

SEQ ID NO: 11366 - DNA, 446 bp, synthetic construct
  misc_feature 1..446: note = Synthetic polypeptide
  source 1..446: mol_type = other DNA
gctgggcacgatggttctcacctgcaatcccagcactttaggaggccaagacaggaggatcgcttgaggccaggaattcaaggcaacacgagccagcggacttctcccaggacccacccaagccaagcctgtccagccagcaggcagtgtatggacatgtgcacctgggaactggagacccctacacacctggcttcccttccttcaatcaaacccagttccctccagttgcatcatcaggccttcccagcatcccagcccagcccatcagtgcagacattgcctcccgcctgctgaggctggagtgcagtggtgcaatcttggctcactgcaacctccacctcccgggttcaagtgattcttctgcctcagactccagagtatctaggattacaggaagctcaaaggccctgtggccccccaagaatggcaggggagcctcctag

SEQ ID NO: 11367 - DNA, 1079 bp, synthetic construct; identical to SEQ ID NO: 6652
  misc_feature 1..1079: note = Synthetic polypeptide
  source 1..1079: mol_type = other DNA

SEQ ID NO: 11368 - DNA, 1103 bp, synthetic construct
  misc_feature 1..1103: note = Synthetic polypeptide
  source 1..1103: mol_type = other DNA
gcgcaggtgctggaatccgagggcctggttaagagcctccgctcagttgctgattggctggagatgaagttacttagcgtctctgagcttcaagctctccatctgcccaactggggaaagcagtgccttcttttcagggctttggtgagagctaaatgagatagaccgtgtatgcattgcttgcttgggagttcatgagcggcccagttctgtaccaggagaagctgctgaagccggcagctttgctgctggagaagggtgccgaccaggaggaagacgaggccctgcgggtgctgtccctgcgcgccctcggcaacatggccctgggcgcccccaagaaggtgaagcagtaccggaaggtcttgctggagaagtgcctgggccccctgagggagcccgtgagcaacagcgtgactgccgagggcatggaggccctgaccaagatcctggctgagctccgggaaggggatgtggggtcctctttcgacgccatgtctgagcagtgcaggatcttcttcgacaacgagagcgagctgctgcgtctgaaagccttcatcctctttggaaagctggcaagggtggtcgggatgtccaagaagcatttcttcaaaggggaggtgaagaaggcctggatccccctcatgctgcactcccaggacccctgctccaatgcagcccaagcctgtatggctaccatgtttcagtgtgtgcacttctggggctggaagtccctggagcatccctcagggccaagtgataccgctactgatgacaagatgaccgttttccagacaaccatgtgctccatcctgactcggaaaaagccggctgttctctaccgcttcttgctagaaacaatggcctatgttaaaaataacttgtcaagaatcagaatcgctgcttgcaacttggcaggaattattatgaagcagatgtctacacattatctgaaaaagctggacttcccagcattacggaattccctccaggaactacagctggacccggatcccggggtcaggagggcagccctggagacgctcacagtcttggatagctgtagtcagcatgggtttctggcttcaccccaaggaatgtcctag

SEQ ID NO: 11369 - DNA, 1450 bp, synthetic construct
  misc_feature 1..1450: note = Synthetic polypeptide
  source 1..1450: mol_type = other DNA
acaggggtgaaaagcataggttctgacttcagactgctgggccgcagccctggctatcccaccccagagtgggaagctttggggtggccggtttgtgggtgcagtggaccccatcatggagaagttcaacgcgtccattgcctacgaccggcacctttgggaggtggatgttcaaggcagcaaagcctacagcaggggcctggagaaggcagggctcctcaccaaggccgagatggaccagatactccatggcctagacaaggtggctgaggagtgggcccagggcaccttcaaactgaactccaatgatgaggacatccacacagccaatgagcgccgcctgaaggagctcattggtgcaacggcagggaagctgcacacgggacggagccggaatgaccaggtggtcacagacctcaggctgtggatgcggcagacctgctccacgctctcgggcctcctctgggagctcattaggaccatggtggatcgggcagaggcggaacgtgatgttctcttcccggggtacacccatttgcagagggcccagcccatccgctggagccactggattctgagccacgccgtggcactgacccgagactctgagcggctgctggaggtgcggaagcggatcaatgtcctgcccctggggagtggggccattgcaggcaatcccctgggtgtggaccgagagctgctccgagcagaactcaactttggggccatcactctcaacagcatggatgccactagtgagcgggactttgtggccgagttcctgttctgggcttcgctgtgcatgacccatctcagcaggatggccgaggacctcatcctctactgcaccaaggaattcagcttcgtgcagctctcagatgcctacagcacgggaagcagcctgatgccccagaagaaaaaccccgacagtttggagctgatccggagcaaggctgggcgtgtgtttgggcggtgtgccgggctcctgatgaccctcaagggacttcccagcacctacaacaaagacttacaggaggacaaggaagctgtgtttgaagtgtcagacactatgagtgccgtgctccaggtggccactggcgtcatctctacgctgcagattcaccaagagaacatgggacaggctctcagccccgacatgctggccactgaccttgcctattacctggtccgcaaagggatgccattccgccaggcccacgaggcctccgggaaagctgtgttcatggccgagaccaagggggtcgccctcaaccagctgtcactgcaggagctgcagaccatcagccccctgttctcgggcgacgtgatctgcgtgtgggactacgggcacagtgtggagcagtatggtgccctgggcggcactgcgcgctccagcgtcgactggcagatccgccaggtgcgggcgctactgcaggcacagcaggcctag

SEQ ID NO: 11370 - DNA, 1372 bp, synthetic construct
  misc_feature 1..1372: note = Synthetic polypeptide
  source 1..1372: mol_type = other DNA
acaggggtgaaaagcataggttctgacttcagactgctgggccgcagccctggctatcccaccccagagtgggaagctttggggtggccggtttgtgggtgcagtggaccccatcatggagaagttcaacgcgtccattgcctacgaccggcacctttgggaggtggatgttcaaggcagcaaagcctacagcaggggcctggagaaggcagggctcctcaccaaggccgagatggaccagatactccatggcctagacaaggtggctgaggagtgggcccagggcaccttcaaactgaactccaatgatgaggacatccacacagccaatgagcgccgcctgaaggagctcattggtgcaacggcagggaagctgcacacgggacggagccggaatgaccaggtggtcacagacctcaggctgtggatgcggcagacctgctccacgctctcgggcctcctctgggagctcattaggaccatggtggatcgggcagaggcggaacgtgatgttctcttcccggggtacacccatttgcagagggcccagcccatccgctggagccactggattctgagtggggccattgcaggcaatcccctgggtgtggaccgagagctgctccgagcagaactcaactttggggccatcactctcaacagcatggatgccactagtgagcgggactttgtggccgagttcctgttctgggcttcgctgtgcatgacccatctcagcaggatggccgaggacctcatcctctactgcaccaaggaattcagcttcgtgcagctctcagatgcctacagcacgggaagcagcctgatgccccagaagaaaaaccccgacagtttggagctgatccggagcaaggctgggcgtgtgtttgggcggtgtgccgggctcctgatgaccctcaagggacttcccagcacctacaacaaagacttacaggaggacaaggaagctgtgtttgaagtgtcagacactatgagtgccgtgctccaggtggccactggcgtcatctctacgctgcagattcaccaagagaacatgggacaggctctcagccccgacatgctggccactgaccttgcctattacctggtccgcaaagggatgccattccgccaggcccacgaggcctccgggaaagctgtgttcatggccgagaccaagggggtcgccctcaaccagctgtcactgcaggagctgcagaccatcagccccctgttctcgggcgacgtgatctgcgtgtgggactacgggcacagtgtggagcagtatggtgccctgggcggcactgcgcgctccagcgtcgactggcagatccgccaggtgcgggcgctactgcaggcacagcaggcctag

SEQ ID NO: 11371 - DNA, 1390 bp, synthetic construct
  misc_feature 1..1390: note = Synthetic polypeptide
  source 1..1390: mol_type = other DNA
acaggggtgaaaagcataggttctgacttcagactgctgggccgcagccctggctatcccaccccagagtgggaagctttggggtggccggtttgtgggtgcagtggaccccatcatggagaagttcaacgcgtccattgcctacgaccggcacctttgggaggtggatgttcaaggcagcaaagcctacagcaggggcctggagaaggcagggctcctcaccaaggccgagatggaccagatactccatggcctagacaaggtggctgaggagtgggcccagggcaccttcaaactgaactccaatgatgaggacatccacacagccaatgagcgccgcctgaaggagctcattggtgcaacggcagggaagctgcacacgggacggagccggaatgaccaggtggtcacagacctcaggctgtggatgcggcagacctgctccacgctctcgggcctcctctgggagctcattaggaccatggtggatcgggcagaggcggaacgtgatgttctcttcccggggtacacccatttgcagagggcccagcccatccgctggagccactggattctgagccacgccgtggcactgacccgagactctgagcggctgctggaggtgcggaagcggatcaatgtcctgcccctggggagtggggccattgcaggcaatcccctgggtgtggaccgagagctgctccgagcagaactcaactttggggccatcactctcaacagcatggatgccactagtgagcgggactttgtggccgagttcctgttctgggcttcgctgtgcatgacccatctcagcaggatggccgaggacctcatcctctactgcaccaaggaattcagcttcgtgcagctctcagatgcctacagcacgggaagcagcctgatgccccagaagaaaaaccccgacagtttggagctgatccggagcaaggctgggcgtgtgtttgggcgggaggacaaggaagctgtgtttgaagtgtcagacactatgagtgccgtgctccaggtggccactggcgtcatctctacgctgcagattcaccaagagaacatgggacaggctctcagccccgacatgctggccactgaccttgcctattacctggtccgcaaagggatgccattccgccaggcccacgaggcctccgggaaagctgtgttcatggccgagaccaagggggtcgccctcaaccagctgtcactgcaggagctgcagaccatcagccccctgttctcgggcgacgtgatctgcgtgtgggactacgggcacagtgtggagcagtatggtgccctgggcggcactgcgcgctccagcgtcgactggcagatccgccaggtgcgggcgctactgcaggcacagcaggcctag

SEQ ID NO: 11372 - DNA, 522 bp, synthetic construct
  misc_feature 1..522: note = Synthetic polypeptide
  source 1..522: mol_type = other DNA
aaagaatgtggactttggagtcaaactaatatcactggcaagtggttttatatcgcatcggcctttcgaaacgaggagtacaataagtcggttcaggagatccaagcaaccttcttttactttacccccaacaagacagaggacacgatctttctcagagagtaccagacccgccagaaccagtgcttctataactccagttacctgaatgtccagcgggagaatgggaccgtctccagatacgagggaggccgagaacatgttgctcacctgctgttccttagggacaccaagaccttgatgtttggttcctacctggacgatgagaagaactgggggctgtctttctatgctgacaagccagagacgaccaaggagcaactgggagagttctacgaagctctcgactgcttgtgcattcccaggtcagatgtcatgtacaccgactggaaaaaggataagtgtgagccactggagaagcagcacgagaaggagaggaaacaggaggagggggaatcctag

SEQ ID NO: 11373 - DNA, 86 bp, synthetic construct
  misc_feature 1..86: note = Synthetic polypeptide
  source 1..86: mol_type = other DNA
aaagaatgtggactttggagtcaaactaatatcactggcaagtggttttatatcgcatcggcctttcgaaacgaggagtacaataa

SEQ ID NO: 11374 - DNA, 715 bp, synthetic construct
  misc_feature 1..715: note = Synthetic polypeptide
  source 1..715: mol_type = other DNA
ggctaggcgcggtggctcacgcctgtcatcccagcactttgggaggccgaggttgcctaagtactcttgccagttcattgagatgtgtctgatggtgacagctgatcacgggccagccgtctctggagcccacaacaccatcatttgtgcgcgagctgggaaagacctggtctccagcctcacctcggggctgctcaccatcggggatcggtttgggggtgccttggatgcagcagccaagatgttcagtaaagcctttgacagtggcattatccccatggagtttgtgaacaagatgaagaaggaagggaagctgatcatgggcattggtcaccgagtgaagtcgataaacaacccagacatgcgagtgcagatcctcaaagattacgtcaggcagcacttccctgccactcctctgctcgattatgcactggaagtagagaagattaccacctcgaagaagccaaatcttatcctgaatgtagatggtctcatcggagtcgcatttgtagacatgcttagaaactgtgggtcctttactcgggaggaagctgatgaatatattgacattggagccctcaatggcatctttgtgctgggaaggagtatggggttcattggacactatcttgatcagaagaggctgaagcaggggctgtatcgtcatccgtgggatgatatttcatatgttcttccggaacacatgagcatgtaa

SEQ ID NO: 11375 - DNA, 566 bp, synthetic construct
  misc_feature 1..566: note = Synthetic polypeptide
  source 1..566: mol_type = other DNA
aatcctggctccactccttactagctgtgtgaccctggacaaattggctcataaaggactcagtgcagcatttacagaccctgacgcaatccggagctgaccagcacgaggcttggaaccagaccactgtcatacacctccaggctgctaaggtgcactgctactatgtcactgtgaagggttttacagaagctctggagaaactagaaaatgaaccagcgattcagcaggtgctcaagcgcctctgtgacctccatgccatacatggaatcttgactaactcgggtgactttctccatgacgccttcctgtctggtgcccaagtggacatggcaagaacagcctacctggacctgctccgcctgatccggaaggatgccatcctgttaactgatgcttttgacttcaccgatcagtgtttaaattcagcacttggctgttatgatggaaacgtctacgaacgcctgttccagtgggctcagaagtcaccaaccaatactcaggagaaccctgcctatgaggaatatataagaccacttttacaaagttggagatccaagctatga

SEQ ID NO: 11376 - DNA, 1090 bp, synthetic construct
  misc_feature 1..1090: note = Synthetic polypeptide
  source 1..1090: mol_type = other DNA
ccttcctagctctcagttttctcatctgtaaaatggaagtgacagtaccgactatgaattaaatgagccattgtttgggaacttggcacgtttcccggcgcacggtatcatacatgcgctacagagggaaaacttcaatatctctcggatctatgggaagtggtacaacctggccatcggttccacctgcccctggctgaagaagatcatggacaggatgacagtgagcacgctggtgctgggagagggcgctacagaggcggagatcagcatgaccagcactcgttggcggaaaggtgtctgtgaggagacgtctggagcttatgagaaaacagatactgatgggaagtttctctatcacaaatccaaatggaacataaccatggagtcctatgtggtccacaccaactatgatgagtatgccattttcctgaccaagaaattcagccgccatcatggacccaccattactgccaagctctacgggcgggcgccgcagctgagggaaactctcctgcaggacttcagagtggttgcccagggtgtgggcatccctgaggactccatcttcaccatggctgaccgaggtgaatgtgtccctggggagcaggaaccagagcccatcttaatcccgagagtccggagggctgtgctaccccaagaagaggaaggatcagggggtgggcaactggtaactgaagtcaccaagaaagaagattcctgccagctgggctactcggccggtccctgcatgggaatgaccagcaggtatttctataatggtacatccatggcctgtgagactttccagtacggcggctgcatgggcaacggtaacaacttcgtcacagaaaaggagtgtctgcagacctgccgaactgtggcggcctgcaatctccccatagtccggggcccctgccgagccttcatccagctctgggcatttgatgctgtcaaggggaagtgcgtcctcttcccctacgggggctgccagggcaacgggaacaagttctactcagagaaggagtgcagagagtactgcggtgtccctggtgatggtgatgaggagctgctgcgcttctccaactga

SEQ ID NO: 11377 - DNA, 748 bp, synthetic construct
  misc_feature 1..748: note = Synthetic polypeptide
  source 1..748: mol_type = other DNA
ccttcctagctctcagttttctcatctgtaaaatggaagtgacagtaccgactatgaattaaatgagccattgtttgggaacttggcacgtttcccggcgcacggtatcatacatgcgctacagagggaaaacttcaatatctctcggatctatgggaagtggtacaacctggccatcggttccacctgcccctggctgaagaagatcatggacaggatgacagtgagcacgctggtgctgggagagggcgctacagaggcggagatcagcatgaccagcactcgttggcggaaaggtgtctgtgaggagacgtctggagcttatgagaaaacagatactgatgggaagtttctctatcacaaatccaaatggaacataaccatggagtcctatgtggtccacaccaactatgatgagtatgccattttcctgaccaagaaattcagccgccatcatggacccaccattactgccaagctctacgggcgggcgccgcagctgagggaaactctcctgcaggacttcagagtggttgcccagggtgtgggcatccctgaggactccatcttcaccatggctgaccgagtgaatggccttgagcaagccacacaggcaggaccattcatgaagtggactaaggcacgacaagttcccagcacgatgctcaccaaagatacaaatccgggtctaggatggcccctgggcctggtcctgttattcactcctctctcctgctctgtgacctag

SEQ ID NO: 11378 - DNA, 2972 bp, synthetic construct
  misc_feature 1..2972: note = Synthetic polypeptide
  source 1..2972: mol_type = other DNA
gtgacgttaagtcttcatagggagaaggtgagataattggttctacaaatcttataattctgctagaggatgaagtctttgccgattttttcaacacatttctttccctcccggtttttggtcagacaccattttatactgttgaaaattcacagtggagcttgtggccagaaataccttgtaacttgattgccaaatacaaagggttattgacctggttggaaaaatgccgattacctttcttctgtaaaacaaacttgtgtttccattacattctctgtcaggagttcatcagtttcattaagtccccagaaggagccaagatgatgagatggaaaaaggcagaccagtggctactccagaaatgcattggcggggtcagagggatgtggcgcttctattcctacctcacaggcagtgcaggtgaagaattggtggatttctggatccttgctgagaacatcctgagcatagatgagatggacctggaagtgagagactactacctgtccctcctcctcatgctgagggccactcatctgcaggagggctccagggtggtaaccctctgtaacatgaacatcaagtccctcctgaacctctccatctggcatcccaaccaatcaaccactaggagggagatcctgagccacatgcagaaagtggctctgttcaaactccagagctattggcttcccaacttttacacccacaccaagatgaccatggccaaggaggaagcatgccatggtctgatgcaagagtacgagactcgcttatacagcgtttgctacacccacataggagggctccctctgaacatgagcatcaagaagtgccaccactttcagaaacggtactcaagcaggaaagccaagaggaagatgtggcaattggtagatcctgactcttggtctctggaaatggatctcaagccagatgctattggtatgcccctacaggagacatgtcctcaagagaaggtggttatacaaatgccttccctgaaaatggcttcttcaaaggaaacaagaatcagttccctggaaaaggatatgcattatgcaaaaatatccagcatggagaataaagccaagagccacctccacatggaagccccctttgagacaaaggtctctacccacctgaggactgtcatccccattgtcaatcactcctccaagatgacaattcagaaggccatcaagcaaagcttctccttaggatacatccacttggccttgtgtgctgatgcctgtgcagggaaccctttccgggaccacctgaagaagctgaatttgaaagtggagatccaacttcttgacctctggcaggacttgcagcatttcctcagtgtccttctgaataacaaaaagaatgggaatgcaatctttcgtcacttgctgggtgacagaatctgcgagctctacctgaatgagcagattggtccgtgcttaccactcaaatcccaaaccattcagggcctgaaggaactattgccctctggggatgtgatcccctggattcccaaagcccagaaggagatttgcaagatgctcagtccctggtatgatgagtttctagatgaagaggactactggtttctcctttttacgacacagaacaggttcatcagctccagacagcataaaagagaatttataggcaaagaagagaacattcttctttataagaggattcagcagtctctagagttaagccaggctttggctgacatgaaggaaatggactataggcagtggcgaaagatagctactgaggacctgaagcaaggaggctctctccaggtagagctgacatctccagtgtttctaacagacataactaaaatgtcctttgaggagctttgctacaagaacccaaagatggccatacagaagatcagtgatgactacaaaatatactgtgagaaagcacctaaaatagattttaaaatggaaattatcaaggaaacaaagacagtttcacgctcaaataggaaaatgtccttgctcaaaagaactcttgtaaggaagccatcaatgagacccagaaacttgacagaagtcctcttaaatacacagcacttggagttcttcagggagttcctcaaggaacggaaggctaaaatcccattgcaatttctcacagctgtacagaagatcagtatagagaccaatgaaaagatttgcaagtctctcatagaaaatgtaatcaagactttcttccaaggccaactctctcctgaagaaatgctgcagtgtgatgcccctattatcaaagaaatcgcttccatgcgtcatgtcaccacaagcacactgttaacgctccagggacatgttatgaaatctatagaagaaaagtggtttaaagattatcaagacctgttcccacctcaccatcaggaggtggaagtgcaaagtgaagtacaaatttcgtctaggaagccctcaaagatagtgtcaacttacctacaggaatcccagaagaaaggctggatgagaatgatcagctttatcaggagtttttgcaagtaccgcagatttatgttgaatcctagtaagcgccaggaatttgaagactatcttcaccaggaaatgcaaaatagcaaggaaaatttcaccacagcacacaacacatcgggacgttcagctccaccctccacaaatgtccggagtgcagaccaagagaatggagaaataacccttgtaaagcgtcgtatatttggccacaggattatcactgtcaactttgcgatcaatgatctatatttcttttctgaaatggagaaatttaatgatctggtcagttcagcccacatgctgcaggtcaaccgggcatataatgagaatgatgtgatcctaatgcggtccaaaatgaacattatccaaaaactcttcctgaattctgacatccctccaaagctgagggttttgtttctggaaggcaacccgctcttacttacagtatag

SEQ ID NO: 11379 - DNA, 3248 bp, synthetic construct
  misc_feature 1..3248: note = Synthetic polypeptide
  source 1..3248: mol_type = other DNA
gtgacgttaagtcttcatagggagaaggtgagataattggttctacaaatcttataattctgctagaggatgaagtctttgccgattttttcaacacatttctttccctcccggtttttggtcagacaccattttatactgttgaaaattcacagtggagcttgtggccagaaataccttgtaacttgattgccaaatacaaagggttattgacctggttggaaaaatgccgattacctttcttctgtaaaacaaacttgtgtttccattacattctctgtcaggagttcatcagtttcattaagtccccagaaggaggtgaagaattggtggatttctggatccttgctgagaacatcctgagcatagatgagatggacctggaagtgagagactactacctgtccctcctcctcatgctgagggccactcatctgcaggagggctccagggtggtaaccctctgtaacatgaacatcaagtccctcctgaacctctccatctggcatcccaaccaatcaaccactaggagggagatcctgagccacatgcagaaagtggctctgttcaaactccagagctattggcttcccaacttttacacccacaccaagatgaccatggccaaggaggaagcatgccatggtctgatgcaagagtacgagactcgcttatacagcgtttgctacacccacataggagggctccctctgaacatgagcatcaagaagtgccaccactttcagaaacggtactcaagcaggaaagccaagaggaagatgtggcaattggtagatcctgactcttggtctctggaaatggatctcaagccagatgctattggtatgcccctacaggagacatgtcctcaagagaaggtggttatacaaatgccttccctgaaaatggcttcttcaaaggaaacaagaatcagttccctggaaaaggatatgcattatgcaaaaatatccagcatggagaataaagccaagagccacctccacatggaagccccctttgagacaaaggtctctacccacctgaggactgtcatccccattgtcaatcactcctccaagatgacaattcagaaggccatcaagcaaagcttctccttaggatacatccacttggccttgtgtgctgatgcctgtgcagggaaccctttccgggaccacctgaagaagctgaatttgaaagtggagatccaacttcttgacctctggcaggacttgcagcatttcctcagtgtccttctgaataacaaaaagaatgggaatgcaatctttcgtcacttgctgggtgacagaatctgcgagctctacctgaatgagcagattggtccgtgcttaccactcaaatcccaaaccattcagggcctgaaggaactattgccctctggggatgtgatcccctggattcccaaagcccagaaggagatttgcaagatgctcagtccctggtatgatgagtttctagatgaagaggactactggtttctcctttttacgacacagaacaggttcatcagctccagacagcataaaagagaatttataggcaaagaagagaacattcttctttataagaggattcagcagtctctagagttaagccaggctttggctgacatgaaggaaatggactataggcagtggcgaaagatagctactgaggacctgaagcaaggaggctctctccaggtagagctgacatctccagtgtttctaacagacataactaaaatgtcctttgaggagctttgctacaagaacccaaagatggccatacagaagatcagtgatgactacaaaatatactgtgagaaagcacctaaaatagattttaaaatggaaattatcaaggaaacaaagacagtttcacgctcaaataggaaaatgtccttgctcaaaagaactcttgtaaggaagccatcaatgagacccagaaacttgacagaagtcctcttaaatacacagcacttggagttcttcagggagttcctcaaggaacggaaggctaaaatcccattgcaatttctcacagctgtacagaagatcagtatagagaccaatgaaaagatttgcaagtctctcatagaaaatgtaatcaagactttcttccaaggccaactctctcctgaagaaatgctgcagtgtgatgcccctattatcaaagaaatcgcttccatgcgtcatgtcaccacaagcacactgttaacgctccagggacatgttatgaaatctatagaagaaaagtggtttaaagattatcaagacctgttcccacctcaccatcaggaggtggaagtgcaaagtgaagtacaaatttcgtctaggaagccctcaaagatagtgtcaacttacctacaggaatcccagaagaaaggctggatgagaatgatcagctttatcaggagtttttgcaagtaccgcagatttatgttgaatcctagtaagcgccaggaatttgaagactatcttcaccaggaaatgcaaaatagcaaggaaaatttcaccacagcacacaacacatcgggacgttcagctccaccctccacaaatgtccggagtgcagaccaagagaatggagaaataacccttgtaaagcgtcgtatatttggccacaggattatcactgtcaactttgcgatcaatgatctatatttcttttctgaaatggagaaatttaatgatctggtcagttcagcccacatgctgcaggtcaaccgggcatataatgagaatgatgtgatcctaatgcggtccaaaatgaacattatccaaaaactcttcctgaattctgacatccctccaaagctgagggtgaatgtccctgagttccagaaggatgccatccttgctgccatcacagagggctacctagatcggagcgtcttccatggggctatcatgtctgtcttccccgttgttatgtacttctggaaaaggttttgtttctggaaggcaacccgctcttacttacagtatagggggaagaagttcaaggacagaaaaagccctcctaaatctacggacaagtatcctttctcgagtggaggagacaatgccatcttaaggttcaccttgctcagaggtattgagtggttgcagcctcaacgggaagcaataagttcagttcaaaattcttcatcaagcaaacttactcagccaagactcgtggtatctgccatgcagctgcatcccgtccagggacaaaaattatcctacatcaaaaaagagaagtaa

SEQ ID NO: 11380 - DNA, 500 bp, synthetic construct
  misc_feature 1..500: note = Synthetic polypeptide
  source 1..500: mol_type = other DNA
gtgacgttaagtcttcatagggagaaggtgagataattggttctacaaatcttataattctgctagaggatgaagtctttgccgattttttcaacacatttctttccctcccggtttttggtcagacaccattttatactgttgaaaattcacagtggagcttgtggccagaaataccttgtaacttgattgccaaatacaaagggttattgacctggttggaaaaatgccgattacctttcttctgtaaaacaaacttgtgtttccattacattctctgtcaggagttcatcagtttcattaagtccccagaaggaggtgaagaattggtggatttctggatccttgctgagaacatcctgagcatagatgagatggacctggaagtgagagactactacctgtccctcctcctcatgctgagggccactcatctgcaggagggctccagggtggtaaccctctgtaacatgaacatcaatgctcagtccctggtatga

SEQ ID NO: 11381 - DNA, 482 bp, synthetic construct
  misc_feature 1..482: note = Synthetic polypeptide
  source 1..482: mol_type = other DNA
gtgacgttaagtcttcatagggagaaggtgagataattggttctacaaatcttataattctgctagaggatgaagtctttgccgattttttcaacacatttctttccctcccggtttttggtcagacaccattttatactgttgaaaattcacagtggagcttgtggccagaaataccttgtaacttgattgccaaatacaaagggttattgacctggttggaaaaatgccgattacctttcttctgtaaaacaaacttgtgtttccattacattctctgtcaggagttcatcagtttcattaagtccccagaaggagaagccagagtgagcctcttaaaaagtaattggtggtggtgctggagggactcccaggaagatgatgaaataggaagcactaggaatctgtttcctcatctagacaacaattgtactggcagaatctgtatgatatgctcagtccctggtatgatgagtttctag

SEQ ID NO: 11382 - DNA, 1082 bp, synthetic construct
  misc_feature 1..1082: note = Synthetic polypeptide
  source 1..1082: mol_type = other DNA
ttccctttcctagccaagggaagccctgacagatggtacctggaaaatcaggacactcccaccctaatactgcacttttccaatggtcttagcaaacggcacaccaggagattatatcccgcgcatggctcagagggtcccatgcccacagagcctcgctaactgctagcacagcagtctgaaatagaactgcagggtggcagtgagactgggggaggggtgtccgccagtgctggggcttgagtaggtaaacaaagtagcctggaagctcaaactgggtggagcccaccacagctcaaggaggcctgccttcctgcctctatagactccacctctaggggcaggacatagctgaacaaaaggcagcagaaacttctgcagacttaaatgtccctgtctgacagctttgaagagagtagtggttctcccagcatggagttggagatctgagaacggacagactggcccctcaactgggcccttgacccccgagtagcctaactgggagacacctcccagtaggggccaactgacacctcatacagccaggtgcccctctgagacgaagcttccagaggaaggatcaggcagcaacatttgccattctacaatatttgctgttctgcagcctccactggtgatacccaggcaaacagtgtctgcagtggacgtccagcaaactccaacagacctgcagctcagggtcctgactgttagaaggaaaactaacaaacagaaaggacatccacaccaaaaccccgtttgtatgtcaccatcacgaaagaccaaaggcagataaaaccacaaagatggggagaaaccagagcagaaaagctgaaaattctgaaattcagagcgcctcttctcttccaaaggaatgcagctcctcgccagcaacggaacaaagctggacggagaatgactttgacgagttgagagaagaaggcttcagatgattggtcattaaatttgacggtggagaggaagtacttatttcaggggaattcaacgacctgagaaaggtcaccaaggagcagtgggacaccatagaagaactcatcaggaagacaaaaggttcctaa

SEQ ID NO: 11383 - DNA, 967 bp, synthetic construct
  misc_feature 1..967: note = Synthetic polypeptide
  source 1..967: mol_type = other DNA
ttccctttcctagccaagggaagccctgacagatggtacctggaaaatcaggacactcccaccctaatactgcacttttccaatggtcttagcaaacggcacaccaggagattatatcccgcgcatggctcagagggtcccatgcccacagagcctcgctaactgctagcacagcagtctgaaatagaactgcagggtggcagtgagactgggggaggggtgtccgccagtgctggggcttgagtaggtaaacaaagtagcctggaagctcaaactgggtggagcccaccacagctcaaggaggcctgccttcctgcctctatagactccacctctaggggcaggacatagctgaacaaaaggcagcagaaacttctgcagacttaaatgtccctgtctgacagctttgaagagagtagtggttctcccagcatggagttggagatctgagaacggacagactggcccctcaactgggcccttgacccccgagtagcctaactgggagacacctcccagtaggggccaactgacacctcatacagccaggtgcccctctgagacgaagcttccagaggaaggatcaggcagcaacatttgccattctacaatatttgctgttctgcagcctccactggtgatacccaggcaaacagtgtctgcagtggacgtccagcaaactccaacagacctgcagctcagggtcctgactgttagaaggaaaactaacaaacagaaaggacatccacaccaaaaccccgtttgtatgtcaccatcacgaaagaccaaaggcagataaaaccacaaagatggggagaaaccagagcagaaaagctgaaaattctgaaattcagagcgcctcttctcttccaaaggaatgcagctcctcgccagcaacggaacaaagctggacggagaatgactttgacgagttgagagaagaaggcttcagatgattggtcattaa

SEQ ID NO: 11384 - DNA, 343 bp, synthetic construct; identical to SEQ ID NO: 891
  misc_feature 1..343: note = Synthetic polypeptide
  source 1..343: mol_type = other DNA

SEQ ID NO: 11385 - DNA, 780 bp, synthetic construct
  misc_feature 1..780: note = Synthetic polypeptide
  source 1..780: mol_type = other DNA
acgggctttggaactggacctggctctaaatctcagctctgacacgctcagctgtgtggtttggaacgagctgttgaacctctggatgcaattcgacagctaggaggcatagtgcgtgacggagagaaggtggtggagataaacccagggctactggtcacggtgaaaaccacctccaggagctaccaagctaagagcttggtcatcacagcaggtccttggaccaaccagctcctccgtcccctgggcattgagatgcctctccagaccctgcggatcaacgtgtgttactggcgagagatggttcctgggagctatggtgtgtcccaggcctttccgtgcttcctgtggctgggcttgtgtccccaccacatctacggactgcccacaggagagtacccagggctgatgaaggtcagctatcaccacggcaaccacgcagaccctgaggagcgggactgccccacagcacgcacagacatcggagacgtccagatcctgagcagctttgtcagagatcacttacctgatctgaagcccgagcctgctgtcattgagagctgcatgtacacgaatacccctgatgagcagttcattctcgatcgccacccaaagtatgacaacattgtcattggtgctggattctctgggcacgggttcaagctggcccctgtggtggggaagatcctgtatgaattaagcatgaaattaacaccatcttatgacttggcaccttttcgaatcagccgtttcccaagcctgggcaaagcccacctttga

SEQ ID NO: 11386 - DNA, 264 bp, synthetic construct
  misc_feature 1..264: note = Synthetic polypeptide
  source 1..264: mol_type = other DNA
acgggctttggaactggacctggctctaaatctcagctctgacacgctcagctgtgtggtttggaacgagctgttgaacctctggatgcaattcgacagctaggaggcatagtgcgtgacggagagaaggtggtggagataaacccagggctactggtcacggtgaaaaccacctccaggagctaccaagctaagagcttggtcatcacagcaggtccttggaccaaccagctcctccgtcccctgggcattgagatgcctctc

SEQ ID NO: 11387 - DNA, 419 bp, synthetic construct
  misc_feature 1..419: note = Synthetic polypeptide
  source 1..419: mol_type = other DNA
acgggctttggaactggacctggctctaaatctcagctctgacacgctcagctgtgtggtttggaacgagctgttgaacctctggatgcaattcgacagctaggaggcatagtgcgtgacggagagaaggtggtggagataaacccagggctactggtcacggtgaaaaccacctccaggagctaccaagctaagagcttggtcatcacagcaggtccttggaccaaccagctcctccgtcccctgggcattgagatgcctctccagaccctgcggatcaacgtgtgttactggcgagagatggttcctgggagctatggtgtgtcccaggcctttccgtgcttcctgtggctgggcttgtgtccccaccacatctacggactgcccacaggagagtacccagggctgatgaaggtcag

SEQ ID NO: 11388 - DNA, 1647 bp, synthetic construct
  misc_feature 1..1647: note = Synthetic polypeptide
  source 1..1647: mol_type = other DNA
tgcagaacagttatgctggtggccttgaactgacccagttctctcttttttgcttgtagttctcaaaaataactagaatattctgtgaatgcaacatccagtgataaggagcgactggctggaacagcctgggctctgttccagtcccccctagaaacaggatgtccttcaacactttagcccagcatgtcatgttacccctggggtataaagcccagggtgggctgctatccagggtccctcagctgcggcgcaagtggagtatgtacaaacaaagcttcatctaccttggtaactttcctgagccttggaagaccagctcaacatgaatcctaggcttctgctgtcctttgctgtctttctgtgcagcagttcctgcggcaagcccagcgggggacagaggaaaaggagagagagggggctctggtcagccttcgtcgaggcttgcagcaccctgaaacacagcaaaccttcatccggctggagggcagcatgcggaccctggtcgggctcctgaccagcaaccaggccctgctgcagcttgaggcggctcggtgcctgcatgagctctctcactccgagcagtccactgttgctgaggcctgcctgccagccacttcttacctcctcacctacctctccagtcacagctcagacttcatagagctgtgtctgtatacactgggtaacctgatcgtggagagtgaggctgtgagaaggcagctcctgccacagggcattgttccagccttggctgcctgcatccagtccccccatgtggctgtgctggaagctctcggatatgccttgtcccagcttctacaggctgaggaagctccagagaagatcattccctccatcttggcctccactctccctcagcacatgctacaaatgttgcaacctggcccaaagctcaaccctggggtcgctgtggagtttgcctggtgccttcattacatcatctgcagccaggtcagcaatcctctgctcattggccatggggctctgtctactctggggttgctgctgttggacttggctggggctgtccagaaaaccgaggatgcaggactggagctgctggcatgccccgtgcttcgatgtctaagcaacctgctaactgaggcagcagtggagactgtgggagggcaaatgcagctcagagatgagcgtgttgtggcagccttatttatccttctgcagttctttttccagaaacagcccagtctgctccctgagggcctttggctcctcaacaacctcactgcaaacagtcctagtttctgtacctccttgctctccctggatctgattgagcctctcttacagctgttgccagtatctaacgtggtgagcgtaatggtgctcacagttctgtgcaatgttgcagaaaagggtcctgcttactgccagcggctgtggccagggcccctgcttcccgccttgctgcacacactagccttttctgacactgaagtagtaggccagagtttggagctgctgcatctgctgttcctgtatcagccagaggctgttcaggtcttcctgcagcagtcagggctgcaagccctggaaaggcatcaggaagaggcccagctccaggatcgtgtgtatgctctccagcagacagctcttcaagggtga

SEQ ID NO: 11389 - DNA, 522 bp, synthetic construct
  misc_feature 1..522: note = Synthetic polypeptide
  source 1..522: mol_type = other DNA
tgcagaacagttatgctggtggccttgaactgacccagttctctcttttttgcttgtagttctcaaaaataactagaatattctgtgaatgcaacatccagtgataaggagcgactggctggaacagcctgggctctgttccagtcccccctagaaacaggatgtccttcaacactttagcccagcatgtcatgttacccctggggtataaagcccagggtgggctgctatccagggtccctcagctgcggcgcaagtggagtatgtacaaacaaagcttcatctaccttggtaactttcctgagccttggaagaccagctcaacatgaatcctaggcttctgctgtcctttgctgtctttctgtgcagcagttcctgcggcaagcccagcgggggacagaggaaaaggagagagagggggctctggtcagccttcgtcgaggcttgcagcaccctgaaacacagcaaaccttcatccggtcagtgtggatggtgtggtggagggaggagttggggctctga

SEQ ID NO: 11390 - DNA, 458 bp, synthetic construct
  misc_feature 1..458: note = Synthetic polypeptide
  source 1..458: mol_type = other DNA
tgcagaacagttatgctggtggccttgaactgacccagttctctcttttttgcttgtagttctcaaaaataactagaatattctgtgaatgcaacatccagtgataaggagcgactggctggaacagcctgggctctgttccagtcccccctagaaacaggatgtccttcaacactttagcccagcatgtcatgttacccctggggtataaagcccagggtgggctgctatccagggtccctcagctgcggcgcaagtggagtatgtacaaacaaagcttcatctaccttggtaactttcctgagccttggaagaccagctcaacatgaatcctaggcttctgctgtcctttgctgtctttctgtgcagcagttcctgcggcaagcccagcgggggacagaggaaaaggagagagagggggctctggtcagccttcgtcgaggcttgcagcaccctga

SEQ ID NO: 11391 - DNA, 1665 bp, synthetic construct
  misc_feature 1..1665: note = Synthetic polypeptide
  source 1..1665: mol_type = other DNA
tgcagaacagttatgctggtggccttgaactgacccagttctctcttttttgcttgtagttctcaaaaataactagaatattctgtgaatgcaacatccagtgataaggagcgactggctggaacagcctgggctctgttccagtcccccctagaaacaggatgtccttcaacactttagcccagcatgtcatgttacccctggggtataaagcccagggtgggctgctatccagggtccctcagctgcggcgcaagtggagtatgtacaaacaaagcttcatctaccttggtaactttcctgagccttggaagaccagctcaacatgaatcctaggcttctgctgtcctttgctgtctttctgtgcagcagttcctgcggcaagcccagcgggggacagaggaaaaggagagagagggggctctggtcagccttcgtcgaggcttgcagcaccctgaaacacagcaaaccttcatccggctggagggcagcatgcggaccctggtcgggctcctgaccagcaaccaggccctgctgcagcttgaggcggctcggtgcctgcatgagctctctcactccgagcagtccactgttgctgaggcctgcctgccagccacttcttacctcctcacctacctctccagtcacagctcagacttcatagagctgtgtctgtatacactgggtaacctgatcgtggagagtgaggctgtgagaaggcagctcctgccacagggcattgttccagccttggctgcctgcatccagtccccccatgtggctgtgctggaagctctcggatatgccttgtcccagcttctacaggctgaggaagctccagagaagatcattccccctgcttctgccagcagctccatcttggcctccactctccctcagcacatgctacaaatgttgcaacctggcccaaagctcaaccctggggtcgctgtggagtttgcctggtgccttcattacatcatctgcagccaggtcagcaatcctctgctcattggccatggggctctgtctactctggggttgctgctgttggacttggctggggctgtccagaaaaccgaggatgcaggactggagctgctggcatgccccgtgcttcgatgtctaagcaacctgctaactgaggcagcagtggagactgtgggagggcaaatgcagctcagagatgagcgtgttgtggcagccttatttatccttctgcagttctttttccagaaacagcccagtctgctccctgagggcctttggctcctcaacaacctcactgcaaacagtcctagtttctgtacctccttgctctccctggatctgattgagcctctcttacagctgttgccagtatctaacgtggtgagcgtaatggtgctcacagttctgtgcaatgttgcagaaaagggtcctgcttactgccagcggctgtggccagggcccctgcttcccgccttgctgcacacactagccttttctgacactgaagtagtaggccagagtttggagctgctgcatctgctgttcctgtatcagccagaggctgttcaggtcttcctgcagcagtcagggctgcaagccctggaaaggcatcaggaagaggcccagctccaggatcgtgtgtatgctctccagcagacagctcttcaagggtga

SEQ ID NO: 11392 - DNA, 1025 bp, synthetic construct
  misc_feature 1..1025: note = Synthetic polypeptide
  source 1..1025: mol_type = other DNA
agcctacagattcagagtgtgcgttccagagccaggctctccaggtctgaatcttagccgtgtgacttcgggcaagtgacttaatgtctctgtgcttcaacgtcctcacctagagaatggagatgataatagtacttttgcataatgttgctgtgaggatgaacgagaaagcacgggaacggggcgccaaaatcatgcgggagccctgggtagagcaagacaagtttgggaaggtgaagtttgctgtgctgcagacgtatggggacaccacacacaccctggtggagaagatgaactacatcggccaattcttgcctggatatgaggccccagcgttcatggaccccctacttcctaaactgcccaaatgcagtctggagatgatcgaccacattgtgggaaaccagcctgatcaggagatggtgtccgcctccgaatggtacctgaaaaacctgcagttccaccgcttctggtccgtggatgacacgcaggtgcacacggaatatagctctctgcgatccattgtggtggccaactatgaagagtccatcaagatgcccatcaatgagccagcgcctggcaagaagaagtcccagatccaggaatatgtggactataacgggggcgctggggtccagcacatcgctctcaagaccgaagacatcatcacagcgattcgccacttgagagagagaggcctggagttcttatctgttccctccacgtactacaaacaactgcgggagaagctgaagacggccaagatcaaggtgaaggagaacattgatgccctggaggagctgaaaatcctggtggactacgacgagaaaggctacctcctgcagatcttcaccaaaccggtgcaggaccggcccacgctcttcctggaagtcatccagcgccacaaccaccagggttttggagccggcaacttcaactcactgttcaaggctttcgaggaggagcagaacctgcggggtaacctcaccaacatggagaccaatggggtggtgcccggcatgtaa

SEQ ID NO: 11393 - DNA, 1052 bp, synthetic construct; identical to SEQ ID NO: 789
  misc_feature 1..1052: note = Synthetic polypeptide
  source 1..1052: mol_type = other DNA

SEQ ID NO: 11394 - DNA, 974 bp, synthetic construct; identical to SEQ ID NO: 790
  misc_feature 1..974: note = Synthetic polypeptide
  source 1..974: mol_type = other DNA

SEQ ID NO: 11395 - DNA, 682 bp, synthetic construct; identical to SEQ ID NO: 792
  misc_feature 1..682: note = Synthetic polypeptide
  source 1..682: mol_type = other DNA

SEQ ID NO: 11396 - DNA, 500 bp, synthetic construct; identical to SEQ ID NO: 793
  misc_feature 1..500: note = Synthetic polypeptide
  source 1..500: mol_type = other DNA

SEQ ID NO: 11397 - DNA, 6357 bp, synthetic construct
  misc_feature 1..6357: note = Synthetic polypeptide
  source 1..6357: mol_type = other DNA
aagatggccaaacaggaacagctccagtctacagctcccagcgtgagcaacacagaagacgaatgatttctgcatttccaactgaggtaccgggtgcatctcaatggggattgttggagagtgggtgcaggacagtgggtgcagtgcacccagcctgagccaaagcagggcgaggcatcacctcacctgggaagtgcaaggggtcagggaattccctttcctaggggtgacggacagcacctggaaaatcaggtcactcccaccctaatactgcgcttttctgatggtcttagcaaacggcacaccaggagattatatcccgcgcatggctcggagggtcctacgcccatggagcctcgctcattgctagcacagcagtctgagatcgaactgcaaggcagcagcaaggctgggggaggggcgcccgccattgctaaggcttgagtaggtaaacaaagctgccaggaagctcaaactgggtgaagcccaccgcagctcaaggaggtctgcctgcctctgtagactccacctctaggggcagagcatagccaaccaaaaggcagcagaaacctctgcagacttaaatgtccctgtctgacagctttgaagagagtagtggttctcccagcacacagctggagatctgagaacagacagactgcctcctcaagtgggtccctgacccccgagcagcctaactgggaggcaccccccagtaggggcagactgacacctcacacggccgggtactcctctgagacaaaacttccagaggaatgatcaggcagcagcatttgcgggtcaccaataccgctgttctgcagcctccactcctgatacccaggcaaacagggtctggagtggacctccggcaaactccaacagacctgcagctgaggatcctgactgtcagaaggaaaactaacaaacagaaaggacatccacaccaaaacccatctgtacatcaccatcatcaaagatcaaaggtagataaaaacacaaagatgggggaaaaacagcagaaaaactgaaaaatctaaaaatcagagcacctctcctcctccaaaggaacgcagctccgcaccagcaacggaaagctggatggagaatgactttgacgagttgagagaagaaggcttcagacgatcaaactactccgagctaaaggaggaagttcgaacccatggcaaagaagttaaaaaccttgaaaaaagattagacaaatggctaactagaataatcaatgcagagaagtccttaaaggacctgatggagctgaagaccatggcacgagaactacgtgatgaatgcacaagcctcagtagccaattcaatcaactggaagaaagggtatcagtgatggaagatcaaatgaatgaaatgaagaaagaagagaagtttagaagaaaaagaataaaaagaaaggaacaaagcctccaagaaatatgggactatgtgaaaagaccaaatctacgtctgattggtgtacctgaaagtgacggggagaatagaacgaagttggaaaacactctgcaggatattatccaggagaacttccccaatctagcaaggcaggccaacattcaaattcaggaaatacagagaacgccacaaagatactcctcgagaagagcaactccaagacacataattgtcagattcaccaaagttgaaatgaaggaaaaaatgttaagggcagccagagagaaaggtcgggttacccacaaacacaaacccatcagactaacagtggatctctcggcagaaactctacaagccagtagagagtgggggccaatattcaacattcttaaagaaaagaattttcaacccagaatttcatttccagccaaactaagcttcataagtgaaggagaaataaaatactttacagacaagcaaatgctgagagattttgtcaccaccaggcctgccctaaaagagctcttgaaggaagcactaaacatggaaaggaacaactggtaccagccactgcaaaaacatgccaaattgtaaagaccatcgaggctaaggagaaactgcatcaactaacgagcaaaataatcagctaacatcataatgacaggatcaaattcacatataaaaatattaaccttaaatgtaaacgggctaaatgctccaattaaaagacacagactggcaaactggatagagtcaagacccatcggtgtgctgtattcaggaaacccatctcacgtgcaaagtaacacataggctcaaaataaagggatggaggaagatctaccaagcaaatggacaacaaaaaaaggcaggggttgcaatcctactctctgataaaacaggctttaaaccaacaaagatcaaaagagacaaagaaggccattacataatggtaaagggatcaattcaacaagaagagctaactatcctaaatatatatgcacccaatacaggagcacccagattcatgaagcaagtctttagagacttacaaagagagttagactcccacacaataataatggaagactttaacaccacactgtcaacactagacagatcaacaggacagaaagttaagaaggatatccaggaattgaactcagctctgcacaaagtggacataatagacatctacagaactctccaccccaaatcaacagaatatacattcttttcagcaccacaccacacctattccaaaattaaccacatagttggaagtaaagcactcctcagcaaatgtaaaagaacagacattataacaaactgtctctcagaccacagtgcaatcaaactagaactcaggattcagaaactcactcaaaaccgctcaactacatggaaactgaacaacctgctcctgaatgactactgggtacataacgaaatgaaggcagaaataaagatgttctttgaaaccaacaagaacaaagacacaacataccagaatctctgggccacattcaaagcaatgtgtagagggaaatttatagcactaaatgcctacaagagaaagcaggaaagatctaacattgacaccctaacatcacaatgaaaagaactagagaagcaggagcaaacacattcaaaagatagcagaaggcaagaaataactaagatcagagcagaactgaaggaaacagagacacaaaaaaacccttcaaaaaaatcaatgaatccaggagctggttttttgaaaagatcaacaaaattgatagaatgctagcaagactaataaagaagaaaagagagaagaatcaaatagatgcaataaaaatgataaaggggatatcaccacccatcccacagaaatacaaactaccatcagagaatactataaacacctctatgcaaataaactagaaaatctagaagaaatggataaattcctcgacacatacactctcccaagactaaaccaggaagaagttgaaactctgaatagaccaataacaggttctgaaattgaggcaataattaatagcttaccaaccaaaaaaagtccaggaccagatggattcaccgccgaattctaccagaggtacaaggaggacctggtaccattctttctgaaactattccaatcaatagaaaaagagggaatcctccctaactcattttatgaggccagcatcatcctgataccaaagcctggcagagacacaaccaaaaaagagaattttagaccaatatccctgatgaacagtgatacaaaaatcctcaataaaatactggcaaaccgaatccagcagcacatcaaaaagcttatccaccatgatcaagtgggcttcatccctgggatgcaaggctggttcaacatacgcaaatcaataaacataatccagcatataaacagaaccaacgacaaaacccacatgattatctcaatagatgcagaaaaggcctttaacaaaattcaacagcccttcatgctaaaaactctgaataaattaggtattgatggaacctatctcaaaataataagagcaaatttatgacaaacccacagccaatatcatactgaatggacaaaaactggaatcattccctttgaaaactggcacaagacagggatgccctctctcaccactcctattcaacatagtgttggaagttctggccagggcaatcaggcaagagaaagaaataaagggtattcaattaggaaaagaggaagtcaaattgtccctgtttgcagatgacatgattgtatatctagaaaaccccatcgtctcagcccaaaatctccttaagctgataaacaacttcagcaaagtatcaggatacaaaatcaatgtgcaaaaatcacaaatattcttatacaccaataacagacaaacagagagccaaatcatgagtgaactcccattcacaattgcttcaaagacaataaaatacctaggaattcaacttacaagggatgtgaaggacctcttcaaggagaattacaaaccactgctcaatgaaataaaagaagatacaaacaaatggaacaacattccatgctcatgggtaggaagaatcaatatcatgaaaatggccatactgcccaaggtaatttatagattcagtgccatcgccatcaagctaccaatgactttcttcacagaactggaaaaaactactttaaagttcatatggaaccaaaaaagagcccgcattgccaagtcaatcctaagccaaaagaacaaagccggaggcatcatgctacctgacttcaaactatactacaaggctacagtaaccaaaacagcatggtactggtaccaaaacagagatattgatcaatggagcagaacagagccctgagaaagaatgccacatatctacaaccatctgatctttgacaaacctgacaaaaacaagcagtggggaaaggattccctatttaataaatggtgctgggaaaactggctagccatatatagaaagctgaaactggatcccttccttacaccttatacaaaaattaattcaagatggattaaagacttacatgttagacctaaaaccataaaaaccctagaagaaaacctaggcaatatcattcaatacagaggcatgggcaaggacttcatgtctaaaacaccaaaagcaatggcaacaaaagccaaaattgacaaatgggatctaatgaaactaaagagcttctgcacagcaaaagaaactaccatcagagtgaacaggcaaccgacagaatgggagaaaatttttgcaacctactcatctgacaaagggctaatatccagaatctacaatgatctcaaacaaatttacaagaaaaaaacacaaccccatcaacaagtgggggaaggatatgaacagacacttctcaaaagacatttatgcagccaatagacacatgaaaaaatgttcatcatcactggccatcaaagaaatgcaaatcaaaaccacaatgagataccatctcacgccagttagaatggcgatcattaaaaagtcaggaaacaacaggtgctggagaggatgtggagaaaacaggaacacttttacactgttggtgggactgtaaactagttcaaccattgtggaagtcagtgtggtgattcctcagggatctagaactagaaataccatttgacccagccatcccattactgggtatatacccaaaggattataaatcatcctgctataaacacacatgcacacttatgtttattgcagcactattcacaatagcaaagacttggaaccaacccaaatgtccaataatgatagactggattaagaaaatgtggcacatatacaccatggaatgctatgcagccataaaaaatgatgagttcatgtcctttgtagagacatggatgaagctggaaaccatcattctcagcaaactatggcaaggacaaaaaaccaaacactgcaccacctacctatgatgccgtggtacagatggagtaccttgacatggtggtgaatgaaacactcagattattcccagttgctattagacttgagaggacttgcaagaaagatgttgaaatcaatggggtattcattcccaaagggtcaatggtggtgattccaacttatgctcttcaccatgacccaaagtactggacagagcctgaggagttccgccctgaaaggttcagtaagaagaaggacagcatagatccttacatatacacaccctttggaactggacccagaaactgcattggcatgaggtttgctctcatgaacatgaaacttgctctaatcagagtccttcagaacttctccttcaaaccttgtaaagaaacacagatccccttgaaattagacacgcaaggacttcttcaaccagaaaaacccattgttctaaaggtggattcaagagatggaaccctaagtggagaatga

SEQ ID NO: 11398 - DNA, 625 bp, synthetic construct; identical to SEQ ID NO: 6804
  misc_feature 1..625: note = Synthetic polypeptide
  source 1..625: mol_type = other DNA

SEQ ID NO: 11399 - DNA, 598 bp, synthetic construct; identical to SEQ ID NO: 6805
  misc_feature 1..598: note = Synthetic polypeptide
  source 1..598: mol_type = other DNA

SEQ ID NO: 11400 - DNA, 1911 bp, synthetic construct; identical to SEQ ID NO: 10254
  misc_feature 1..1911: note = Synthetic polypeptide
  source 1..1911: mol_type = other DNA

SEQ ID NO: 11401 - DNA, 804 bp, synthetic construct; identical to SEQ ID NO: 10255
  misc_feature 1..804: note = Synthetic polypeptide
  source 1..804: mol_type = other DNA

SEQ ID NO: 11402 - DNA, 531 bp, synthetic construct; identical to SEQ ID NO: 10256
  misc_feature 1..531: note = Synthetic polypeptide
  source 1..531: mol_type = other DNA

SEQ ID NO: 11403 - DNA, 494 bp, synthetic construct; identical to SEQ ID NO: 10257
  misc_feature 1..494: note = Synthetic polypeptide
  source 1..494: mol_type = other DNA

SEQ ID NO: 11404 - DNA, 398 bp, synthetic construct
  misc_feature 1..398: note = Synthetic polypeptide
  source 1..398: mol_type = other DNA
acttctgcttctggccaggccgtagttacaaggaccagactttaatgttcctccatgaacaactagaaaactggacaaagtatatgaaacaactgtttgcagacattggacaactggtcaaacaagaccgagatccccaacaagaccgagaccctggacgagtccgagatcccggacaagaccgccacccttgttggaagggagacaggcaagagctcccagctcctccagcagccgacaggaggcccgtcaagatgcaggcaggcattgccaccccagggatgaagacagcagcccaggcaaaggccaagaccacaggagcctcccggtctcatcctgcaaaagctaaaggctgccagaggccccccaagatccgtaactacaacattatggactga

SEQ ID NO: 11405 - DNA, 349 bp, synthetic construct
  misc_feature 1..349: note = Synthetic polypeptide
  source 1..349: mol_type = other DNA
acttctgcttctggccaggccgtagttacaaggaccagactttaatgttcctccatgaacaactagaaaactggacaaagtatatgaaacaactgtttgcagacattggacaactggtcaaacaagaccgagatccccaacaagaccgagaccctggacgagtccgagatcccggacaagaccgccacccttgttggaagggagacaggcaagagctcccagctcctccagcagccgacaggaggcccgtcaagatgcaggcaggcattgccaccccagggatgaagacagcagcccaggcaaaggccaagaccacaggagcctcccggtctcatcctgcaaaagctaa

SEQ ID NO: 11406 - DNA, 1137 bp, synthetic construct
  misc_feature 1..1137: note = Synthetic polypeptide
  source 1..1137: mol_type = other DNA
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaa

SEQ ID NO: 11407 - DNA, 585 bp, synthetic construct
  misc_feature 1..585: note = Synthetic polypeptide
  source 1..585: mol_type = other DNA
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctga

SEQ ID NO: 11408 - DNA, 401 bp, synthetic construct
  misc_feature 1..401: note = Synthetic polypeptide
  source 1..401: mol_type = other DNA
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaa

SEQ ID NO: 11409 - DNA, 678 bp, synthetic construct
  misc_feature 1..678: note = Synthetic polypeptide
  source 1..678: mol_type = other DNA
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaagatctttgataccatactttaatctgtatcttcagtttctgaacataagtatgcaaaatctttttaaggtgcatactctgctgcgtccctgctattttctaggacaaaaataa

SEQ ID NO: 11410 - DNA, 1173 bp, synthetic construct
  misc_feature 1..1173: note = Synthetic polypeptide
  source 1..1173: mol_type = other DNA
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggctggtagcaagttctggatcttatacccaacacacagcaacatccagaaataa

SEQ ID NO: 11411 - DNA, 1092 bp, synthetic construct
  misc_feature 1..1092: note = Synthetic polypeptide
  source 1..1092: mol_type = other DNA
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatgaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaa

SEQ ID NO: 11412 - DNA, 855 bp, synthetic construct
  misc_feature 1..855: note = Synthetic polypeptide
  source 1..855: mol_type = other DNA
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggtctgggagaactgatcttgctgaaaatacaacaggaagcagtatcgtgccaggcaaggcaaaccctcgtcagtgtgaagcaatggccatcgttgcagcccaagtcatggggttttgtgtggcagtaa

SEQ ID NO: 11413 - DNA, 771 bp, synthetic construct
  misc_feature 1..771: note = Synthetic polypeptide
  source 1..771: mol_type = other DNA
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggctgctgggggatgcttcagtttccttcacagaaaactaaatag

SEQ ID NO: 11414 - DNA, 834 bp, synthetic construct
  misc_feature 1..834: note = Synthetic polypeptide
  source 1..834: mol_type = other DNA
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggtctgggagaactgatcttgctgaaaatacaacaggaagcagtatcgtgccaggcaaggcaaaccctcgtcagtgtgaagcaatggccatcgttgcagcccaagtcatggggttttgtgtggcagtaaccgttggaggcggcaatggccattttgagttggatgttttcaagccaatgatgattaaaaatttatgttacactcaggctgctgggggatgcttcagtttccttcacagaaaactaaatagtgggaatccggaccaataa

SEQ ID NO: 11415 - DNA, 768 bp, synthetic construct
  misc_feature 1..768: note = Synthetic polypeptide
  source 1..768: mol_type = other DNA
ggccgggcgcagcggctcaagcctgtaatcccggcactttgagaggccgaggtgggcggatcacgagcagagcactgtccagagcttcctccagtggacaatagcatatttgtcgcaaaggaggtggaaggacagattctggggacttacgtttgtatcaagggctaccacctggtaggaaagaagacccttttttgcaatgcctctaaggagtgggataacaccactactgagtgccgcttgggccactgtcctgatcctgtgctggtgaatggagagttcagttcttcagggcctgtgaatgtaagtgacaaaatcacgtttatgtgcaatgaccactacatcctcaagggcagcaatcggagccagtgtctagaggaccacacctgggcacctccctttcccatctgcaaaagtagggactgtgaccctcctgggaatccagttcatggctattttgaaggaaataacttcaccttaggatccaccattagttattactgtgaagacaggtactacttagtgggcgtgcaggagcagcaatgcgttgatggggagtggagcagtgcacttccagtctgcaagttgatccaggaagctcccaaaccagagtgtgagaaggcacttcttgcctttcaggagagtaagaacctctgcgaagccatggagaactttatgcaacaattaaaggaaagtggcatgacaatggaggagctaaaatattctctggagctgaagaaagctgagttgaaggcaaaattgttgtaa

SEQ ID NO: 11416 - DNA, 552 bp, synthetic construct
  misc_feature 1..552: note = Synthetic polypeptide
  source 1..552: mol_type = other DNA
ggccgggcgcagcggctcaagcctgtaatcccggcactttgagaggccgaggtgggcggatcacgagcagagcactgtccagagcttcctccagtggacaatagcatatttgtcgcaaaggaggtggaaggacagattctggggacttacgtttgtatcaagggctaccacctggtaggaaagaagacccttttttgcaatgcctctaaggagtgggataacaccactactgagtgccgcttgggccactgtcctgatcctgtgctggtgaatggagagttcagttcttcagggcctgtgaatgtaagtgacaaaatcacgtttatgtgcaatgaccactacatcctcaagggcagcaatcggagccagtgtctagaggaccacacctgggcacctccctttcccatctgcaaaagtagggactgtgaccctcctgggaatccagttcatggctattttgaaggaaataacttcaccttaggatccaccattagttattactgtgaagacaggtactacttagtgggcgtgcaggagcagcaatgcgttgat

SEQ ID NO: 11417 - DNA, 1172 bp, synthetic construct
  misc_feature 1..1172: note = Synthetic polypeptide
  source 1..1172: mol_type = other DNA
aatttggtggcccatacagggaaaacattgtcctccgggaaagggtctttgatcacctcttgtgaggagacacatcccactgccttgttgcagtggcctcatgagtaaggaatcgagacccacctggtctgatgaataaccccagactctcaacaacgtggggagaaaaagacttgcaacactatggtggccaggtaactctgtgcgcagaccaagatgaccgcttcccgaagccccctgagattgcaaatggctatgtggagcacttgtttcgctaccagtgtaagaactactacagactgcgcacagaaggagatggagtatacaccttaaatgataagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggggccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggtggttctacaccctaactaccaccaggtagatattgggctcatcaaactcaaacagaaggtgcttgttaatgagagagtgatgcccatctgcctaccttcaaagaattatgcagaagtagggcgtgtgggttacgtgtctggctggggacaaagtgacaactttaaacttactgaccatctgaagtatgtcatgctgcctgtggctgaccaatacgattgcataacgcattatgaaggcagcacatgccccaaatggaaggcaccgaagagccctgtaggggtgcagcccatactgaacgaacacaccttctgtgtcggcatgtctaagtaccaggaagacacctgctatggcgatgcgggcagtgcctttgccgttcacgacctggaggaggacacctggtacgcggctgggatcctaagctttgataagagctgtgctgtggctgagtatggtgtgtatgtgaaggtgacttccatccagcactgggttcagaagaccatagctgagaactaa

SEQ ID NO: 11418 - DNA, 479 bp, synthetic construct
  misc_feature 1..479: note = Synthetic polypeptide
  source 1..479: mol_type = other DNA
aatttggtggcccatacagggaaaacattgtcctccgggaaagggtctttgatcacctcttgtgaggagacacatcccactgccttgttgcagtggcctcatgagtaaggaatcgagacccacctggtctgatgaataaccccagactctcaacaacgtggggagaaaaagacttgcaacactatggtggccaggtaactctgtgcgcagaccaagatgaccgcttcccgaagccccctgagattgcaaatggctatgtggagcacttgtttcgctaccagtgtaagaactactacagactgcgcacagaaggagatggagtatacaccttaaatgataagaagcagtggataaataaggctgttggagataaacttcctgaatgtgaagcagtatgtgggaagcccaagaatccggcaaacccagtgcagcggatcctgggaggacacctggtacgcggctgggatcctaagctttga

SEQ ID NO: 11419 - DNA, 1120 bp, synthetic construct
  misc_feature 1..1120: note = Synthetic polypeptide
  source 1..1120: mol_type = other DNA
ttccagcagttcagttttaattgttcatttgtttgtggaatcatttcagtgtttggctctgcccacttggatgtaagctccaggagctctgggagaccaagtacaccatctgttttgcccattgctggaactccgtggttgggcacctgcctggcacctaattttccgccgtgcggacaaaaatgatgatgggaagctgtccttggaggaattccagctcttctttgcagatggcgtccttaatgagaaagaactggaggatctctttcacacgattgactctgacaacaccaaccatgtggacaccaaggagctgtgtgattactttgtggaccacatgggtgactatgaggatgtcctggcctccctggagaccttgaatcactctgtcctgaaggccatgggttataccaagaaggtatatgagggtgggagcaacgtggaccagtttgtgacccgcttcctcctgaaggagacggccaatcagatccagtcgctgctgagctcagtggagagtgcggtggaggccatcgaggaacagaccagccagctccgacagaaccacatcaaacccagccacagcgcggcacagacctggtgtggaagccccactcccgcctctgcccccaaccacaagctcatggctatggaacaaggcaagacccttccatctgccacggaggatgcaaaggaagagggtctggaagcccagatcagccgcttggcagagctgattgggaggctggagagcaaagcactgtggttcgacctgcagcagcgcctgtcagatgaagatggcaccaacatgcacctgcagctggtccggcaggagatggccgtgtgccccgagcaactgagcgagtttctggactctctgcgccagtatctgcgggggaccactggcgtgaggaactgcttccacatcactgccgtgaggctctcagatggcttcacctttgtcatctatgagttctgggagacagaggaggcgtggaagaggcacctgcagagccccctgtgtaaggcgttccggcacgtcaaggtggacacactgagccagcctgaggccctctccaggatcttggtgccagctgcttggtgcacggtgggacgggactga

SEQ ID NO: 11420 - DNA, 924 bp, synthetic construct; identical to SEQ ID NO: 7243
  misc_feature 1..924: note = Synthetic polypeptide
  source 1..924: mol_type = other DNA

SEQ ID NO: 11421 - DNA, 963 bp, synthetic construct; identical to SEQ ID NO: 7244
  misc_feature 1..963: note = Synthetic polypeptide
  source 1..963: mol_type = other DNA

SEQ ID NO: 11422 - DNA, 580 bp, synthetic construct
  misc_feature 1..580: note = Synthetic polypeptide
  source 1..580: mol_type = other DNA
gtggcaggctgaagaatggcccctaaagtgtccatgtcctgatccccagaaccttggtggacacttcaaccctgcggtgtccctggcagccatgctgatcggaggcctcaacctggtgatgctcctcccgtactgggtctcacagctgctcggggggatgctcggggctgccttggccaaggcggtgagtcctgaggagaggttctggaatgcatctggggcggcctttgtgacagtccaggagcaggggcaggtggcaggggcgttggtggcagagatcatcctgacgacgctgctggccctggctgtatgcatgggtgccatcaatgagaagacaaagggccctctggccccgttctccatcggctttgccgtcaccgtggatatcctggctgggggccctgtgtctggaggctgcatgaatcccgcccgtgcttttggacctgcggtggtggccaaccactggaacttccactggatctactggctgggcccactcctggctggcctgcttgttggactgctcattaggtgcttcattggagatgggaagacccgcctcatcctgaaggctcggtga

SEQ ID NO: 11423 - DNA, 1327 bp, synthetic construct
  misc_feature 1..1327: note = Synthetic polypeptide
  source 1..1327: mol_type = other DNA
tttctgggggcctgtctgggatttctccaaagcgatccgagtgatggtggacctgtgcaacagcaccaagggcatctgcctcacaggaccttctggaccaccaggacctccgggagccggcgggttgccaggacacaacggattggatggacagcctggtcctcagggcccaaaaggagaaaaaggagcaaatggaaaaagaggaaaaatggggatacctggagctgcaggaaatccaggggaaaggggagaaaagggagaccatggtgaactgggcctgcagggaaatgagggcccaccagggcagaagggagaaaagggtgacaaaggagatgtgtccaacgacgtgctcctggcaggtgccaaaggtgaccaaggcccacccggtccacctgggcccccaggccctccaggtcctccagggccccctggaagcagaagagccaaaggccctcggcagccaagcatgttcaacggccagtgcccaggtgagacttgtgccataccaaatgatgataccttggttggaaaagctgatgagaaagccagtgaacaccattccccacaagcagaatccatgatcacttccattggaaacccagtgcaagtactgaaagtgacagagacatttgggacttggataagagagtctgctaacaagagtgatgaccggatttgggtgacagagcatttttcaggcatcatggttaaggaattcaaggatcagccctcacttctgaatggcagttacacgttcatccaccttccatactatttccatggctgtgggcacgttgtttacaacaactctctctactaccacaaagggggttctaataccctagtgagatttgaatttggccaggaaacatcccaaactctgaagcttgaaaatgccttgtattttgatcgaaaatacctttttgcaaattccaaaacttacttcaatctagctgtagatgaaaagggcctttggattatctatgcgtcaagtgtggacggctcgagcattcttgtagcacaactggatgagaggacattctcagtggtgcaacacgtcaataccacgtaccctaaatccaaggctggcaacgccttcattgcccgaggaatcctctatgtcacagacaccaaagatatgagggtcacatttgcctttgatttgttaggagggaaacagatcaatgcaaactttgatttaagaacttcccagtctgttcttgccatgttagcatacaacatgagagatcagcatttatattcatgggaagatggccatttaatgctttatcctgtgcagtttttgtcaactaccttaaatcagtga

SEQ ID NO: 11424 - DNA, 508 bp, synthetic construct
  misc_feature 1..508: note = Synthetic polypeptide
  source 1..508: mol_type = other DNA
tttctgggggcctgtctgggatttctccaaagcgatccgagtgatggtggacctgtgcaacagcaccaagggcatctgcctcacaggaccttctggaccaccaggacctccgggagccggcgggttgccaggacacaacggattggatggacagcctggtcctcagggcccaaaaggagaaaaaggagcaaatggaaaaagaggaaaaatggggatacctggagctgcaggaaatccaggggaaaggggagaaaagggagaccatggtgaactgggcctgcagggaaatgagggcccaccagggcagaagggagaaaagggtgacaaaggagatgtgtccaacgacgtgctcctggcaggtgccaaaggtgaccaaggcccacccggtccacctgggcccccaggccctccaggtcctccagggccccctggaagcagaagagccaaaggccctcggcagccaagcatgttcaacggccagtgcccaggtgagacttgtgccatacca

SEQ ID NO: 11425 - DNA, 278 bp, synthetic construct; identical to SEQ ID NO: 8451
  misc_feature 1..278: note = Synthetic polypeptide
  source 1..278: mol_type = other DNA

SEQ ID NO: 11426 - DNA, 136 bp, synthetic construct; identical to SEQ ID NO: 8452
  misc_feature 1..136: note = Synthetic polypeptide
  source 1..136: mol_type = other DNA

SEQ ID NO: 11427 - DNA, 93 bp, synthetic construct
  misc_feature 1..93: note = Synthetic polypeptide
  source 1..93: mol_type = other DNA
ctccaagatcatgacaactggcccaagggagcaggggacctttctgttgtcaaaaagatgaaggagacctttaaggagaaagctaagctctga

SEQ ID NO: 11428 - DNA, 883 bp, synthetic construct; identical to SEQ ID NO: 9631
  misc_feature 1..883: note = Synthetic polypeptide
  source 1..883: mol_type = other DNA

SEQ ID NO: 11429 - DNA, 630 bp, synthetic construct
  misc_feature 1..630: note = Synthetic polypeptide
  source 1..630: mol_type = other DNA
tgtggcagaaactgcttagtgtcccctaatatccattcttccccttttctacagtataaagcccctccttccacgttttagctgggctcatggctgcccacttcatttcctagcccaccttggcaaccagattttgccatttgattaaggtctggccagagggaagtatgaggaagtgacgtgtataacattctggagtgtgtttactgaagagaggggctggacccttccaactcctgccatcctgctacaggaaaggcaccaatgcccagacctggctacaagccccaagagcccaatggctgcggctcctatttcctgggtctcaaggtaccagaaagtatggacttgggcattccagcaatgacaaagtgctgcaaccagctggatgtctgttatgacacttgcggtgccaacaaatatcgctgtgatgcaaaattccgatggtgtctccactcgatctgctctgaccttaagcggagtctgggctttgtctccaaagtggaagcagcctgtgattccctggttgacactgtgttcaacaccgtgtggaccttgggctgccgcccctttatgaatagtcagcgggcagcttgcatctgtgcagaggaggagaaggaagagttatga

SEQ ID NO: 11430 - DNA, 820 bp, synthetic construct
  misc_feature 1..820: note = Synthetic polypeptide
  source 1..820: mol_type = other DNA
gccaggcgcagtggctcacgcctgtaatcccagcacttggggaggccgaggcaggcagatcatgaggtcaggagatcgagaccatcctggctaacatggaacaaactggttggctgagattctctgcctgatgcactccaagggggatgccaagtggatccaatctgtgcccatctgggagcgatcaccctgggtagagagtgagattgggtatacagcactcagtgaaacggagagtccacgtttattctcctcccacctccccatccagttattccccaagtctttcttcagttccaaggccaaggtgatttatctcatgagaaatcccagagatgttttggtgtctggttattttttctggaaaaacatgaagtttattaagaaaccaaagtcatgggaagaatattttgaatggttttgtcaaggaactgtgctatatgggtcatggtttgaccacattcatggctggatgcccatgagagaggagaaaaacttcctgttactgagttatgaggagctgaaacaggacacaggaagaaccatagagaagatctgtcaattcctgggaaagacgttagaacccgaagaactgaacttaattctcaagaacagctcctttcagagcatgaaagaaaacaagatgtccaattattccctcctgagtgttgattatgtagtggacaaagcacaacttctgagaaaaggtgtatctggggactggaaaaatcacttcacagtggcccaagctgaagactttgataaattgttccaagagaagatggcagatcttcctcgagagctgttcccatgggaataa

SEQ ID NO: 11431 - DNA, 376 bp, synthetic construct; identical to SEQ ID NO: 10759
  misc_feature 1..376: note = Synthetic polypeptide
  source 1..376: mol_type = other DNA

SEQ ID NO: 11432 - DNA, 568 bp, synthetic construct
  misc_feature 1..568: note = Synthetic polypeptide
  source 1..568: mol_type = other DNA
agtatggtgatttctcaaaaaactaaacagaactaccatatgatccagcaatcccactactgggtatttatccaaaggaaaagaaatcagcatatcaaaaagatgtctacactcccatgttaattgcagcactattcacaatacgaagatatgggatcaacctaagtatccaatggatgaaaggataaataatatgtggtatatatacacaatggaatactatttggcattaaaaaagagtgaaatcatgtcatctgcagcaacatggagagaactggaggtcattatgttaactgaagtaagccaggcacagaaaataaatatcacgtgtttgcactcataagtggtgaaggcatttgtgatcctggcctcgcagttcctatcccatgacccagaacagctcaccaaggagctgcagcagcatgtgaagtcagtgacagccccatacaagtacccaagaaagatagagtttgtcttgaacctgcccaagactgtcacagggaaaattcaacgaaccaaacttcgagacaaggagtggaagatgtccggaaaagcccgtgcgcagtga

SEQ ID NO: 11433 - DNA, 1088 bp, synthetic construct
  misc_feature 1..1088: note = Synthetic polypeptide
  source 1..1088: mol_type = other DNA
gggaaatgcaaaccataactacagtgaggtatcaccttatacccattaggataatcactatcaaaagaacagaaattggcaaatgttagcaaagttgcatagaaattggaacgcttgtacactgttggtaggaatgtaaagtggttcaatcattatggaaaacagtatggaagtccctcaaaacattaaaaatagaattaacatgtaatccatcaattccacttctgggtatatatcttaaaaattcaaagtgggatctcaaagagatttgcacttccatgttcactgcagaattattcacaataaccaagaggtggaagcaacccatatgtccatcaacagatgaatggatgaagacaatgtgcaatctcataaagttagcccaaaaagtgcctactgctgatctggaggatgttttgccactagctgaagatattactaacatcctctccaaatgctgtgagtctgcctctgaagattgcatggccaaagagctgcctgaacacacagtaaaactctgtgacaatttatccacaaagaattctaagtttgaagactgttgtcaagaaaaaacagccatggacgtttttgtgtgcacttacttcatgccagctgcccaactccccgagcttccagatgtagagttgcccacaaacaaagatgtgtgtgatccaggaaacaccaaagtcatggataagtatacatttgaactaagcagaaggactcatcttccggaagtattcctcagtaaggtacttgagccaaccctaaaaagccttggtgaatgctgtgatgttgaagactcaactacctgttttaatgctaagggccctctactaaagaaggaactatcttctttcattgacaagggacaagaactatgtgcagattattcagaaaatacatttactgagtacaagaaaaaactggcagagcgactaaaagcaaaattgcctgatgccacacccacggaactggcaaagctggttaacaagcactcagactttgcctccaactgctgttccataaactcacctcctctttactgtgattcagagattgatgctgaattgaagaatatcctgtag

SEQ ID NO: 11434 - DNA, 1094 bp, synthetic construct
  misc_feature 1..1094: note = Synthetic polypeptide
  source 1..1094: mol_type = other DNA
gggaaatgcaaaccataactacagtgaggtatcaccttatacccattaggataatcactatcaaaagaacagaaattggcaaatgttagcaaagttgcatagaaattggaacgcttgtacactgttggtaggaatgtaaagtggttcaatcattatggaaaacagtatggaagtccctcaaaacattaaaaatagaattaacatgtaatccatcaattccacttctgggtatatatcttaaaaattcaaagtgggatctcaaagagatttgcacttccatgttcactgcagaattattcacaataaccaagaggtggaagcaacccatatgtccatcaacagatgaatggatgaagacaatgtgcaatctcataaagttagcccaaaaagtgcctactgctgatctggaggatgttttgccactagctgaagatattactaacatcctctccaaatgctgtgagtctgcctctgaagattgcatggccaaagagctgcctgaacacacagtaaaactctgtgacaatttatccacaaagaattctaagtttgaagactgttgtcaagaaaaaacagccatggacgtttttgtgtgcacttacttcatgccagctgcccaactccccgagcttccagatgtagagttgcccacaaacaaagatgtgtgtgatccaggaaacaccaaagtcatggataagtatacatttgaactaagcagaaggactcatcttccggaagtattcctcagtaaggtacttgagccaaccctaaaaagccttggtgaatgctgtgatgttgaagactcaactacctgttttaatgctaagggccctctactaaagaaggaactatcttctttcattgacaagggacaagaactatgtgcagattattcagaaaatacatttactgagtacaagaaaaaactggcagagcgactaaaagcaaaattgcctgatgccacacccacggaactggcaaagctggttaacaagcactcagactttgcctccaactgctgttccataaactcacctcctctttactgtgattcagagaccagagttggagccacccaggggaatgatctctga

SEQ ID NO: 11435 - DNA, 710 bp, synthetic construct
  misc_feature 1..710: note = Synthetic polypeptide
  source 1..710: mol_type = other DNA
gggaaatgcaaaccataactacagtgaggtatcaccttatacccattaggataatcactatcaaaagaacagaaattggcaaatgttagcaaagttgcatagaaattggaacgcttgtacactgttggtaggaatgtaaagtggttcaatcattatggaaaacagtatggaagtccctcaaaacattaaaaatagaattaacatgtaatccatcaattccacttctgggtatatatcttaaaaattcaaagtgggatctcaaagagatttgcacttccatgttcactgcagaattattcacaataaccaagaggtggaagcaacccatatgtccatcaacagatgaatggatgaagacaatgtgcaatctcataaagttagcccaaaaagtgcctactgctgatctggaggatgttttgccactagctgaagatattactaacatcctctccaaatgctgtgagtctgcctctgaagattgcatggccaaagagctgcctgaacacacagtaaaactctgtgacaatttatccacaaagaattctaagtttgaagactgttgtcaagaaaaaacagccatggacgtttttgtgtgcacttacttcatgccagctgcccaactccccgagcttccagatgtagagttgcccacaaacaaagatgtgtgtgatccaggaaacaccaaagtcatggataaggccctctactaa

SEQ ID NO: 11436 - DNA, 249 bp, synthetic construct; identical to SEQ ID NO: 492
  misc_feature 1..249: note = Synthetic polypeptide
  source 1..249: mol_type = other DNA

SEQ ID NO: 11437 - DNA, 38 bp, synthetic construct; identical to SEQ ID NO: 491
  misc_feature 1..38: note = Synthetic polypeptide
  source 1..38: mol_type = other DNA

SEQ ID NO: 11438 - DNA, 3076 bp, synthetic construct
  misc_feature 1..3076: note = Synthetic polypeptide
  source 1..3076: mol_type = other DNA
gtaatgctggcataaaaaaacctactgcactgccagtcctataaaagcatacagtaatgtcccaggccttcacattcactcaccactcactgattcacccagaacaacttccagtcctgcaagctccattcatgagataattggttctacaaatcttataattctgctagaggatgaagtctttgccgattttttcaacacatttctttccctcccggtttttggtcagacaccattttatactgttgaaaattcacagtggagcttgtggccagaaataccttgtaacttgattgccaaatacaaagggttattgacctggttggaaaaatgccgattacctttcttctgtaaaacaaacttgtgtttccattacattctctgtcaggagttcatcagtttcattaagtccccagaaggagccaagatgatgagatggaaaaaggcagaccagtggctactccagaaatgcattggcggggtcagagggatgtggcgcttctattcctacctcacaggcagtgcaggtgaagaattggtggatttctggatccttgctgagaacatcctgagcatagatgagatggacctggaagtgagagactactacctgtccctcctcctcatgctgagggccactcatctgcaggagggctccagggtggtaaccctctgtaacatgaacatcaagtccctcctgaacctctccatctggcatcccaaccaatcaaccactaggagggagatcctgagccacatgcagaaagtggctctgttcaaactccagagctattggcttcccaacttttacacccacaccaagatgaccatggccaaggaggaagcatgccatggtctgatgcaagagtacgagactcgcttatacagcgtttgctacacccacataggagggctccctctgaacatgagcatcaagaagtgccaccactttcagaaacggtactcaagcaggaaagccaagaggaagatgtggcaattggtagatcctgactcttggtctctggaaatggatctcaagccagatgctattggtatgcccctacaggagacatgtcctcaagagaaggtggttatacaaatgccttccctgaaaatggcttcttcaaaggaaacaagaatcagttccctggaaaaggatatgcattatgcaaaaatatccagcatggagaataaagccaagagccacctccacatggaagccccctttgagacaaaggtctctacccacctgaggactgtcatccccattgtcaatcactcctccaagatgacaattcagaaggccatcaagcaaagcttctccttaggatacatccacttggccttgtgtgctgatgcctgtgcagggaaccctttccgggaccacctgaagaagctgaatttgaaagtggagatccaacttcttgacctctggcaggacttgcagcatttcctcagtgtccttctgaataacaaaaagaatgggaatgcaatctttcgtcacttgctgggtgacagaatctgcgagctctacctgaatgagcagattggtccgtgcttaccactcaaatcccaaaccattcagggcctgaaggaactattgccctctggggatgtgatcccctggattcccaaagcccagaaggagatttgcaagatgctcagtccctggtatgatgagtttctagatgaagaggactactggtttctcctttttacgacacagaacaggttcatcagctccagacagcataaaagagaatttataggcaaagaagagaacattcttctttataagaggattcagcagtctctagagttaagccaggctttggctgacatgaaggaaatggactataggcagtggcgaaagatagctactgaggacctgaagcaaggaggctctctccaggtagagctgacatctccagtgtttctaacagacataactaaaatgtcctttgaggagctttgctacaagaacccaaagatggccatacagaagatcagtgatgactacaaaatatactgtgagaaagcacctaaaatagattttaaaatggaaattatcaaggaaacaaagacagtttcacgctcaaataggaaaatgtccttgctcaaaagaactcttgtaaggaagccatcaatgagacccagaaacttgacagaagtcctcttaaatacacagcacttggagttcttcagggagttcctcaaggaacggaaggctaaaatcccattgcaatttctcacagctgtacagaagatcagtatagagaccaatgaaaagatttgcaagtctctcatagaaaatgtaatcaagactttcttccaaggccaactctctcctgaagaaatgctgcagtgtgatgcccctattatcaaagaaatcgcttccatgcgtcatgtcaccacaagcacactgttaacgctccagggacatgttatgaaatctatagaagaaaagtggtttaaagattatcaagacctgttcccacctcaccatcaggaggtggaagtgcaaagtgaagtacaaatttcgtctaggaagccctcaaagatagtgtcaacttacctacaggaatcccagaagaaaggctggatgagaatgatcagctttatcaggagtttttgcaagtaccgcagatttatgttgaatcctagtaagcgccaggaatttgaagactatcttcaccaggaaatgcaaaatagcaaggaaaatttcaccacagcacacaacacatcgggacgttcagctccaccctccacaaatgtccggagtgcagaccaagagaatggagaaataacccttgtaaagcgtcgtatatttggccacaggattatcactgtcaactttgcgatcaatgatctatatttcttttctgaaatggagaaatttaatgatctggtcagttcagcccacatgctgcaggtcaaccgggcatataatgagaatgatgtgatcctaatgcggtccaaaatgaacattatccaaaaactcttcctgaattctgacatccctccaaagctgagggttttgtttctggaaggcaacccgctcttacttacagtatag

SEQ ID NO: 11439 - DNA, 3352 bp, synthetic construct
  misc_feature 1..3352: note = Synthetic polypeptide
  source 1..3352: mol_type = other DNA
gtaatgctggcataaaaaaacctactgcactgccagtcctataaaagcatacagtaatgtcccaggccttcacattcactcaccactcactgattcacccagaacaacttccagtcctgcaagctccattcatgagataattggttctacaaatcttataattctgctagaggatgaagtctttgccgattttttcaacacatttctttccctcccggtttttggtcagacaccattttatactgttgaaaattcacagtggagcttgtggccagaaataccttgtaacttgattgccaaatacaaagggttattgacctggttggaaaaatgccgattacctttcttctgtaaaacaaacttgtgtttccattacattctctgtcaggagttcatcagtttcattaagtccccagaaggaggtgaagaattggtggatttctggatccttgctgagaacatcctgagcatagatgagatggacctggaagtgagagactactacctgtccctcctcctcatgctgagggccactcatctgcaggagggctccagggtggtaaccctctgtaacatgaacatcaagtccctcctgaacctctccatctggcatcccaaccaatcaaccactaggagggagatcctgagccacatgcagaaagtggctctgttcaaactccagagctattggcttcccaacttttacacccacaccaagatgaccatggccaaggaggaagcatgccatggtctgatgcaagagtacgagactcgcttatacagcgtttgctacacccacataggagggctccctctgaacatgagcatcaagaagtgccaccactttcagaaacggtactcaagcaggaaagccaagaggaagatgtggcaattggtagatcctgactcttggtctctggaaatggatctcaagccagatgctattggtatgcccctacaggagacatgtcctcaagagaaggtggttatacaaatgccttccctgaaaatggcttcttcaaaggaaacaagaatcagttccctggaaaaggatatgcattatgcaaaaatatccagcatggagaataaagccaagagccacctccacatggaagccccctttgagacaaaggtctctacccacctgaggactgtcatccccattgtcaatcactcctccaagatgacaattcagaaggccatcaagcaaagcttctccttaggatacatccacttggccttgtgtgctgatgcctgtgcagggaaccctttccgggaccacctgaagaagctgaatttgaaagtggagatccaacttcttgacctctggcaggacttgcagcatttcctcagtgtccttctgaataacaaaaagaatgggaatgcaatctttcgtcacttgctgggtgacagaatctgcgagctctacctgaatgagcagattggtccgtgcttaccactcaaatcccaaaccattcagggcctgaaggaactattgccctctggggatgtgatcccctggattcccaaagcccagaaggagatttgcaagatgctcagtccctggtatgatgagtttctagatgaagaggactactggtttctcctttttacgacacagaacaggttcatcagctccagacagcataaaagagaatttataggcaaagaagagaacattcttctttataagaggattcagcagtctctagagttaagccaggctttggctgacatgaaggaaatggactataggcagtggcgaaagatagctactgaggacctgaagcaaggaggctctctccaggtagagctgacatctccagtgtttctaacagacataactaaaatgtcctttgaggagctttgctacaagaacccaaagatggccatacagaagatcagtgatgactacaaaatatactgtgagaaagcacctaaaatagattttaaaatggaaattatcaaggaaacaaagacagtttcacgctcaaataggaaaatgtccttgctcaaaagaactcttgtaaggaagccatcaatgagacccagaaacttgacagaagtcctcttaaatacacagcacttggagttcttcagggagttcctcaaggaacggaaggctaaaatcccattgcaatttctcacagctgtacagaagatcagtatagagaccaatgaaaagatttgcaagtctctcatagaaaatgtaatcaagactttcttccaaggccaactctctcctgaagaaatgctgcagtgtgatgcccctattatcaaagaaatcgcttccatgcgtcatgtcaccacaagcacactgttaacgctccagggacatgttatgaaatctatagaagaaaagtggtttaaagattatcaagacctgttcccacctcaccatcaggaggtggaagtgcaaagtgaagtacaaatttcgtctaggaagccctcaaagatagtgtcaacttacctacaggaatcccagaagaaaggctggatgagaatgatcagctttatcaggagtttttgcaagtaccgcagatttatgttgaatcctagtaagcgccaggaatttgaagactatcttcaccaggaaatgcaaaatagcaaggaaaatttcaccacagcacacaacacatcgggacgttcagctccaccctccacaaatgtccggagtgcagaccaagagaatggagaaataacccttgtaaagcgtcgtatatttggccacaggattatcactgtcaactttgcgatcaatgatctatatttcttttctgaaatggagaaatttaatgatctggtcagttcagcccacatgctgcaggtcaaccgggcatataatgagaatgatgtgatcctaatgcggtccaaaatgaacattatccaaaaactcttcctgaattctgacatccctccaaagctgagggtgaatgtccctgagttccagaaggatgccatccttgctgccatcacagagggctacctagatcggagcgtcttccatggggctatcatgtctgtcttccccgttgttatgtacttctggaaaaggttttgtttctggaaggcaacccgctcttacttacagtatagggggaagaagttcaaggacagaaaaagccctcctaaatctacggacaagtatcctttctcgagtggaggagacaatgccatcttaaggttcaccttgctcagaggtattgagtggttgcagcctcaacgggaagcaataagttcagttcaaaattcttcatcaagcaaacttactcagccaagactcgtggtatctgccatgcagctgcatcccgtccagggacaaaaattatcctacatcaaaaaagagaagtaa

SEQ ID NO: 11440 - DNA, 604 bp, synthetic construct
  misc_feature 1..604: note = Synthetic polypeptide
  source 1..604: mol_type = other DNA
gtaatgctggcataaaaaaacctactgcactgccagtcctataaaagcatacagtaatgtcccaggccttcacattcactcaccactcactgattcacccagaacaacttccagtcctgcaagctccattcatgagataattggttctacaaatcttataattctgctagaggatgaagtctttgccgattttttcaacacatttctttccctcccggtttttggtcagacaccattttatactgttgaaaattcacagtggagcttgtggccagaaataccttgtaacttgattgccaaatacaaagggttattgacctggttggaaaaatgccgattacctttcttctgtaaaacaaacttgtgtttccattacattctctgtcaggagttcatcagtttcattaagtccccagaaggaggtgaagaattggtggatttctggatccttgctgagaacatcctgagcatagatgagatggacctggaagtgagagactactacctgtccctcctcctcatgctgagggccactcatctgcaggagggctccagggtggtaaccctctgtaacatgaacatcaatgctcagtccctggtatga

SEQ ID NO: 11441 - DNA, 586 bp, synthetic construct
  misc_feature 1..586: note = Synthetic polypeptide
  source 1..586: mol_type = other DNA
gtaatgctggcataaaaaaacctactgcactgccagtcctataaaagcatacagtaatgtcccaggccttcacattcactcaccactcactgattcacccagaacaacttccagtcctgcaagctccattcatgagataattggttctacaaatcttataattctgctagaggatgaagtctttgccgattttttcaacacatttctttccctcccggtttttggtcagacaccattttatactgttgaaaattcacagtggagcttgtggccagaaataccttgtaacttgattgccaaatacaaagggttattgacctggttggaaaaatgccgattacctttcttctgtaaaacaaacttgtgtttccattacattctctgtcaggagttcatcagtttcattaagtccccagaaggagaagccagagtgagcctcttaaaaagtaattggtggtggtgctggagggactcccaggaagatgatgaaataggaagcactaggaatctgtttcctcatctagacaacaattgtactggcagaatctgtatgatatgctcagtccctggtatgatgagtttctag

SEQ ID NO: 11442 - DNA, 291 bp, synthetic construct
  misc_feature 1..291: note = Synthetic polypeptide
  source 1..291: mol_type = other DNA
caaggagtaatcagagggtgagaacgtggagcctggtggacagctgcttccactatggcttcaactccaactacctgaagaaagtcatctcctactggcggaatgaatttgactggaagaagcaggtggagattctcaacagataccctcacttcaagactaagattgaagggctggacatccacttcatccacgtgaagcccccccagctgcccgcaggccataccccgaagcccttgctgatggtgcacggctggcccggctctttctacgagttttataagatcatcc

SEQ ID NO: 11443 - DNA, 1175 bp, synthetic construct
  misc_feature 1..1175: note = Synthetic polypeptide
  source 1..1175: mol_type = other DNA
caaggagtaatcagagggtgagaacgtggagcctggtggacagctgcttccactatggcttcaactccaactacctgaagaaagtcatctcctactggcggaatgaatttgactggaagaagcaggtggagattctcaacagataccctcacttcaagactaagattgaagggctggacatccacttcatccacgtgaagcccccccagctgcccgcaggccataccccgaagcccttgctgatggtgcacggctggcccggctctttctacgagttttataagatcatcccactcctgactgaccccaagaaccatggcctgagcgatgagcacgtttttgaagtcatctgcccttccatccctggctatggcttctcagaggcatcctccaagaaggggttcaactcggtggccaccgccaggatcttttacaagctgatgctgcggctgggcttccaggaattctacattcaaggaggggactgggggtccctgatctgcactaatatggcccagctggtgcccagccacgtgaaaggcctgcacttgaacatggctttggttttaagcaacttctctaccctgaccctcctcctgggacagcgtttcgggaggtttcttggcctcactgagagggatgtggagctgctgtaccccgtcaaggagaaggtattctacagcctgatgagggagagcggctacatgcacatccagtgcaccaagcctgacaccgtaggctctgctctgaatgactctcctgtgggtctggctgcctatattctagagaagttttccacctggaccaatacggaattccgatacctggaggatggaggcctggaaaggaagttctccctggacgacctgctgaccaacgtcatgctctactggacaacaggcaccatcatctcctcccagcgcttctacaaggagaacctgggacagggctggatgacccagaagcatgagcggatgaaggtctatgtgcccactggcttctctgccttcccttttgagctattgcacacgcctgaaaagtgggtgaggttcaagtacccaaagctcatctcctattcctacatggttcgtgggggccactttgcggcctttgaggagccggagctgctcgcccaggacatccgcaagttcctgtcggtgctggagcggcaatga

SEQ ID NO: 11444 - DNA, 215 bp, synthetic construct
  misc_feature 1..215: note = Synthetic polypeptide
  source 1..215: mol_type = other DNA
caaggagtaatcagagggtgagaacgtggagcctggtggacagctgcttccactatggcttcaactccaactacctgaagaaagtcatctcctactggcggaatgaatttgactggaagaagcaggtggagattctcaacagataccctcacttcaagactaagattgaagggctggacatccacttcatccacgtgaagcccccccagctgccc

SEQ ID NO: 11445 - DNA, 112 bp, synthetic construct; identical to SEQ ID NO: 7120
  misc_feature 1..112: note = Synthetic polypeptide
  source 1..112: mol_type = other DNA

SEQ ID NO: 11446 - DNA, 682 bp, synthetic construct
  misc_feature 1..682: note = Synthetic polypeptide
  source 1..682: mol_type = other DNA
ggccaggtgcagtggctgacgcctctaatccctgcactttgggaggccaaggtgggtggatcacctgaggttaggggtttgaaaccagcctggccaacatggtgaaaccccgtctctactaaaaacacaaaaattagctgggtgtggtggcatgcacctgtaatgccagctactcgggaggctgaagcaggagaatcacttgaacccaggaggcagaggttgcagtgagccaagattgcaccactgcactccactctgggtgcagtagacattgttgcaatcatgatcggcaatctgaaaggcacaaaaattctgcaatctattcaaagaggcatacaagtgacaatggtcatagaagtagggaaaaaacatggcccttgggtgaatcactattcaatttttttcgtttctgtgtccttttttattattacggcggcaactgtgggctattttatcttttattctgctcgaaggctacggaatgcaagagctcaaagcaggaagcagaggcaattaaaggcagatgctaaaaaagctattggaaggcttcaactacgcacactgaaacaaggagacaaggaaattggccctgatggagatagttgtgctgtgtgcattgaattgtataaaccaaatgatttggtacgcatcttaacgtgcaaccatattttccataagacat

SEQ ID NO: 11447 - DNA, 1062 bp, synthetic construct
  misc_feature 1..1062: note = Synthetic polypeptide
  source 1..1062: mol_type = other DNA
ggccaggtgcagtggctgacgcctctaatccctgcactttgggaggccaaggtgggtggatcacctgaggttaggggtttgaaaccagcctggccaacatggtgaaaccccgtctctactaaaaacacaaaaattagctgggtgtggtggcatgcacctgtaatgccagctactcgggaggctgaagcaggagaatcacttgaacccaggaggcagaggttgcagtgagccaagattgcaccactgcactccactctgggtgcagtagacattgttgcaatcatgatcggcaatctgaaaggcacaaaaattctgcaatctattcaaagaggcatacaagtgacaatggtcatagaagtagggaaaaaacatggcccttgggtgaatcactattcaatttttttcgtttctgtgtccttttttattattacggcggcaactgtgggctattttatcttttattctgctcgaaggctacggaatgcaagagctcaaagcaggaagcagaggcaattaaaggcagatgctaaaaaagctattggaaggcttcaactacgcacactgaaacaaggagacaaggaaattggccctgatggagatagttgtgctgtgtgcattgaattgtataaaccaaatgatttggtacgcatcttaacgtgcaaccatattttccataagacatgtgttgacccatggctgttagaacacaggacttgccccatgtgcaaatgtgacatactcaaagctttgggaattgaggtggatgttgaagatggatcagtgtctttacaagtccctgtatccaatgaaatatctaatagtgcctcctcccatgaagaggataatcgcagcgagaccgcatcatctggatatgcttcagtacagggaacagatgaaccgcctctggaggaacacgtgcagtcaacaaatgaaagtctacagctggtaaaccatgaagcaaattctgtggcagtggatgttattcctcatgttgacaacccaacctttgaagaagacgaaactcctaatcaagagactgctgttcgagaaattaaatcttaa

SEQ ID NO: 11448 - DNA, 1040 bp, synthetic construct; identical to SEQ ID NO: 10948
  misc_feature 1..1040: note = Synthetic polypeptide
  source 1..1040: mol_type = other DNA

SEQ ID NO: 11449 - DNA, 371 bp, synthetic construct; identical to SEQ ID NO: 10949
  misc_feature 1..371: note = Synthetic polypeptide
  source 1..371: mol_type = other DNA

SEQ ID NO: 11450 - DNA, 568 bp, synthetic construct
  misc_feature 1..568: note = Synthetic polypeptide
  source 1..568: mol_type = other DNA
caggcacaggggctcaggcatgaaagatggccagaagataacattccatggtgaaggagaccaagaaccaggactggagccaggcgatattatcattgtgttagatcagaaggaccatgctgtttttactcgacgaggagaagaccttttcatgtgtatggacatacagctcgttgaagcactgtgtggcttccagaagccaatatctactcttgacaaccgaaccatcgtcatcacctctcatccaggtcagattgtcaagcatggagatatcaagtgtgtactaaatgaaggcatgccaatttatcgtagaccatatgaaaagggtcgcctaatcatcgaatttaaggtaaactttcctgagaatggctttctctctcctgataaactgtctttgctggaaaaactcctacccgagaggaaggaagtggaagagactgatgagatggaccaagtagaactggtggactttgatccaaatcaggaaagacggcgccactacaatggagaagcatatgaggatgatgaacatcatcccagaggtggtgttcagtgtcagacctcttaa

SEQ ID NO: 11451 - DNA, 1222 bp, synthetic construct
  misc_feature 1..1222: note = Synthetic polypeptide
  source 1..1222: mol_type = other DNA
tatgatttgttaattatactagagatgctcttaaagggacagctgaacaattaagacccaccagtcaaatggcctgggaaaataaaatagcattagacatgataccagcgaaagagggtggagattgtgtcattatcggaacccgatgctatacttttatccctaataatactactccagtgacctgggagctgtcatttccctcctgctctggggacgacagctttttgcactgtactcaggcaatgatgtcacggatatttcagatgaccgcttcccgaagccccctgagattgcaaatggctatgtggagcacttgtttcgctaccagtgtaagaactactacagactgcgcacagaaggagatggagtatacaccttaaatgataagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggggccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggtggttctacaccctaactaccaccaggtagatattgggctcatcaaactcaaacagaaggtgcttgttaatgagagagtgatgcccatctgcctaccttcaaagaattatgcagaagtagggcgtgtgggttacgtgtctggctggggacaaagtgacaactttaaacttactgaccatctgaagtatgtcatgctgcctgtggctgaccaatacgattgcataacgcattatgaaggcagcacatgccccaaatggaaggcaccgaagagccctgtaggggtgcagcccatactgaacgaacacaccttctgtgtcggcatgtctaagtaccaggaagacacctgctatggcgatgcgggcagtgcctttgccgttcacgacctggaggaggacacctggtacgcggctgggatcctaagctttgataagagctgtgctgtggctgagtatggtgtgtatgtgaaggtgacttccatccagcactgggttcagaagaccatagctgagaactaa

SEQ ID NO: 11452 - DNA, 529 bp, synthetic construct
  misc_feature 1..529: note = Synthetic polypeptide
  source 1..529: mol_type = other DNA
tatgatttgttaattatactagagatgctcttaaagggacagctgaacaattaagacccaccagtcaaatggcctgggaaaataaaatagcattagacatgataccagcgaaagagggtggagattgtgtcattatcggaacccgatgctatacttttatccctaataatactactccagtgacctgggagctgtcatttccctcctgctctggggacgacagctttttgcactgtactcaggcaatgatgtcacggatatttcagatgaccgcttcccgaagccccctgagattgcaaatggctatgtggagcacttgtttcgctaccagtgtaagaactactacagactgcgcacagaaggagatggagtatacaccttaaatgataagaagcagtggataaataaggctgttggagataaacttcctgaatgtgaagcagtatgtgggaagcccaagaatccggcaaacccagtgcagcggatcctgggaggacacctggtacgcggctgggatcctaagctttga

SEQ ID NO: 11453 - DNA, 565 bp, synthetic construct
  misc_feature 1..565: note = Synthetic polypeptide
  source 1..565: mol_type = other DNA
cactgtaaagtgttagaagcaatactggccttggagttagaacacctacattctggttccattttcgtcactaaactattgtacgactttgttaagtcacttttcctctctggtctgcagaagaaaggcacggaactaggttgaggtcctagatgagaacaacttggtcatgaatttagagttcagcatccgggagactacatgcaggaaggattctggagaagatcccgctacatgtgccttccagagggactactatgtgtccacagctgtttgcagaagcaccgtgaaggtatctgcccagcaggtgcagggcgtgcatgctcgctgcagctggtcctcctccacgtctgagtcttacagcagcgaagagatgatttttggggacatgttgggatctcataaatggagaaacaattatctatttggtctcatttcagacgagtccataagtgaacaattttatgatcggtcacttgggatcatgagaagggtattgcctcctggaaacagaaggtacccaaaccaccggcacagagcaagaataaatactgactttgagtaa

SEQ ID NO: 11454 - DNA, 324 bp, synthetic construct
  misc_feature 1..324: note = Synthetic polypeptide
  source 1..324: mol_type = other DNA
tgttggacaaataattcaaaatttccattagacaggaaaaataagttcaagagatatattgaacaacatggtgattatagttaataacaatatattatatacttgaacattgctaaaagatattttaagtgttctcaccacacacaaagggacagcatctctcggacgccacgttggcggctgtgtggcattgtgagttggggcactggctgtgccctggcccagaagccaggcgtctacaccaaagtcagtgacttccgggagtggatcttccaggccataaagactcactccgaagccagcggcatggtgacccagctctga

SEQ ID NO: 11455 - DNA, 371 bp, synthetic construct
  misc_feature 1..371: note = Synthetic polypeptide
  source 1..371: mol_type = other DNA
caaggagtaatcagagggtgagaacgtggagcctggtggacaggtggaaacgtcagatgaggagatccacgacttacaccagaggatcgataagttccgtttcaccccacctttggaggacagctgcttccactatggcttcaactccaactacctgaagaaagtcatctcctactggcggaatgaatttgactggaagaagcaggtggagattctcaacagataccctcacttcaagactaagattgaagggctggacatccacttcatccacgtgaagcccccccagctgcccgcaggccataccccgaagcccttgctgatggtgcacggctggcccggctctttctacgagttttataagatcatcc

SEQ ID NO: 11456 - DNA, 1255 bp, synthetic construct
  misc_feature 1..1255: note = Synthetic polypeptide
  source 1..1255: mol_type = other DNA
caaggagtaatcagagggtgagaacgtggagcctggtggacaggtggaaacgtcagatgaggagatccacgacttacaccagaggatcgataagttccgtttcaccccacctttggaggacagctgcttccactatggcttcaactccaactacctgaagaaagtcatctcctactggcggaatgaatttgactggaagaagcaggtggagattctcaacagataccctcacttcaagactaagattgaagggctggacatccacttcatccacgtgaagcccccccagctgcccgcaggccataccccgaagcccttgctgatggtgcacggctggcccggctctttctacgagttttataagatcatcccactcctgactgaccccaagaaccatggcctgagcgatgagcacgtttttgaagtcatctgcccttccatccctggctatggcttctcagaggcatcctccaagaaggggttcaactcggtggccaccgccaggatcttttacaagctgatgctgcggctgggcttccaggaattctacattcaaggaggggactgggggtccctgatctgcactaatatggcccagctggtgcccagccacgtgaaaggcctgcacttgaacatggctttggttttaagcaacttctctaccctgaccctcctcctgggacagcgtttcgggaggtttcttggcctcactgagagggatgtggagctgctgtaccccgtcaaggagaaggtattctacagcctgatgagggagagcggctacatgcacatccagtgcaccaagcctgacaccgtaggctctgctctgaatgactctcctgtgggtctggctgcctatattctagagaagttttccacctggaccaatacggaattccgatacctggaggatggaggcctggaaaggaagttctccctggacgacctgctgaccaacgtcatgctctactggacaacaggcaccatcatctcctcccagcgcttctacaaggagaacctgggacagggctggatgacccagaagcatgagcggatgaaggtctatgtgcccactggcttctctgccttcccttttgagctattgcacacgcctgaaaagtgggtgaggttcaagtacccaaagctcatctcctattcctacatggttcgtgggggccactttgcggcctttgaggagccggagctgctcgcccaggacatccgcaagttcctgtcggtgctggagcggcaatga

SEQ ID NO: 11457 - DNA, 295 bp, synthetic construct
  misc_feature 1..295: note = Synthetic polypeptide
  source 1..295: mol_type = other DNA
caaggagtaatcagagggtgagaacgtggagcctggtggacaggtggaaacgtcagatgaggagatccacgacttacaccagaggatcgataagttccgtttcaccccacctttggaggacagctgcttccactatggcttcaactccaactacctgaagaaagtcatctcctactggcggaatgaatttgactggaagaagcaggtggagattctcaacagataccctcacttcaagactaagattgaagggctggacatccacttcatccacgtgaagcccccccagctgccc

SEQ ID NO: 11458 - DNA, 1734 bp, synthetic construct
  misc_feature 1..1734: note = Synthetic polypeptide
  source 1..1734: mol_type = other DNA
tggctgggctcgacggcccatgcctgtaatcccagcgctttgggaggccgaggcaggaggatggcttgagcccaggaggtcgaggctgcagtgagccatgatcatgacactgcactccaggctgataacagaggtggattacggaacaacaacgagaaagacatggccctcacggcctttgttctcatctcgctgcaggaggctaaagatatttgcgaggagcaggtcaacagcctgccaggcagcatcactaaagcaggagacttccttgaagccaactacatgaacctacagagatcctacactgtggccattgctggctatgctctggcccagatgggcaggctgaaggggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcccgaggaggacgaatgccaagacgaagagaaccagaaacaatgccaggacctcggcgccttcaccgagagcatggttgtctttgggtgccccaactga

SEQ ID NO: 11459 - DNA, 2103 bp, synthetic construct
  misc_feature 1..2103: note = Synthetic polypeptide
  source 1..2103: mol_type = other DNA
agcatatgcctttgtgcagggcagcgctcgccattgaatgacttccaagtgctccggggcacagagctacagcacctgctacatgcggtggtgcccgggccttggcaggaggatgtggcagatgctgaagagtgtgctggtcgctgtgggcccttaatggactgccgggccttccactacaacgtgagcagccatggttgccaactgctgccatggactcaacactcgccccacacgaggctgcggcgttctgggcgctgtgacctcttccagaagaaagactacgtacggacctgcatcatgaacaatggggttgggtaccggggcaccatggccacgaccgtgggtggcctgccctgccaggcttggagccacaagttcccaaatgatcacaagtacacgcccactctccggaatggcctggaagagaacttctgccgtaaccctgatggcgaccccggaggtccttggtgctacacaacagaccctgctgtgcgcttccagagctgcggcatcaaatcctgccgggaggccgcgtgtgtctggtgcaatggcgaggaataccgcggcgcggtagaccgcacggagtcagggcgcgagtgccagcgctgggatcttcagcacccgcaccagcaccccttcgagccgggcaagttcctcgaccaaggtctggacgacaactattgccggaatcctgacggctccgagcggccatggtgctacactacggatccgcagatcgagcgagagttctgtgacctcccccgctgcgggtccgaggcacagccccgccaagaggccacaactgtcagctgcttccgcgggaagggtgagggctaccggggcacagccaataccaccactgcgggcgtaccttgccagcgttgggacgcgcaaatcccgcatcagcaccgatttacgccagaaaaatacgcgtgcaaagaccttcgggagaacttctgccggaaccccgacggctcagaggcgccctggtgcttcacactgcggcccggcatgcgcgcggccttttgctaccagatccggcgttgtacagacgacgtgcggccccaggactgctaccacggcgcaggggagcagtaccgcggcacggtcagcaagacccgcaagggtgtccagtgccagcgctggtccgctgagacgccgcacaagccgcagttcacgtttacctccgaaccgcatgcacaactggaggagaacttctgccggaacccagatggggatagccatgggccctggtgctacacgatggacccaaggaccccattcgactactgtgccctgcgacgctgcgctgatgaccagccgccatcaatcctggaccccccagaccaggtgcagtttgagaagtgtggcaagagggtggatcggctggatcagcggcgttccaagctgcgcgtggttgggggccatccgggcaactcaccctggacagtcagcttgcggaatcggcagggccagcatttctgcggggggtctctagtgaaggagcagtggatactgactgcccggcagtgcttctcctcctgccatatgcctctcacgggctatgaggtatggttgggcaccctgttccagaacccacagcatggagagccaagcctacagcgggtcccagtagccaagatggtgtgtgggccctcaggctcccagcttgtcctgctcaagctggagagatctgtgaccctgaaccagcgtgtggccctgatctgcctgccccctgaatggtatgtggtgcctccagggaccaagtgtgagattgcaggctggggtgagaccaaaggtacgggtaatgacacagtcctaaatgtggccttgctgaatgtcatctccaaccaggagtgtaacatcaagcaccgaggacgtgtgcgggagagtgagatgtgcactgagggactgttggcccctgtgggggcctgtgagggtgactacgggggcccacttgcctgctttacccacaactgctgggtcctggaaggaattataatccccaaccgagtatgcgcaaggtcccgctggccagctgtcttcacgcgtgtctctgtgtttgtggactggattcacaaggtcatgagactgggttag

SEQ ID NO: 11460 - DNA, 462 bp, synthetic construct
  misc_feature 1..462: note = Synthetic polypeptide
  source 1..462: mol_type = other DNA
agcatatgcctttgtgcagggcagcgctcgccattgaatgacttccaagtgctccggggcacagagctacagcacctgctacatgcggtggtgcccgggccttggcaggaggatgtggcagatgctgaagagtgtgctggtcgctgtgggcccttaatggactgccgggccttccactacaacgtgagcagccatggttgccaactgctgccatggactcaacactcgccccacacgaggctgcggcgttctgggcgctgtgacctcttccagaagaaaggtacacgcccactctccggaatggcctggaagagaacttctgccgtaaccctgatggcgaccccggaggtccttggtgctacacaacagaccctgctgtgcgcttccagagctgcggcatcaaatcctgccgggaggccgcgtgtgtctggtgcaatggcgaggaataccgcggcgcggtag

SEQ ID NO: 11461 - DNA, 1205 bp, synthetic construct
  misc_feature 1..1205: note = Synthetic polypeptide
  source 1..1205: mol_type = other DNA
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtggcccagctgtaaaattcttctctttgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaa

SEQ ID NO: 11462 - DNA, 653 bp, synthetic construct
  misc_feature 1..653: note = Synthetic polypeptide
  source 1..653: mol_type = other DNA
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtggcccagctgtaaaattcttctctttgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctga

SEQ ID NO: 11463 - DNA, 469 bp, synthetic construct
  misc_feature 1..469: note = Synthetic polypeptide
  source 1..469: mol_type = other DNA
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtggcccagctgtaaaattcttctctttgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaa

SEQ ID NO: 11464 - DNA, 746 bp, synthetic construct
  misc_feature 1..746: note = Synthetic polypeptide
  source 1..746: mol_type = other DNA
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtggcccagctgtaaaattcttctctttgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaagatctttgataccatactttaatctgtatcttcagtttctgaacataagtatgcaaaatctttttaaggtgcatactctgctgcgtccctgctattttctaggacaaaaataa

SEQ ID NO: 11465 - DNA, 1241 bp, synthetic construct
  misc_feature 1..1241: note = Synthetic polypeptide
  source 1..1241: mol_type = other DNA
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtggcccagctgtaaaattcttctctttgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggctggtagcaagttctggatcttatacccaacacacagcaacatccagaaataa

SEQ ID NO: 11466 - DNA, 1160 bp, synthetic construct
  misc_feature 1..1160: note = Synthetic polypeptide
  source 1..1160: mol_type = other DNA
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtggcccagctgtaaaattcttctctttgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatgaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaa

SEQ ID NO: 11467 - DNA, 923 bp, synthetic construct
  misc_feature 1..923: note = Synthetic polypeptide
  source 1..923: mol_type = other DNA
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtggcccagctgtaaaattcttctctttgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggtctgggagaactgatcttgctgaaaatacaacaggaagcagtatcgtgccaggcaaggcaaaccctcgtcagtgtgaagcaatggccatcgttgcagcccaagtcatggggttttgtgtggcagtaa

SEQ ID NO: 11468 - DNA, 839 bp, synthetic construct
  misc_feature 1..839: note = Synthetic polypeptide
  source 1..839: mol_type = other DNA
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtggcccagctgtaaaattcttctctttgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggctgctgggggatgcttcagtttccttcacagaaaactaaatag

SEQ ID NO: 11469 - DNA, 902 bp, synthetic construct
  misc_feature 1..902: note = Synthetic polypeptide
  source 1..902: mol_type = other DNA
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtggcccagctgtaaaattcttctctttgtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggtctgggagaactgatcttgctgaaaatacaacaggaagcagtatcgtgccaggcaaggcaaaccctcgtcagtgtgaagcaatggccatcgttgcagcccaagtcatggggttttgtgtggcagtaaccgttggaggcggcaatggccattttgagttggatgttttcaagccaatgatgattaaaaatttatgttacactcaggctgctgggggatgcttcagtttccttcacagaaaactaaatagtgggaatccggaccaataa

SEQ ID NO: 11470 - DNA, 1581 bp, synthetic construct
  misc_feature 1..1581: note = Synthetic polypeptide
  source 1..1581: mol_type = other DNA
gaggaagcatagagcagacaagaatctacttagggtggaggggccggctggtgaaggccactcagaactgcttcaaatgaagaggaccaggatgtttattttagggaagactcagaaggcccacaagtgtcatcttcagatgatggaaggactcttcatgtacgtgggagaagcactagaccttcctggagcctcagagcttgaactcatccaccatacaccatgtgctttagagtgaaattctacccacatgaacccttgaagattaaagaagagctcacaagataccttttataccttcagattaaaagggacatttttcatggccgcctgctgtgctccttttctgatgctgcctacctgggtgcctgtattgttcaagctgagcttggtgattacgatcctgatgagcatcctgagaattacatcagtgagtttgagattttccccaagcagtcacagaagctggaaagaaaaatagtggaaattcataaaaatgaactcagggggcagagcccaccagttgctgaatttaacttgctcctgaaagctcacactttggaaacctacggggtggatcctcacccatgcaaggattcaacaggcacaacaacatttttaggattcacagctgcaggctttgtggtctttcagggaaataagagaatccatttgataaaatggccagatgtctgcaaattgaagtttgaagggaagacattttatgtgattggcacccagaaggagaaaaaagccatgttggcattccatacttcaacaccagctgcctgcaaacatctttggaagtgtggagtggaaaaccaggccttttataagtatgcaaaatccagtcagatcaagactgtatcaagcagcaagatattttttaaaggaagtagatttcgatatagtgggaaagttgccaaagaggtggtggaggccagttccaagatccagagggagcctcctgaggtgcacagagccaacattactcagagccgcagttcccactccttgaacaaacagctcatcattaacatggaacccctgcagcccctgcttccttcccccagcgagcaagaagaagaacttcctctgggtgagggtgttccattgcctaaagaggagaacatttctgctcccttgatctccagctccccagtgaaggcagcccgggagtatgaagatccccctagtgaagaggaagataaaataaaagaagaacctttaaccatctctgaactagtgtacaacccaagtgccagcctgctccccacccctgtggatgacgatgagattgacatgctctttgactgtccttctaggcttgagttggaaagagaagacacagattcatttgaggatctggaagcagatgaaaacgcctttttgattgctgaagaagaggagctgaaggaggctcgccgtgctttgtcgtggagctatgacattctgactggccatattcgggtgaacccactggtcaagagtttttccaggctccttgtggtgggcctgggactgctgctctttgtatttcccctgctcctcctccttttggagtcagtctccatgcagtaa

SEQ ID NO: 11471 - DNA, 1704 bp, synthetic construct
  misc_feature 1..1704: note = Synthetic polypeptide
  source 1..1704: mol_type = other DNA
gaggaagcatagagcagacaagaatctacttagggtggaggggccggctggtgaaggccactcagaactgcttcaaatgaagaggaccaggatgtttattttagggaagactcagaaggcccacaagtgtcatcttcagatgatggaaggactcttcatgtacgtgggagaagcactagaccttcctggagcctcagagcttgaactcatccaccatacaccatgtgctttagagtgaaattctacccacatgaacccttgaagattaaagaagagctcacaagataccttttataccttcagattaaaagggacatttttcatggccgcctgctgtgctccttttctgatgctgcctacctgggtgcctgtattgttcaagctgagcttggtgattacgatcctgatgagcatcctgagaattacatcagtgagtttgagattttccccaagcagtcacagaagctggaaagaaaaatagtggaaattcataaaaatgaactcagggggcagagcccaccagttgctgaatttaacttgctcctgaaagctcacactttggaaacctacggggtggatcctcacccatgcaaggattcaacaggcacaacaacatttttaggattcacagctgcaggctttgtggtctttcagggaaataagagaatccatttgataaaatggccagatgtctgcaaattgaagtttgaagggaagacattttatgtgattggcacccagaaggagaaaaaagccatgttggcattccatacttcaacaccagctgcctgcaaacatctttggaagtgtggagtggaaaaccaggccttttataagtatgcaaaatccagtcagatcaagactgtatcaagcagcaagatattttttaaaggaagtagatttcgatatagtgggaaagttgccaaagaggtggtggaggccagttccaagatccagagggagcctcctgaggtgcacagagccaacattactcagagccgcagttcccactccttgaacaaacagctcatcattaacatggaacccctgcagcccctgcttccttcccccagcgagcaagaagaagaacttcctctgggtgagggtgttccattgcctaaagaggagaacatttctgctcccttgatctccagctccccagtgaaggcagcccgggagtatgaagatccccctagtgaagaggaagataaaataaaagaagaacctttaaccatctctgaactagtgtacaacccaagtgccagcctgctccccacccctgtggatgacgatgagattgacatgctctttgactgtccttctaggcttgagttggaaagagaagacacagattcatttgaggatctggaagcagatgaaaacgcctttttgattgctgaagaagaggagctgaaggaggctcgccgtgctttgtcgtggagctatgacattctgactggccatattcgggtgaacccactggtcaagagtttttccaggctccttgtggtgggcctgggactgctgctctttgtatttcccctgctcctcctccttttggagtcaggtattgatctctccttcttatgcgaaatccgccagacaccagagtttgagcagtttcactatgaatactactgtcccctcaaggagtgggtggctgggaaagtccacctcatcctctacatgctgggttgctcatga

SEQ ID NO: 11472 - DNA, 4259 bp, synthetic construct; identical to SEQ ID NO: 7592
  misc_feature 1..4259: note = Synthetic polypeptide
  source 1..4259: mol_type = other DNA

SEQ ID NO: 11473 - DNA, 3476 bp, synthetic construct; identical to SEQ ID NO: 7593
  misc_feature 1..3476: note = Synthetic polypeptide
  source 1..3476: mol_type = other DNA

SEQ ID NO: 11474 - DNA, 3497 bp, synthetic construct; identical to SEQ ID NO: 7594
  misc_feature 1..3497: note = Synthetic polypeptide
  source 1..3497: mol_type = other DNA

SEQ ID NO: 11475 - DNA, 584 bp, synthetic construct
  misc_feature 1..584: note = Synthetic polypeptide
  source 1..584: mol_type = other DNA
tgtgatggctaatattgagtgtcaaccaagtattgttcctgagtgtgtctctgagggtgttgccagtgtggctagaataaagcaggcagaagaaagtggaatgtggagacttaactgaattttctggccttcatctttctcccatgctgcatgcttcctgctctcgaacatcagactccaagttcttcagcctttggactcttggacttacacgaatggtttgccaggggctcttgggccttcagccacagactgaaggctgcactgtctgcttccctacttttgaggttttgggactcggactggctcccttgctccacagcttgcagacggcctattgtgggacttcatcttgtgatcgtatgccacaccacatgaagcccttgccatattacagctatgaccagcctgtgatcgggtactgccaggcccaccagccactccatgtcaccaagggctatgagacagtgtctccagagcaggacgaaagccccggcctggagctgggccgagaccacagcttcatcgccaccatcgccaggtcggcagcaccggccatctacctagagagaattgcaaactaa

SEQ ID NO: 11476 - DNA, 769 bp, synthetic construct
  misc_feature 1..769: note = Synthetic polypeptide
  source 1..769: mol_type = other DNA
gagtcttgggctcaactcctggctggatgtgtggtcttaggcagtttcaaaaaaaaagatttacatgacgtgccctgactgcccaagctccatacccactgactcttccaatcaccaagtgctggaggctgccaccgagtctcttgcgaaatacaacaatgagaacacatccaagcagtattctctcttcaaagtcaccagggcttctagccagtgggtggtcggcccttcttactttgtggaatacttaattaaagaatcaccatgtactaaatcccaggccagcagctgttcacttcagtcctccgactctgtgcctgttggtctttgcaaaggttctctgactcgaacacactgggaaaagtttgtctctgtgacttgtgacttctttgaatcacaggctccagccactggaagtgaaaactctgctgttaaccagaaacctacaaaccttcccaaggtggaagaatcccagcagaaaaacacccccccaacagactccccctccaaagctgggccaagaggatctgtccaatatcttcctgacttggatgataaaaattcccaggaaaagggccctcaggaggcctttcctgtgcatctggacctaaccacgaatccccagggagaaaccctggatatttccttcctcttcctggagcctatggaggagaagctggtggtcctgcctttccccaaagaaaaagcacgcactgctgagtgcccagggccagcccagaatgccagccctcttgtccttccgccatga

SEQ ID NO: 11477 - DNA, 68 bp, synthetic construct
  misc_feature 1..68: note = Synthetic polypeptide
  source 1..68: mol_type = other DNA
gagtcttgggctcaactcctggctggatgtgtggtcttaggcagtttcaaaaaaaaagatttacatga

SEQ ID NO: 11478 - DNA, 842 bp, synthetic construct; identical to SEQ ID NO: 6534
  misc_feature 1..842: note = Synthetic polypeptide
  source 1..842: mol_type = other DNA

SEQ ID NO: 11479 - DNA, 539 bp, synthetic construct
  misc_feature 1..539: note = Synthetic polypeptide
  source 1..539: mol_type = other DNA
gacagggcgaggggagcgggtctgcggggcgcgggtgaagacagggcgaggggagcgggtctgcggggcgcggtggcattttgtcagcacttgggaacttcctggcccagatgattgagaagaagcggaaaaaagaaaactctagaagtctggatgtcggtgggcctctgagatatgccgtttacgggttcttcttcacagggccgctgagtcacttcttctacttcttcatggaacattggatccctcctgaggtccccctggcagggctcaggaggcttctcctggaccgcctcgtctttgcaccggccttcctcatgttgttcttcctcatcatgaactttctggaggggaaagacgcctcagccttcgccgccaagatgagggggggcttctggccggcgctgaggatgaactggcgggtgtggacgccactacagttcatcaacatcaactacgtccctctgaagttccgggtgctcttcgccaacctggcagctctgttctggtatgcctacctggcctccttggggaagtga

SEQ ID NO: 11480 - DNA, 434 bp, synthetic construct
  misc_feature 1..434: note = Synthetic polypeptide
  source 1..434: mol_type = other DNA
gacagggcgaggggagcgggtctgcggggcgcgggtgaagacagggcgaggggagcgggtctgcggggcgcggtggcattttgtcagcacttgggaacttcctggcccagatgattgagaagaagcggaaaaaagaaaactctagaagtctggatgtcggtgggcctctgagatatgccgtttacggttccgggtgctcttcgccaacctggcagctctgttctggtatgcctacctggcctccttggggaagtgacgaccgctgggagaacatcaggtgcactgtggacgtgggtctgggggtctcacccgcccagcgagagcagaaccaatccagtcaggatgtcactgactctaaatcaggtgattcaagatgcccaaaaatgatggatagagaaacagaaatctctgaatgtcagaaccctgtcttttaa

SEQ ID NO: 11481 - DNA, 1579 bp, synthetic construct
  misc_feature 1..1579: note = Synthetic polypeptide
  source 1..1579: mol_type = other DNA
caggggtctgcaacccgtgggccacagatgggtaccaatccatggcctgttaggaactgagcctcacagcaggaggcgggtggcaggcgagtgagctaagcttcatctatatttacagccgttcctcgtcactcgcatcactgcctgagctccgcctcctgtcagatcagcagtggcattagattctcatagaaacgtgaaccctactgtgaactgtgcatgcgtgggatctaggttgcacgctccttatgagaatttaatgtctgatgatctgtccctgtctcccattacccccagatgggaccatctagttgcaggaaaacaagctcagggctcccactgattctgcgtgatggctgactgtgttgttattattggaggtgcatcaaatgaagcaggaaaatggatggatgatacctgcgacagtaaacgaggctacatatgccagacacgatccgacccttccttgactaatcctccagcaacgattcaaacagatggctttgttaaatatggcaaaagcagctattcactcatgagacaaaaatttcaatggcatgaagcggagacatactgcaagcttcacaattcccttatagccagcattctggatccctacagtaatgcatttgcgtggctgcagatggaaacatctaatgaacgtgtgtggatcgccctgaacagtaacttgactgataatcaatacacttggactgataagtggagggtgaggtacactaactgggctgctgatgagcccaaattgaaatcagcatgtgtttatctggatcttgatggctactggaagacagcacattgcaatgaaagtttttactttctctgtaaaagatcagatgaaatccctgctactgaacccccacaactgcctggcagatgcccggagtcagatcacacagcatggattcctttccatggtcactgttactatattgagtcctcatatacaagaaactggggccaagcttctctggaatgtcttcgaatgggttcctctctggtttccattgaaagtgctgcagaatccagttttctgtcatatcgggttgagccacttaaaagtaaaaccaatttttggataggattgttcagaaatgttgaagggacgtggctgtggataaataacagtccggtctcctttgtcaactggaacacaggagatccctctggtgaacggaatgattgtgtagctttacatgcgtcttctgggttttggagtaatattcactgttcatcctacaaaggatatatttgtaaaagaccaaaaattattgatgctaaacctactcatgaattacttacaacaaaagctgacacaaggaagatggacccttctaaaccgtcttccaacgtggccggagtagtcatcattgtgatcctcctgattttaacgggtgctggccttgccgcctatttcttttataagaaaagacgtgtgcacctacctcaagagggcgcctttgaaaacactctgtattttaacagtcagtcaagcccaggaactagtgatatgaaagatctcgtgggcaatattgaacagaatgaacactcggtcatctag

SEQ ID NO: 11482 - DNA, 500 bp, synthetic construct
  misc_feature 1..500: note = Synthetic polypeptide
  source 1..500: mol_type = other DNA
gacagggcgaggggagcgggtctgcggggcgcggtggcattttgtcagcacttgggaacttcctggcccagatgattgagaagaagcggaaaaaagaaaactctagaagtctggatgtcggtgggcctctgagatatgccgtttacgggttcttcttcacagggccgctgagtcacttcttctacttcttcatggaacattggatccctcctgaggtccccctggcagggctcaggaggcttctcctggaccgcctcgtctttgcaccggccttcctcatgttgttcttcctcatcatgaactttctggaggggaaagacgcctcagccttcgccgccaagatgagggggggcttctggccggcgctgaggatgaactggcgggtgtggacgccactacagttcatcaacatcaactacgtccctctgaagttccgggtgctcttcgccaacctggcagctctgttctggtatgcctacctggcctccttggggaagtga

SEQ ID NO: 11483 - DNA, 395 bp, synthetic construct
  misc_feature 1..395: note = Synthetic polypeptide
  source 1..395: mol_type = other DNA
gacagggcgaggggagcgggtctgcggggcgcggtggcattttgtcagcacttgggaacttcctggcccagatgattgagaagaagcggaaaaaagaaaactctagaagtctggatgtcggtgggcctctgagatatgccgtttacggttccgggtgctcttcgccaacctggcagctctgttctggtatgcctacctggcctccttggggaagtgacgaccgctgggagaacatcaggtgcactgtggacgtgggtctgggggtctcacccgcccagcgagagcagaaccaatccagtcaggatgtcactgactctaaatcaggtgattcaagatgcccaaaaatgatggatagagaaacagaaatctctgaatgtcagaaccctgtcttttaa

SEQ ID NO: 11484 - DNA, 715 bp, synthetic construct
  misc_feature 1..715: note = Synthetic polypeptide
  source 1..715: mol_type = other DNA
caggatcctgagggtatcactgctaagcctgtaagtgaagatatgatggaatgggaagttgaaattgaaggtctacagaattcagtttggcagggtttagtcttccaactgacaatacattttacatcggagtacaactatgctcctccagttgtgaaatttataacaattccgtttcatccaaatgtagacccacacactggtcagccctgtatagactttttggacaaccctgagaagtggaatacaaactatacattgagcagcatcttacttgccctacaggttatgctttctaatccagtgctagagaatccagtgaatttggaagcagccagaatactggttaaagatgaatctctgtacagaacaattctaagacttttcaacaggccattacaaatgaaagatgacagccaggagttacctaaagacccacgtaaatgtatcagaccaattaaaacaacctcatttagtgattactaccagacatggtccagaatagctacatcaaaagccacagaatactacagaactccattgctcaaagttccaaatttcattggacagtattacaaatggaagaaaatggatctacagcatcagaaagaatggaatttaaagtattccgttatcaagtgttggcttgctagaaaaagaatgcctcatgaagtcactcactcaatggaagaaattaagctctgcccaactctaa

SEQ ID NO: 11485 - DNA, 627 bp, synthetic construct
  misc_feature 1..627: note = Synthetic polypeptide
  source 1..627: mol_type = other DNA
caggatcctgagggtatcactgctaagcctgtaagtgaagatatgatggaatgggaagttgaaattgaaggtctacagaattcagtttggcagggtttagtcttccaactgacaatacattttacatcggagtacaactatgctcctccagttgtgaaatttataacaattccgtttcatccaaatgtagacccacacactggtcagccctgtatagactttttggacaaccctgagaagtggaatacaaactatacattgagcagcatcttacttgccctacaggttatgctttctaatccagtgctagagaatccagtgaatttggaagcagccagaatactggttaaagatgaatctctgtacagaacaattctaagacttttcaacaggccattacaaatgaaagatgacagccaggagttacctaaagacccacgtaaatgtatcagaccaattaaaacaacctcatttagtgattactaccagacatggtccagaatagctacatcaaaagccacagaatactacagaactccattgctcaaagttccaaatttcattggacagtattacaaatggaagaaaatggatctacagcatcagaaagaatggaatttaaaatga

SEQ ID NO: 11486 - DNA, 266 bp, synthetic construct
  misc_feature 1..266: note = Synthetic polypeptide
  source 1..266: mol_type = other DNA
cagtgtggcgtgaagacttcctgagccaggaggggctggagaagagccctgaggagatccgccatctgttccaggagaagaaagtggacctgtctaagccactggtggccacgtgtggctctggcgtcacagcctgccacgtggcactaggggcctacctctgcggcaagccagacgtgcccatctacgatggctcctgggtggagtggtacatgcgcgcccggcccgaggatgtcatctcagagggccgggggaagacccactga

SEQ ID NO: 11487 - DNA, 100 bp, synthetic construct; identical to SEQ ID NO: 6584
  misc_feature 1..100: note = Synthetic polypeptide
  source 1..100: mol_type = other DNA

SEQ ID NO: 11488 - DNA, 617 bp, synthetic construct
  misc_feature 1..617: note = Synthetic polypeptide
  source 1..617: mol_type = other DNA
gacagggcgaggggagcgggtctgcggggcgcgggtgaagacagggcgaggggagcgggtctgcggggcgcgggtgaagacagggcgaggggagcgggtcttgggggcgcgggtgaagacagggcgaggggagcgggtctgcggggcgcggtggcattttgtcagcacttgggaacttcctggcccagatgattgagaagaagcggaaaaaagaaaactctagaagtctggatgtcggtgggcctctgagatatgccgtttacgggttcttcttcacagggccgctgagtcacttcttctacttcttcatggaacattggatccctcctgaggtccccctggcagggctcaggaggcttctcctggaccgcctcgtctttgcaccggccttcctcatgttgttcttcctcatcatgaactttctggaggggaaagacgcctcagccttcgccgccaagatgagggggggcttctggccggcgctgaggatgaactggcgggtgtggacgccactacagttcatcaacatcaactacgtccctctgaagttccgggtgctcttcgccaacctggcagctctgttctggtatgcctacctggcctccttggggaagtga

SEQ ID NO: 11489 - DNA, 512 bp, synthetic construct
  misc_feature 1..512: note = Synthetic polypeptide
  source 1..512: mol_type = other DNA
gacagggcgaggggagcgggtctgcggggcgcgggtgaagacagggcgaggggagcgggtctgcggggcgcgggtgaagacagggcgaggggagcgggtcttgggggcgcgggtgaagacagggcgaggggagcgggtctgcggggcgcggtggcattttgtcagcacttgggaacttcctggcccagatgattgagaagaagcggaaaaaagaaaactctagaagtctggatgtcggtgggcctctgagatatgccgtttacggttccgggtgctcttcgccaacctggcagctctgttctggtatgcctacctggcctccttggggaagtgacgaccgctgggagaacatcaggtgcactgtggacgtgggtctgggggtctcacccgcccagcgagagcagaaccaatccagtcaggatgtcactgactctaaatcaggtgattcaagatgcccaaaaatgatggatagagaaacagaaatctctgaatgtcagaaccctgtcttttaa

SEQ ID NO: 11490 - DNA, 406 bp, synthetic construct
  misc_feature 1..406: note = Synthetic polypeptide
  source 1..406: mol_type = other DNA
caaggagtaatcagaggagaagttttccacctggaccaatacggaattccgatacctggaggatggaggcctggaaaggaagttctccctggacgacctgctgaccaacgtcatgctctactggacaacaggcaccatcatctcctcccagcgcttctacaaggagaacctgggacagggctggatgacccagaagcatgagcggatgaaggtctatgtgcccactggcttctctgccttcccttttgagctattgcacacgcctgaaaagtgggtgaggttcaagtacccaaagctcatctcctattcctacatggttcgtgggggccactttgcggcctttgaggagccggagctgctcgcccaggacatccgcaagttcctgtcggtgctggagcggcaatga

SEQ ID NO: 11491 - DNA, 1579 bp, synthetic construct
  misc_feature 1..1579: note = Synthetic polypeptide
  source 1..1579: mol_type = other DNA
caggggtctgcaacccgtgggccgcagatgggtaccaatccatggcctgttaggaactgagcctcacagcaggaggtgggtggcaggcgagtgagctaagcttcatctatatttacagccgttcctcgtcactcgcatcactgcctgagctccgcctcctgtcagatcagcagtggcattagattctcatagaaacgtgaaccctactgtgaactgtgcatgcgtgggatctaggttgcacgctccttatgagaatttaatgtctgatgatctgtccctgtctcccattacccccagatgggaccatctagttgcaggaaaacaagctcagggctcccactgattctgcgtgatggctgactgtgttgttattattggaggtgcatcaaatgaagcaggaaaatggatggatgatacctgcgacagtaaacgaggctacatatgccagacacgatccgacccttccttgactaatcctccagcaacgattcaaacagatggctttgttaaatatggcaaaagcagctattcactcatgagacaaaaatttcaatggcatgaagcggagacatactgcaagcttcacaattcccttatagccagcattctggatccctacagtaatgcatttgcgtggctgcagatggaaacatctaatgaacgtgtgtggatcgccctgaacagtaacttgactgataatcaatacacttggactgataagtggagggtgaggtacactaactgggctgctgatgagcccaaattgaaatcagcatgtgtttatctggatcttgatggctactggaagacagcacattgcaatgaaagtttttactttctctgtaaaagatcagatgaaatccctgctactgaacccccacaactgcctggcagatgcccggagtcagatcacacagcatggattcctttccatggtcactgttactatattgagtcctcatatacaagaaactggggccaagcttctctggaatgtcttcgaatgggttcctctctggtttccattgaaagtgctgcagaatccagttttctgtcatatcgggttgagccacttaaaagtaaaaccaatttttggataggattgttcagaaatgttgaagggacgtggctgtggataaataacagtccggtctcctttgtcaactggaacacaggagatccctctggtgaacggaatgattgtgtagctttacatgcgtcttctgggttttggagtaatattcactgttcttcctacaaaggatatatttgtaaaagaccaaaaattattgatgctaaacctactcatgaattacttacaacaaaagctgacacaaggaagatggacccttctaaaccgtcttccaacgtggccggagtagtcatcattgtgatcctcctgattttaacgggtgctggccttgccgcctatttcttttataagaaaagacgtgtgcacctacctcaagagggcgcctttgaaaacactctgtattttaacagtcagtcaagcccaggaactagtgatatgaaagatctcgtgggcaatattgaacagaatgaacactcggtcatctag

SEQ ID NO: 11492 - DNA, 435 bp, synthetic construct
  misc_feature 1..435: note = Synthetic polypeptide
  source 1..435: mol_type = other DNA
gatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctga

SEQ ID NO: 11493 - DNA, 351 bp, synthetic construct
  misc_feature 1..351: note = Synthetic polypeptide
  source 1..351: mol_type = other DNA
gatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctggtgaggacccgagtgcctgggggcggggggaggggtccgttgcttgtggggtgctgggagtggctcctgtacaggtctgggaatga

SEQ ID NO: 11494 - DNA, 345 bp, synthetic construct
  misc_feature 1..345: note = Synthetic polypeptide
  source 1..345: mol_type = other DNA
caaggagtaatcagagggtggaaacgtcagatgaggagatccacgacttacaccagaggatcgataagttccgtttcaccccacctttggaggacagctgcttccactatggcttcaactccaactacctgaagaaagtcatctcctactggcggaatgaatttgactggaagaagcaggtggagattctcaacagataccctcacttcaagactaagattgaagggctggacatccacttcatccacgtgaagcccccccagctgcccgcaggccataccccgaagcccttgctgatggtgcacggctggcccggctctttctacgagttttataagatcatcc

SEQ ID NO: 11495 - DNA, 1229 bp, synthetic construct
  misc_feature 1..1229: note = Synthetic polypeptide
  source 1..1229: mol_type = other DNA
caaggagtaatcagagggtggaaacgtcagatgaggagatccacgacttacaccagaggatcgataagttccgtttcaccccacctttggaggacagctgcttccactatggcttcaactccaactacctgaagaaagtcatctcctactggcggaatgaatttgactggaagaagcaggtggagattctcaacagataccctcacttcaagactaagattgaagggctggacatccacttcatccacgtgaagcccccccagctgcccgcaggccataccccgaagcccttgctgatggtgcacggctggcccggctctttctacgagttttataagatcatcccactcctgactgaccccaagaaccatggcctgagcgatgagcacgtttttgaagtcatctgcccttccatccctggctatggcttctcagaggcatcctccaagaaggggttcaactcggtggccaccgccaggatcttttacaagctgatgctgcggctgggcttccaggaattctacattcaaggaggggactgggggtccctgatctgcactaatatggcccagctggtgcccagccacgtgaaaggcctgcacttgaacatggctttggttttaagcaacttctctaccctgaccctcctcctgggacagcgtttcgggaggtttcttggcctcactgagagggatgtggagctgctgtaccccgtcaaggagaaggtattctacagcctgatgagggagagcggctacatgcacatccagtgcaccaagcctgacaccgtaggctctgctctgaatgactctcctgtgggtctggctgcctatattctagagaagttttccacctggaccaatacggaattccgatacctggaggatggaggcctggaaaggaagttctccctggacgacctgctgaccaacgtcatgctctactggacaacaggcaccatcatctcctcccagcgcttctacaaggagaacctgggacagggctggatgacccagaagcatgagcggatgaaggtctatgtgcccactggcttctctgccttcccttttgagctattgcacacgcctgaaaagtgggtgaggttcaagtacccaaagctcatctcctattcctacatggttcgtgggggccactttgcggcctttgaggagccggagctgctcgcccaggacatccgcaagttcctgtcggtgctggagcggcaatga

SEQ ID NO: 11496 - DNA, 269 bp, synthetic construct
  misc_feature 1..269: note = Synthetic polypeptide
  source 1..269: mol_type = other DNA
caaggagtaatcagagggtggaaacgtcagatgaggagatccacgacttacaccagaggatcgataagttccgtttcaccccacctttggaggacagctgcttccactatggcttcaactccaactacctgaagaaagtcatctcctactggcggaatgaatttgactggaagaagcaggtggagattctcaacagataccctcacttcaagactaagattgaagggctggacatccacttcatccacgtgaagcccccccagctgccc

SEQ ID NO: 11497 - DNA, 772 bp, synthetic construct
  misc_feature 1..772: note = Synthetic polypeptide
  source 1..772: mol_type = other DNA
gaagcaggtccatgcctcccgcagcaacaacatgggcatcgttggtggcttcactcagatgattcgagaaggaggggccaggtcactctggcggggcaatggcatcaacgtcctcaaaattgcccccgaatcagccatcaaattcatggcctatgagcagatcaagcgccttgttggtagtgaccaggagactctgaggattcacgagaggcttgtggcagggtccttggcaggggccatcgcccagagcagcatctacccaatggaggtcctgaagacccggatggcgctgcggaagacaggccagtactcaggaatgctggactgcgccaggaggatcctggccagagagggggtggccgccttctacaaaggctatgtccccaacatgctgggcatcatcccctatgccggcatcgaccttgcagtctacgagacgctcaagaatgcctggctgcagcactatgcagtgaacagcgcggaccccggcgtgtttgtgctcctggcctgtggcaccatgtccagtacctgtggccagctggccagctaccccctggccctagtcaggacccggatgcaggcgcaagcctctattgagggcgctccggaggtgaccatgagcagcctcttcaaacatatcctgcggaccgagggggccttcgggctgtacagggggctggcccccaacttcatgaaggtcatcccagctgtgagcatcagctacgtggtctacgagaacctgaagatcaccctgggcgtgcagtcgcggtga

SEQ ID NO: 11498 - DNA, 347 bp, synthetic construct
  misc_feature 1..347: note = Synthetic polypeptide
  source 1..347: mol_type = other DNA
ggtggctcacacctgtaatcccaacactttgggagactgaggcaggcagatcatctgaggtcaggagtttgagaccagcctggcccaatatgatcaataagatggagtggtggagccgcttggtgtccagtgaccctgagatcaacaccaagaagattaaccctgagaattccaagctgtcagacctggacagtgagactcgcagcatggtggaaaagatgatgtatgaccagcgacagaagtccatggggctgccaacttcagacgaacagaagaaacaggagattctgaagaagttcatggatcaacatccggagatggatttttccaaggctaaattcaactag

SEQ ID NO: 11499 - DNA, 1267 bp, synthetic construct; identical to SEQ ID NO: 6631
  misc_feature 1..1267: note = Synthetic polypeptide
  source 1..1267: mol_type = other DNA

SEQ ID NO: 11500 - DNA, 263 bp, synthetic construct; identical to SEQ ID NO: 6632
  misc_feature 1..263: note = Synthetic polypeptide
  source 1..263: mol_type = other DNA

SEQ ID NO: 11501 - DNA, 502 bp, synthetic construct
  misc_feature 1..502: note = Synthetic polypeptide
  source 1..502: mol_type = other DNA
ggccagtctcagtggctcatgcctataatcccagcagtttgggaggccaaggcatgtggattgcttaagcccaggaattcaagaccagcccaggcaatgtggtcacgtgcggttcattgactatgaatatgctggctacaactaccaagcttttgacattggcaaccatttcaatgagtttgcaggcgtgaatgaggtggattactgcctgtacccggcgcgggagacccagctgcagtggctgcactactacctgcaggcacaaaaggggatggccgtgacccccagggaggtgcaaaggctctacgtgcaagtcaacaagtttgccctgggtcctagctgtgtgtcttccacaatgactgcatccctccagtgctgtagagtcggaaacaggcatggggagattgccaggctgaccctctctggtctgtttccaggcgtctcacttcttctgggctctctgggccctcatccagaaccagtactccaccatcgactttga

SEQ ID NO: 11502 - DNA, 478 bp, synthetic construct
  misc_feature 1..478: note = Synthetic polypeptide
  source 1..478: mol_type = other DNA
ggccagtctcagtggctcatgcctataatcccagcagtttgggaggccaaggcatgtggattgcttaagcccaggaattcaagaccagcccaggcaatgtggtcacgtgcggttcattgactatgaatatgctggctacaactaccaagcttttgacattggcaaccatttcaatgagtttgcaggcgtgaatgaggtggattactgcctgtacccggcgcgggagacccagctgcagtggctgcactactacctgcaggcacaaaaggggatggccgtgacccccagggaggtgcaaaggctctacgtgcaagtcaacaagtttgccctggcgtctcacttcttctgggctctctgggccctcatccagaaccagtactccaccatcgactttgatttcctcaggtacgcagtgatccgattcaaccagtacttcaaggtgaagcctcaagcgtcagccttggagatgccaaagtga

SEQ ID NO: 11503 - DNA, 372 bp, synthetic construct
  misc_feature 1..372: note = Synthetic polypeptide
  source 1..372: mol_type = other DNA
ggccagtctcagtggctcatgcctataatcccagcagtttgggaggccaaggcatgtggattgcttaagcccaggaattcaagaccagcccaggcaatgtggtcacgtgcggttcattgactatgaatatgctggctacaactaccaagcttttgacattggcaaccatttcaatgagtttgcaggcgtgaatgaggtggattactgcctgtacccggcgcgggagacccagctgcagtggctgcactactacctgcaggcacaaaaggggatggccgtgacccccagggaggtgcaaaggctctacgtgcaagtcaacaagtttgccctggcgtctcacttcttctgggctctctgggccctcatccagaa

SEQ ID NO: 11504 - DNA, 323 bp, synthetic construct
  misc_feature 1..323: note = Synthetic polypeptide
  source 1..323: mol_type = other DNA
ggccagtctcagtggctcatgcctataatcccagcagtttgggaggccaaggcatgtggattgcttaagcccaggaattcaagaccagcccaggcaatgtggtcacgtgcggttcattgactatgaatatgctggctacaactaccaagcttttgacattggcaaccatttcaatgagtttgcaggcgtgaatgaggtggattactgcctgtacccggcgcgggagacccagctgcagtggctgcactactacctgcaggcacaaaaggggatggccgtgacccccagggaggtgcaaaggctctacgtgcaagtcaacaagt

SEQ ID NO: 11505 - DNA, 222 bp, synthetic construct
  misc_feature 1..222: note = Synthetic polypeptide
  source 1..222: mol_type = other DNA
ggccagtctcagtggctcatgcctataatcccagcagtttgggaggccaaggcatgtggattgcttaagcccaggaattcaagaccagcccaggcaatgtggtcacgtgcggttcattgactatgaatatgctggctacaactaccaagcttttgacattggcaaccatttcaatgagtttgcaggcgtgaatgaggtggattactgcctgtacccggcgcg

SEQ ID NO: 11506 - DNA, 5350 bp, synthetic construct; identical to SEQ ID NO: 655
  misc_feature 1..5350: note = Synthetic polypeptide
  source 1..5350: mol_type = other DNA

SEQ ID NO: 11507 - DNA, 387 bp, synthetic construct; identical to SEQ ID NO: 544
  misc_feature 1..387: note = Synthetic polypeptide
  source 1..387: mol_type = other DNA

SEQ ID NO: 11508 - DNA, 540 bp, synthetic construct; identical to SEQ ID NO: 545
  misc_feature 1..540: note = Synthetic polypeptide
  source 1..540: mol_type = other DNA

SEQ ID NO: 11509 - DNA, 303 bp, synthetic construct; identical to SEQ ID NO: 547
  misc_feature 1..303: note = Synthetic polypeptide
  source 1..303: mol_type = other DNA

SEQ ID NO: 11510 - DNA, 1424 bp, synthetic construct
  misc_feature 1..1424: note = Synthetic polypeptide
  source 1..1424: mol_type = other DNA
ggccaggtgtggtggcttgtgcgtgtaatcccagaactttgggaggccaaggcaggtggattacctgaggtcaggagttcaagaccatcctagccaacatgccaggactaaaagaagtggtagaatcctgtcgaggaaaaaatctttttttttctaccaatattgatgatgccatcaaagaagctgatcttgtatttatttctgtgaatactccaacaaaaacctatggaatggggaaaggccgggcagcagatctgaagtatattgaagcttgtgctagacgcattgtgcaaaactcaaatgggtacaaaattgtgactgagaaaagcacagttccagtgcgggcagcagaaagtatccgtcgcatatttgatgcaaacacaaaacccaacttgaatttacaggtgctgtccaaccctgagtttctggcagagggaacagccatcaaggacctaaagaacccagacagagtactgattggaggggatgaaactccagagggccagagagctgtgcaggccctgtgtgctgtatatgagcactgggttcccagagaaaagatcctcaccactaatacttggtcttcagagctttccaaactggcagcaaatgcttttcttgcccagagaataagcagcattaactccataagtgctctgtgtgaagcaacaggagctgatgtagaagaggtagcaacagcgattggaatggaccagagaattggaaacaagtttctaaaagccagtgttgggtttggtgggagctgtttccaaaaggatgttctgaatttggtttatctctgtgaggctctgaatttgccagaagtagctcgttattggcagcaggtcatagacatgaatgactaccagaggaggaggtttgcttcccggatcatagatagtctgtttaatacagtaactgataagaagatagctattttgggatttgcattcaaaaaggacactggtgatacaagagaatcttctagtatatatattagcaaatatttgatggatgaaggtgcacatctacatatatatgatccaaaagtacctagggaacaaatagttgtggatctttctcatccaggtgtttcagaggatgaccaagtgtcccggctcgtgaccatttccaaggatccatatgaagcatgtgatggtgcccatgctgttgttatttgcactgagtgggacatgtttaaggaattggattatgaacgcattcataaaaaaatgctaaagccagcctttatcttcgatggacggcgtgtcctggatgggctccacaatgaactacaaaccattggcttccagattgaaacaattggcaaaaaggtgtcttcaaagagaattccatatgctccttctggtgaaattccgaagtttagtcttcaagatccacctaacaagaaacctaaagtgtag

SEQ ID NO: 11511 - DNA, 1223 bp, synthetic construct
  misc_feature 1..1223: note = Synthetic polypeptide
  source 1..1223: mol_type = other DNA
ggccaggtgtggtggcttgtgcgtgtaatcccagaactttgggaggccaaggcaggtggattacctgaggtcaggagttcaagaccatcctagccaacatgccaggactaaaagaagtggtagaatcctgtcgaggaaaaaatctttttttttctaccaatattgatgatgccatcaaagaagctgatcttgtatttatttctgtgctgtccaaccctgagtttctggcagagggaacagccatcaaggacctaaagaacccagacagagtactgattggaggggatgaaactccagagggccagagagctgtgcaggccctgtgtgctgtatatgagcactgggttcccagagaaaagatcctcaccactaatacttggtcttcagagctttccaaactggcagcaaatgcttttcttgcccagagaataagcagcattaactccataagtgctctgtgtgaagcaacaggagctgatgtagaagaggtagcaacagcgattggaatggaccagagaattggaaacaagtttctaaaagccagtgttgggtttggtgggagctgtttccaaaaggatgttctgaatttggtttatctctgtgaggctctgaatttgccagaagtagctcgttattggcagcaggtcatagacatgaatgactaccagaggaggaggtttgcttcccggatcatagatagtctgtttaatacagtaactgataagaagatagctattttgggatttgcattcaaaaaggacactggtgatacaagagaatcttctagtatatatattagcaaatatttgatggatgaaggtgcacatctacatatatatgatccaaaagtacctagggaacaaatagttgtggatctttctcatccaggtgtttcagaggatgaccaagtgtcccggctcgtgaccatttccaaggatccatatgaagcatgtgatggtgcccatgctgttgttatttgcactgagtgggacatgtttaaggaattggattatgaacgcattcataaaaaaatgctaaagccagcctttatcttcgatggacggcgtgtcctggatgggctccacaatgaactacaaaccattggcttccagattgaaacaattggcaaaaaggtgtcttcaaagagaattccatatgctccttctggtgaaattccgaagtttagtcttcaagatccacctaacaagaaacctaaagtgtag

SEQ ID NO: 11512 - DNA, 444 bp, synthetic construct
  misc_feature 1..444: note = Synthetic polypeptide
  source 1..444: mol_type = other DNA
ggccaggtgtggtggcttgtgcgtgtaatcccagaactttgggaggccaaggcaggtggattacctgaggtcaggagttcaagaccatcctagccaacatgccaggactaaaagaagtggtagaatcctgtcgaggaaaaaatctttttttttctaccaatattgatgatgccatcaaagaagctgatcttgtatttatttctgtgaatactccaacaaaaacctatggaatggggaaaggccgggcagcagatctgaagtatattgaagcttgtgctagacgcattgtgcaaaactcaaatgggtacaaaattgtgactgagaaaagcacagttccagtgcgggcagcagaaagtatccgtcgcatatttgatgcaaacacaaaacccaacttgaatttacaggtgctgtccaaccctgagtttctggcagagggaacagcca

SEQ ID NO: 11513 - DNA, 398 bp, synthetic construct
  misc_feature 1..398: note = Synthetic polypeptide
  source 1..398: mol_type = other DNA
ggccaggtgtggtggcttgtgcgtgtaatcccagaactttgggaggccaaggcaggtggattacctgaggtcaggagttcaagaccatcctagccaacatgccaggactaaaagaagtggtagaatcctgtcgaggaaaaaatctttttttttctaccaatattgatgatgccatcaaagaagctgatcttgtatttatttctgtgaatactccaacaaaaacctatggaatggggaaaggccgggcagcagatctgaagtatattgaagcttgtgctagacgcattgtgcaaaactcaaatgggtacaaaattgtgactgagaaaagcacagttccagtgcgggcagcagaaagtatccgtcgcatatttgatgcaaacacaaaacccaacttgaat

SEQ ID NO: 11514 - DNA, 329 bp, synthetic construct
  misc_feature 1..329: note = Synthetic polypeptide
  source 1..329: mol_type = other DNA
ggccaggtgtggtggcttgtgcgtgtaatcccagaactttgggaggccaaggcaggtggattacctgaggtcaggagttcaagaccatcctagccaacatgccaggactaaaagaagtggtagaatcctgtcgaggaaaaaatctttttttttctaccaatattgatgatgccatcaaagaagctgatcttgtatttatttctgtgaatactccaacaaaaacctatggaatggggaaaggccgggcagcagatctgaagtatattgaagcttgtgctagacgcattgtgcaaaactcaaatgggtacaaaattgtgactgagaaaagc

SEQ ID NO: 11515 - DNA, 193 bp, synthetic construct
  misc_feature 1..193: note = Synthetic polypeptide
  source 1..193: mol_type = other DNA
ggccaggtgtggtggcttgtgcgtgtaatcccagaactttgggaggccaaggcaggtggattacctgaggtcaggagttcaagaccatcctagccaacatgccaggactaaaagaagtggtagaatcctgtcgaggaaaaaatctttttttttctaccaatattgatgatgccatcaaagaagctgatcttgt

SEQ ID NO: 11516 - DNA, 4908 bp, synthetic construct
  misc_feature 1..4908: note = Synthetic polypeptide
  source 1..4908: mol_type = other DNA
ggccgggtgcggtggctcatgcctgtaaagccagcactttgggaggctgaggcgggcggatcacgaggcaccacagtaccggcactgctgaacagtacttccaaccaactctacctgcatttccagtctgacattagtgtggcagctgctggtttccacctggaatacaaaactgtaggtcttgctgcatgccaagaaccagccctccccagcaacagcatcaaaatcggagatcggtacatggtgaacgacgtgctctccttccagtgcgagcccgggtacaccctgcagggccgttcccacatttcctgtatgccagggaccgttcgccgttggaactatccgtctcccctgtgcattgcaacctgtggagggacgctgagcaccttgggtggtgtgatcctgagccccggcttcccaggttcttaccccaacaacttagactgcacctggaggatctcattacccatcggctatggtgcacatattcagtttctgaatttttctaccgaagctaatcatgacttccttgaaattcaaaatggaccttaccacaccagccccatgattggacaatttagcggcacggatctccccgcggccctgctgagcacaacgcatgaaaccctcatccacttttatagtgaccattcgcaaaaccggcaaggatttaaacttgcttaccaagcctatgaattacagaactgtccagatccacccccatttcagaatgggtacatgatcaactcggattacagcgtggggcaatcagtatctttcgagtgttatcctgggtacattctaataggccatcctgtcctcacttgtcagcatgggatcaacagaaactggaactacccttttccaagatgtgatgccccttgtgggtacaacgtaacttctcagaacggcaccatctactcccctggctttcctgatgagtatccgatcctgaaggactgcatttggctcatcacggtgcctccagggcacggagtttacatcaacttcaccctgttacagacggaagctgtcaacgattacattgctgtttgggacggtcccgatcagaactcaccccagctgggagttttcagtggcaacacagccctcgaaacggcgtatagctccaccaaccaagtcctgctcaagttccacagcgacttttcaaatggaggcttctttgtcctcaatttccacgcatttcagctcaagaaatgtcaacctcccccagcggttccacaggcagaaatgcttactgaggatgatgatttcgaaataggagattttgtgaagtaccagtgccaccccgggtacaccttggtggggaccgacattctgacttgcaagctcagttcccagttgcagtttgagggttctctcccaacatgtgaaggttcttctgggcaaagtcctctgctagtagtcttaagtgggaatcatactgaacaatcaaattttacaagcaggagtaatcagttatatctccgctggtccactgaccatgccaccagtaagaaaggattcaagattcgctatgcagcaccttactgcagtttgacccaccccctgaagaatgggggtattctaaacaggactgcaggagcggttggaagcaaagtgcattatttttgcaagcctggataccgaatggtcggccacagcaatgcaacctgtagacgaaacccacttggcatgtaccagtgggactccctcacgccactctgccaggctgtgtcctgtggaatcccagaatccccaggaaacggttcatttaccgggaacgagttcactttggacagtaaagtggtctatgaatgtcatgagggcttcaagcttgaatccagccagcaagcaacagccgtgtgtcaagaagatgggttgtggagtaacaaggggaagccgcccacgtgtaagccggtcgcttgccccagcattgaagctcagctctcagaacatgtcatctggaggctggtttcaggatccttgaatgagtacggtgctcaagtattgctgagctgcagtcctggttactacttagaaggctggaggctcctgcggtgccaggccaatgggacgtggaacataggagatgagaggccaagctgtcgagttatctcgtgtggaagcctttcctttcccccaaatggcaacaagattggaacgttgacagtttatggggccacagctatatttacgtgcaacaccggctacacgcttgtggggtctcatgtcagagagtgcttggcaaatgggctctggagcggcagcgaaactcgatgtctggctggccactgcggttccccagacccgattgtgaacggtcacattagtggagatggcttcagttacagagacacggtggtttaccagtgcaatcctggtttccggcttgtgggaacttccgtgaggatatgcctgcaagaccacaagtggtctggacaaacgcctgtctgtgtccccatcacatgtggtcaccctggaaaccctgcccacggattcactaatggcagtgagttcaacctgaatgatgtcgtgaatttcacctgcaacacgggctatttgctgcagggcgtgtctcgagcccagtgtcggagcaacggccagtggagtagccctctgcccacgtgtcgagtggtgaactgttctgatccaggctttgtggaaaatgccattcgtcacgggcaacagaacttccctgagagttttgagtatggaatgagtatcctgtaccattgcaagaagggattttacttgctgggatcttcagccttgacctgtatggcaaatggcttatgggaccgatccctgcccaagtgtttggctatatcgtgtggacacccaggggtccctgccaacgccgtcctcactggagagctgtttacctatggcgccgtcgtgcactactcctgcagagggagcgagagcctcataggcaacgacacgagagtgtgccaggaagacagtcactggagcggggcactgccccactgcacaggaaataatcctggattctgtggtgatccggggaccccagcacatgggtctcggcttggtgatgactttaagacaaagagtcttctccgcttctcctgtgaaatggggcaccagctgaggggctcccctgaacgcacgtgtttgctcaatgggtcatggtcaggactgcagccggtgtgtgaggccgtgtcctgtggcaaccctggcacacccaccaacggaatgattgtcagtagtgatggcattctgttctccagctcggtcatctatgcctgctgggaaggctacaagacctcagggctcatgacacggcattgcacagccaatgggacctggacaggcactgctcccgactgcacaattataagttgtggggatccaggcacactagcaaatggcatccagtttgggaccgacttcaccttcaacaagactgtgagctatcagtgtaacccaggctatgtcatggaagcagtcacatccgccactattcgctgtaccaaagacggcaggtggaatccgagcaaacctgtctgcaaagccgtgctgtgtcctcagccgccgccggtgcagaatggaacagtggagggaagtgatttccgctggggctccagcataagttacagctgcatggacggttaccagctctctcactccgccatcctctcctgtgaaggtcgcggggtgtggaaaggagagatcccccagtgtctccctgtgttctgcggagaccctggcatccccgcagaagggcgacttagtgggaaaagtttcacctataagtccgaagtcttcttccagtgcaaatctccatttatactcgtgggatcctccagaagagtctgccaagctgacggcacgtggagcggcatacaacccacctgcattgatcctgctcataacacctgcccagaccctggtacgccacactttggaatacagaatagctccagaggctatgaggttggaagcacggtttttttcaggtgcagaaaaggctaccatattcaaggttccacgactcgcacctgccttgccaatttaacatggagtgggatacagaccgaatgtatacctcatgcctgcagacagccagaaaccccggcacacgcggatgtgagagccatcgatcttcctactttcggctacaccttagtgtacacctgccatccaggctttttcctcgcagggggatctgagcacagaacatgtaaagcagacatgaaatggacaggaaagtcgcctgtgtgtaaaattccttcagatgtctttttcgtcaattcactgtggaaggggtattatgaatatttagggaaaagacaacccgccactctaactgttgactggttcaatgcaacaagcagtaaggtgaatgccaccttcagcgaagcctcgccagtggagctgaagttgacaggcatttacaagaaggaggaggcccacttactcctgaaagcttttcaaattaaaggccaggcagatatttttgtaagcaagttcgaaaatgacaactggggactagatggttatgtgtcatctggacttgaaagaggaggatttacttttcaaggtgacattcatggaaaagactttggaaaatttaagctagaaaggcaagatcctttaaacccagatcaagactcttccagtcattaccacggcaccagcagtggctctgtggcggctgccattctggttcctttctttgctctaattttatcagggtttgcattttacctctacaaacacagaacgagaccaaaagttcaatacaatggctatgctgggcatgaaaacagcaatggacaagcatcgtttgaaaaccccatgtatgatacaaacttaaaacccacagaagccaaggctgtgaggtttgacacaactctgaacacagtctgtacagtggtatag

SEQ ID NO: 11517 - DNA, 4611 bp, synthetic construct
  misc_feature 1..4611: note = Synthetic polypeptide
  source 1..4611: mol_type = other DNA
ggccgggtgcggtggctcatgcctgtaaagccagcactttgggaggctgaggcgggcggatcacgaggcaccacagtaccggcactgctgaacagtacttccaaccaactctacctgcatttccagtctgacattagtgtggcagctgctggtttccacctggaatacaaaactgtaggtcttgctgcatgccaagaaccagccctccccagcaacagcatcaaaatcggagatcggtacatggtgaacgacgtgctctccttccagtgcgagcccgggtacaccctgcagggccgttcccacatttcctgtatgccagggaccgttcgccgttggaactatccgtctcccctgtgcattgcaacctgtggagggacgctgagcaccttgggtggtgtgatcctgagccccggcttcccaggttcttaccccaacaacttagactgcacctggaggatctcattacccatcggctatggtgcacatattcagtttctgaatttttctaccgaagctaatcatgacttccttgaaattcaaaatggaccttaccacaccagccccatgattggacaatttagcggcacggatctccccgcggccctgctgagcacaacgcatgaaaccctcatccacttttatagtgaccattcgcaaaaccggcaaggatttaaacttgcttaccaagcctatgaattacagaactgtccagatccacccccatttcagaatgggtacatgatcaactcggattacagcgtggggcaatcagtatctttcgagtgttatcctgggtacattctaataggccatcctgtcctcacttgtcagcatgggatcaacagaaactggaactacccttttccaagatgtgatgccccttgtgggtacaacgtaacttctcagaacggcaccatctactcccctggctttcctgatgagtatccgatcctgaaggactgcatttggctcatcacggtgcctccagggcacggagtttacatcaacttcaccctgttacagacggaagctgtcaacgattacattgctgtttgggacggtcccgatcagaactcaccccagctgggagttttcagtggcaacacagccctcgaaacggcgtatagctccaccaaccaagtcctgctcaagttccacagcgacttttcaaatggaggcttctttgtcctcaatttccacgcatttcagctcaagaaatgtcaacctcccccagcggttccacaggcagaaatgcttactgaggatgatgatttcgaaataggagattttgtgaagtaccagtgccaccccgggtacaccttggtggggaccgacattctgacttgcaagctcagttcccagttgcagtttgagggttctctcccaacatgtgaagcacaatgcccagcaaatgaagtccggactggatcatcgggagtcattctcagtccagggtatccgggtaattattttaactcccagacttgctcttggagtattaaagtggaaccaaactacaacattaccatctttgtggacacatttcaaagtgaaaagcagtttgatgcactggaagtgtttgatggttcttctgggcaaagtcctctgctagtagtcttaagtgggaatcatactgaacaatcaaattttacaagcaggagtaatcagttatatctccgctggtccactgaccatgccaccagtaagaaaggattcaagattcgctatgcagcaccttactgcagtttgacccaccccctgaagaatgggggtattctaaacaggactgcaggagcggttggaagcaaagtgcattatttttgcaagcctggataccgaatggtcggccacagcaatgcaacctgtagacgaaacccacttggcatgtaccagtgggactccctcacgccactctgccaggctgtgtcctgtggaatcccagaatccccaggaaacggttcatttaccgggaacgagttcactttggacagtaaagtggtctatgaatgtcatgagggcttcaagcttgaatccagccagcaagcaacagccgtgtgtcaagaagatgggttgtggagtaacaaggggaagccgcccacgtgtaagccggtcgcttgccccagcattgaagctcagctctcagaacatgtcatctggaggctggtttcaggatccttgaatgagtacggtgctcaagtattgctgagctgcagtcctggttactacttagaaggctggaggctcctgcggtgccaggccaatgggacgtggaacataggagatgagaggccaagctgtcgagctggccactgcggttccccagacccgattgtgaacggtcacattagtggagatggcttcagttacagagacacggtggtttaccagtgcaatcctggtttccggcttgtgggaacttccgtgaggatatgcctgcaagaccacaagtggtctggacaaacgcctgtctgtgtccccatcacatgtggtcaccctggaaaccctgcccacggattcactaatggcagtgagttcaacctgaatgatgtcgtgaatttcacctgcaacacgggctatttgctgcagggcgtgtctcgagcccagtgtcggagcaacggccagtggagtagccctctgcccacgtgtcgagtggtgaactgttctgatccaggctttgtggaaaatgccattcgtcacgggcaacagaacttccctgagagttttgagtatggaatgagtatcctgtaccattgcaagaagggattttacttgctgggatcttcagccttgacctgtatggcaaatggcttatgggaccgatccctgcccaagtgtttggctatatcgtgtggacacccaggggtccctgccaacgccgtcctcactggagagctgtttacctatggcgccgtcgtgcactactcctgcagagggagcgagagcctcataggcaacgacacgagagtgtgccaggaagacagtcactggagcggggcactgccccactgcacaggaaataatcctggattctgtggtgatccggggaccccagcacatgggtctcggcttggtgatgactttaagacaaagagtcttctccgcttctcctgtgaaatggggcaccagctgaggggctcccctgaacgcacgtgtttgctcaatgggtcatggtcaggactgcagccggtgtgtgaggccgtgctgtgtcctcagccgccgccggtgcagaatggaacagtggagggaagtgatttccgctggggctccagcataagttacagctgcatggacggttaccagctctctcactccgccatcctctcctgtgaaggtcgcggggtgtggaaaggagagatcccccagtgtctccctgtgttctgcggagaccctggcatccccgcagaagggcgacttagtgggaaaagtttcacctataagtccgaagtcttcttccagtgcaaatctccatttatactcgtgggatcctccagaagagtctgccaagctgacggcacgtggagcggcatacaacccacctgcattgatcctgctcataacacctgcccagaccctggtacgccacactttggaatacagaatagctccagaggctatgaggttggaagcacggtttttttcaggtgcagaaaaggctaccatattcaaggttccacgactcgcacctgccttgccaatttaacatggagtgggatacagaccgaatgtatacctcatgcctgcagacagccagaaaccccggcacacgcggatgtgagagccatcgatcttcctactttcggctacaccttagtgtacacctgccatccaggctttttcctcgcagggggatctgagcacagaacatgtaaagcagacatgaaatggacaggaaagtcgcctgtgtgtaaaagtaaaggagtgagagaagttaatgaaacagttactaaaactccagttccttcagatgtctttttcgtcaattcactgtggaaggggtattatgaatatttagggaaaagacaacccgccactctaactgttgactggttcaatgcaacaagcagtaaggtgaatgccaccttcagcgaagcctcgccagtggagctgaagttgacaggcatttacaagaaggaggaggcccacttactcctgaaagcttttcaaattaaaggccaggcagatatttttgtaagcaagttcgaaaatgacaactggggactagatggttatgtgtcatctggacttgaaagaggaggatttacttttcaaggtgacattcatggaaaagactttggaaaatttaagctagaaaggcaagatcctttaaacccagatcaagactcttccagtcattaccacggcaccagcagtggctctgtggcggctgccattctggttcctttctttgctctaattttatcagggtttgcattttacctctacaaacacagaacgagaccaaaagttcaatacaatggctatgctgggcatgaaaacagcaatggacaagcatcgtttgaaaaccccatgtatgatacaaacttaaaacccacagaagccaaggctgtgaggtttgacacaactctgaacacagtctgtacagtggtatag

SEQ ID NO: 11518 - DNA, 5142 bp, synthetic construct
  misc_feature 1..5142: note = Synthetic polypeptide
  source 1..5142: mol_type = other DNA
ggccgggtgcggtggctcatgcctgtaaagccagcactttgggaggctgaggcgggcggatcacgaggcaccacagtaccggcactgctgaacagtacttccaaccaactctacctgcatttccagtctgacattagtgtggcagctgctggtttccacctggaatacaaaactgtaggtcttgctgcatgccaagaaccagccctccccagcaacagcatcaaaatcggagatcggtacatggtgaacgacgtgctctccttccagtgcgagcccgggtacaccctgcagggccgttcccacatttcctgtatgccagggaccgttcgccgttggaactatccgtctcccctgtgcattgcaacctgtggagggacgctgagcaccttgggtggtgtgatcctgagccccggcttcccaggttcttaccccaacaacttagactgcacctggaggatctcattacccatcggctatggtgcacatattcagtttctgaatttttctaccgaagctaatcatgacttccttgaaattcaaaatggaccttaccacaccagccccatgattggacaatttagcggcacggatctccccgcggccctgctgagcacaacgcatgaaaccctcatccacttttatagtgaccattcgcaaaaccggcaaggatttaaacttgcttaccaagcctatgaattacagaactgtccagatccacccccatttcagaatgggtacatgatcaactcggattacagcgtggggcaatcagtatctttcgagtgttatcctgggtacattctaataggccatcctgtcctcacttgtcagcatgggatcaacagaaactggaactacccttttccaagatgtgatgccccttgtgggtacaacgtaacttctcagaacggcaccatctactcccctggctttcctgatgagtatccgatcctgaaggactgcatttggctcatcacggtgcctccagggcacggagtttacatcaacttcaccctgttacagacggaagctgtcaacgattacattgctgtttgggacggtcccgatcagaactcaccccagctgggagttttcagtggcaacacagccctcgaaacggcgtatagctccaccaaccaagtcctgctcaagttccacagcgacttttcaaatggaggcttctttgtcctcaatttccacgcatttcagctcaagaaatgtcaacctcccccagcggttccacaggcagaaatgcttactgaggatgatgatttcgaaataggagattttgtgaagtaccagtgccaccccgggtacaccttggtggggaccgacattctgacttgcaagctcagttcccagttgcagtttgagggttctctcccaacatgtgaagcacaatgcccagcaaatgaagtccggactggatcatcgggagtcattctcagtccagggtatccgggtaattattttaactcccagacttgctcttggagtattaaagtggaaccaaactacaacattaccatctttgtggacacatttcaaagtgaaaagcagtttgatgcactggaagtgtttgatggttcttctgggcaaagtcctctgctagtagtcttaagtgggaatcatactgaacaatcaaattttacaagcaggagtaatcagttatatctccgctggtccactgaccatgccaccagtaagaaaggattcaagattcgctatgcagcaccttactgcagtttgacccaccccctgaagaatgggggtattctaaacaggactgcaggagcggttggaagcaaagtgcattatttttgcaagcctggataccgaatggtcggccacagcaatgcaacctgtagacgaaacccacttggcatgtaccagtgggactccctcacgccactctgccaggctgtgtcctgtggaatcccagaatccccaggaaacggttcatttaccgggaacgagttcactttggacagtaaagtggtctatgaatgtcatgagggcttcaagcttgaatccagccagcaagcaacagccgtgtgtcaagaagatgggttgtggagtaacaaggggaagccgcccacgtgtaagccggtcgcttgccccagcattgaagctcagctctcagaacatgtcatctggaggctggtttcaggatccttgaatgagtacggtgctcaagtattgctgagctgcagtcctggttactacttagaaggctggaggctcctgcggtgccaggccaatgggacgtggaacataggagatgagaggccaagctgtcgagttatctcgtgtggaagcctttcctttcccccaaatggcaacaagattggaacgttgacagtttatggggccacagctatatttacgtgcaacaccggctacacgcttgtggggtctcatgtcagagagtgcttggcaaatgggctctggagcggcagcgaaactcgatgtctggctggccactgcggttccccagacccgattgtgaacggtcacattagtggagatggcttcagttacagagacacggtggtttaccagtgcaatcctggtttccggcttgtgggaacttccgtgaggatatgcctgcaagaccacaagtggtctggacaaacgcctgtctgtgtccccatcacatgtggtcaccctggaaaccctgcccacggattcactaatggcagtgagttcaacctgaatgatgtcgtgaatttcacctgcaacacgggctatttgctgcagggcgtgtctcgagcccagtgtcggagcaacggccagtggagtagccctctgcccacgtgtcgagtggtgaactgttctgatccaggctttgtggaaaatgccattcgtcacgggcaacagaacttccctgagagttttgagtatggaatgagtatcctgtaccattgcaagaagggattttacttgctgggatcttcagccttgacctgtatggcaaatggcttatgggaccgatccctgcccaagtgtttggctatatcgtgtggacacccaggggtccctgccaacgccgtcctcactggagagctgtttacctatggcgccgtcgtgcactactcctgcagagggagcgagagcctcataggcaacgacacgagagtgtgccaggaagacagtcactggagcggggcactgccccactgcacaggaaataatcctggattctgtggtgatccggggaccccagcacatgggtctcggcttggtgatgactttaagacaaagagtcttctccgcttctcctgtgaaatggggcaccagctgaggggctcccctgaacgcacgtgtttgctcaatgggtcatggtcaggactgcagccggtgtgtgaggccgtgtcctgtggcaaccctggcacacccaccaacggaatgattgtcagtagtgatggcattctgttctccagctcggtcatctatgcctgctgggaaggctacaagacctcagggctcatgacacggcattgcacagccaatgggacctggacaggcactgctcccgactgcacaattataagttgtggggatccaggcacactagcaaatggcatccagtttgggaccgacttcaccttcaacaagactgtgagctatcagtgtaacccaggctatgtcatggaagcagtcacatccgccactattcgctgtaccaaagacggcaggtggaatccgagcaaacctgtctgcaaagccgtgctgtgtcctcagccgccgccggtgcagaatggaacagtggagggaagtgatttccgctggggctccagcataagttacagctgcatggacggttaccagctctctcactccgccatcctctcctgtgaaggtcgcggggtgtggaaaggagagatcccccagtgtctccctgtgttctgcggagaccctggcatccccgcagaagggcgacttagtgggaaaagtttcacctataagtccgaagtcttcttccagtgcaaatctccatttatactcgtgggatcctccagaagagtctgccaagctgacggcacgtggagcggcatacaacccacctgcattgatcctgctcataacacctgcccagaccctggtacgccacactttggaatacagaatagctccagaggctatgaggttggaagcacggtttttttcaggtgcagaaaaggctaccatattcaaggttccacgactcgcacctgccttgccaatttaacatggagtgggatacagaccgaatgtatacctcatgcctgcagacagccagaaaccccggcacacgcggatgtgagagccatcgatcttcctactttcggctacaccttagtgtacacctgccatccaggctttttcctcgcagggggatctgagcacagaacatgtaaagcagacatgaaatggacaggaaagtcgcctgtgtgtaaaagtaaaggagtgagagaagttaatgaaacagttactaaaactccagttccttcagatgtctttttcgtcaattcactgtggaaggggtattatgaatatttagggaaaagacaacccgccactctaactgttgactggttcaatgcaacaagcagtaaggtgaatgccaccttcagcgaagcctcgccagtggagctgaagttgacaggcatttacaagaaggaggaggcccacttactcctgaaagcttttcaaattaaaggccaggcagatatttttgtaagcaagttcgaaaatgacaactggggactagatggttatgtgtcatctggacttgaaagaggaggatttacttttcaaggtgacattcatggaaaagactttggaaaatttaagctagaaaggcaagatcctttaaacccagatcaagactcttccagtcattaccacggcaccagcagtggctctgtggcggctgccattctggttcctttctttgctctaattttatcagggtttgcattttacctctacaaacacagaacgagaccaaaagttcaatacaatggctatgctgggcatgaaaacagcaatggacaagcatcgtttgaaaaccccatgtatgatacaaacttaaaacccacagaagccaaggctgtgaggtttgacacaactctgaacacagtctgtacagtggtatag

SEQ ID NO: 11519 - DNA, 777 bp, synthetic construct
  misc_feature 1..777: note = Synthetic polypeptide
  source 1..777: mol_type = other DNA
ggccgggtgcggtggctcatgcctgtaaagccagcactttgggaggctgaggcgggcggatcacgaggcaccacagtaccggcactgctgaacagtacttccaaccaactctacctgcatttccagtctgacattagtgtggcagctgctggtttccacctggaatacaaaactgtaggtcttgctgcatgccaagaaccagccctccccagcaacagcatcaaaatcggagatcggtacatggtgaacgacgtgctctccttccagtgcgagcccgggtacaccctgcagggccgttcccacatttcctgtatgccagggaccgttcgccgttggaactatccgtctcccctgtgcattgcaacctgtggagggacgctgagcaccttgggtggtgtgatcctgagccccggcttcccaggttcttaccccaacaacttagactgcacctggaggatctcattacccatcggctatggtgcacatattcagtttctgaatttttctaccgaagctaatcatgacttccttgaaattcaaaatggaccttaccacaccagccccatgattggacaatttagcggcacggatctccccgcggccctgctgagcacaacgcatgaaaccctcatccacttttatagtgaccattcgcaaaaccggcaaggatttaaacttgcttaccaaggaggatctggaaacattggtcctgctttcccatgtcttgacaccccattccaagccagatgtcaaggagaagaaaggactttcaattaa

SEQ ID NO: 11520 - DNA, 1129 bp, synthetic construct
  misc_feature 1..1129: note = Synthetic polypeptide
  source 1..1129: mol_type = other DNA
cagttgacccttgaacaacacagatttgaactccatgggcccacttatacatctattttttttccatagatatattgaaaatttttttgaagatttgtgacagtttgaaaaaacagatgaaccacatggcctagaaatatcaaaaacattaagaaaaagttagatatgtcgtgaacgcataaaatatatgtagatagatactagtttataaatatgcacaaatctgttataaagagttaaaatttatcaaagtttacaaatatttatagaccatacatggcaccatttacagttgagagaaatgtaaagaaatgtaaagatgcattaaatcataatggcataaaattaactctagtaatactgtactactgtaataattttgtggccacctgttgctattgcagtgaactcaagtgttacaagtattgagcataaaatgtcatgtgacactaatcatctttgtgtgagtggttcatctctttagtaaattgtgtatcatagtaaaaattgatctcttggaattctcttgtatttttttatcatgtttagtgcaataccataaaccttgaatgacaccatgggacccatacaaagtgccactagtgatgctggaagtgctcctaagaagctgagaaaagtcatgacattacaagaaaaagttgaattgcctgatacataccatggattgaggtctgcggctgcgtttgccctccatttcaagataaacaaatccaatgcggcaaagatctgcaacaacatgctgttagctattagtatgattggaactgctgaagctatgaatcttggaatcaggttagggcttgacccaaaactactggctaaaatcctaaatatgagctcaggacggtgttggtcaagtgacacttataatcctgtacctggagtgatggatggcgttccctcggctaataactatcagggtggatttggaacaacactcatggctaaggatctgggattggcacaagactctgctaccagcacaaagagcccaatccttcttggcagtctggcccatcagatctacaggatgatgtgtgcaaagggctactcaaagaaagacttctcatccgtgttccagttcctacgagaggaggagaccttctga

SEQ ID NO: 11521 - DNA, 908 bp, synthetic construct
  misc_feature 1..908: note = Synthetic polypeptide
  source 1..908: mol_type = other DNA
cagttgacccttgaacaacacagatttgaactccatgggcccacttatacatctattttttttccatagatatattgaaaatttttttgaagatttgtgacagtttgaaaaaacagatgaaccacatggcctagaaatatcaaaaacattaagaaaaagttagatatgtcgtgaacgcataaaatatatgtagatagatactagtttataaatatgcacaaatctgttataaagagttaaaatttatcaaagtttacaaatatttatagaccatacatggcaccatttacagttgagagaaatgtaaagaaatgtaaagatgcattaaatcataatggcataaaattaactctagtaatactgtactactgtaataattttgtggccacctgttgctattgcagtgaactcaagtgttacaagtattgagcataaaatgtcatgtgacactaatcatctttgtgtgagtggttcatctctttagtaaattgtgtatcatagtaaaaattgatctcttggaattctcttgtatttttttatcatgtttagtgcaataccataaaccttgaatgacaccatgggacccatacaaagtgccactagtgatgctggaagtgctcctaagaagctgagaaaagtcatgacattacaagaaaaagttgaattgcctgatacataccatggattgaggtctgcggctgcgtttgccctccatttcaagataaacaaatccaatgcggcaaagatctgcaacaacatgctgttagctattagtatgattggaactgctgaagctatgaatcttggaatcaggttagggcttgacccaaaactactggctaaaatcctaaatatgagctcaggacggtgttggtcaagtgacacttataatcctgtacctggagtga

SEQ ID NO: 11522 - DNA, 1204 bp, synthetic construct
  misc_feature 1..1204: note = Synthetic polypeptide
  source 1..1204: mol_type = other DNA
agacttccccctttcagagcggcagacgctggcatacacaggtcctgggcatcgccgtcaaggctgcccgccaggcagcttccacaaatcccaaaatgagcctttccttcttccttctaaaacagcatctccaccttctgtattatttatttcagtgaatgcctgaatctcaaacttgtacttcatcatggactccagtcttcctttcacatccaatttcaatgatcatcaatacagtcattttgctccttagcccactcggactatttctctccatacctgctgcaactgccttgacactggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaa

SEQ ID NO: 11523 - DNA, 652 bp, synthetic construct
  misc_feature 1..652: note = Synthetic polypeptide
  source 1..652: mol_type = other DNA
agacttccccctttcagagcggcagacgctggcatacacaggtcctgggcatcgccgtcaaggctgcccgccaggcagcttccacaaatcccaaaatgagcctttccttcttccttctaaaacagcatctccaccttctgtattatttatttcagtgaatgcctgaatctcaaacttgtacttcatcatggactccagtcttcctttcacatccaatttcaatgatcatcaatacagtcattttgctccttagcccactcggactatttctctccatacctgctgcaactgccttgacactggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctga

SEQ ID NO: 11524 - DNA, 468 bp, synthetic construct
  misc_feature 1..468: note = Synthetic polypeptide
  source 1..468: mol_type = other DNA
agacttccccctttcagagcggcagacgctggcatacacaggtcctgggcatcgccgtcaaggctgcccgccaggcagcttccacaaatcccaaaatgagcctttccttcttccttctaaaacagcatctccaccttctgtattatttatttcagtgaatgcctgaatctcaaacttgtacttcatcatggactccagtcttcctttcacatccaatttcaatgatcatcaatacagtcattttgctccttagcccactcggactatttctctccatacctgctgcaactgccttgacactggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaa

SEQ ID NO: 11525 - DNA, 745 bp, synthetic construct
  misc_feature 1..745: note = Synthetic polypeptide
  source 1..745: mol_type = other DNA
agacttccccctttcagagcggcagacgctggcatacacaggtcctgggcatcgccgtcaaggctgcccgccaggcagcttccacaaatcccaaaatgagcctttccttcttccttctaaaacagcatctccaccttctgtattatttatttcagtgaatgcctgaatctcaaacttgtacttcatcatggactccagtcttcctttcacatccaatttcaatgatcatcaatacagtcattttgctccttagcccactcggactatttctctccatacctgctgcaactgccttgacactggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaagatctttgataccatactttaatctgtatcttcagtttctgaacataagtatgcaaaatctttttaaggtgcatactctgctgcgtccctgctattttctaggacaaaaataa

SEQ ID NO: 11526 - DNA, 1240 bp, synthetic construct
  misc_feature 1..1240: note = Synthetic polypeptide
  source 1..1240: mol_type = other DNA
agacttccccctttcagagcggcagacgctggcatacacaggtcctgggcatcgccgtcaaggctgcccgccaggcagcttccacaaatcccaaaatgagcctttccttcttccttctaaaacagcatctccaccttctgtattatttatttcagtgaatgcctgaatctcaaacttgtacttcatcatggactccagtcttcctttcacatccaatttcaatgatcatcaatacagtcattttgctccttagcccactcggactatttctctccatacctgctgcaactgccttgacactggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggctggtagcaagttctggatcttatacccaacacacagcaacatccagaaataa

SEQ ID NO: 11527 - DNA, 1159 bp, synthetic construct
  misc_feature 1..1159: note = Synthetic polypeptide
  source 1..1159: mol_type = other DNA
agacttccccctttcagagcggcagacgctggcatacacaggtcctgggcatcgccgtcaaggctgcccgccaggcagcttccacaaatcccaaaatgagcctttccttcttccttctaaaacagcatctccaccttctgtattatttatttcagtgaatgcctgaatctcaaacttgtacttcatcatggactccagtcttcctttcacatccaatttcaatgatcatcaatacagtcattttgctccttagcccactcggactatttctctccatacctgctgcaactgccttgacactggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatgaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaa

SEQ ID NO: 11528 - DNA, 922 bp, synthetic construct
  misc_feature 1..922: note = Synthetic polypeptide
  source 1..922: mol_type = other DNA
agacttccccctttcagagcggcagacgctggcatacacaggtcctgggcatcgccgtcaaggctgcccgccaggcagcttccacaaatcccaaaatgagcctttccttcttccttctaaaacagcatctccaccttctgtattatttatttcagtgaatgcctgaatctcaaacttgtacttcatcatggactccagtcttcctttcacatccaatttcaatgatcatcaatacagtcattttgctccttagcccactcggactatttctctccatacctgctgcaactgccttgacactggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggtctgggagaactgatcttgctgaaaatacaacaggaagcagtatcgtgccaggcaaggcaaaccctcgtcagtgtgaagcaatggccatcgttgcagcccaagtcatggggttttgtgtggcagtaa

SEQ ID NO: 11529 - DNA, 838 bp, synthetic construct
  misc_feature 1..838: note = Synthetic polypeptide
  source 1..838: mol_type = other DNA
agacttccccctttcagagcggcagacgctggcatacacaggtcctgggcatcgccgtcaaggctgcccgccaggcagcttccacaaatcccaaaatgagcctttccttcttccttctaaaacagcatctccaccttctgtattatttatttcagtgaatgcctgaatctcaaacttgtacttcatcatggactccagtcttcctttcacatccaatttcaatgatcatcaatacagtcattttgctccttagcccactcggactatttctctccatacctgctgcaactgccttgacactggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggctgctgggggatgcttcagtttccttcacagaaaactaaatag

SEQ ID NO: 11530 - DNA, 901 bp, synthetic construct
  misc_feature 1..901: note = Synthetic polypeptide
  source 1..901: mol_type = other DNA
agacttccccctttcagagcggcagacgctggcatacacaggtcctgggcatcgccgtcaaggctgcccgccaggcagcttccacaaatcccaaaatgagcctttccttcttccttctaaaacagcatctccaccttctgtattatttatttcagtgaatgcctgaatctcaaacttgtacttcatcatggactccagtcttcctttcacatccaatttcaatgatcatcaatacagtcattttgctccttagcccactcggactatttctctccatacctgctgcaactgccttgacactggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggtctgggagaactgatcttgctgaaaatacaacaggaagcagtatcgtgccaggcaaggcaaaccctcgtcagtgtgaagcaatggccatcgttgcagcccaagtcatggggttttgtgtggcagtaaccgttggaggcggcaatggccattttgagttggatgttttcaagccaatgatgattaaaaatttatgttacactcaggctgctgggggatgcttcagtttccttcacagaaaactaaatagtgggaatccggaccaataa

SEQ ID NO: 11531 - DNA, 191 bp, synthetic construct
  misc_feature 1..191: note = Synthetic polypeptide
  source 1..191: mol_type = other DNA
agtgtggaccctggacaagaagcataggttgatatcacttgcaagtttattaccaatgccaactcaggcttcactcgagacctgctaattcagaatcagtatttgaataaggtcccaggggagagtacggtttccatgaatatacagaggtcaaaacagtcacagtgaaaatctctcagaagaactcataa

SEQ ID NO: 11532 - DNA, 1248 bp, synthetic construct
  misc_feature 1..1248: note = Synthetic polypeptide
  source 1..1248: mol_type = other DNA
tatttactccccgatgtttaaaataggactttgaagcaagacaataagcttaaaagccaagctgtttagggtagagaattttctaaattccttttcttttttttcttaaaggctgaagaagactcagatttctgacacaatggtaacacctatcccttctgcctgtgactgccagggcttgctgtatgatgataagaagagaatgtgacacagaggaaggggaaaaagtccatccctctgatggtggctgcaggaatctgtcgttcagatgagcatgtggttagtggcaacctggtgaccccccttcctgtgattttaggccatgaggcagccggcatcgtggaaagtgtttgagaaggggtgactacagtcaaaccaggtgataaagtcatcccgctctttactcctcagtgtggaaaatgcagaatttgtaaaaacccagaaagcaactactgcttgaaaaatgatctaggcaatcctcgggggaccctgcaggatggcaccaggaggttcacctgcagcgggaagcccatccaccacttcgtcggcgtcagcaccttctcccagtacacagtggtggatgagaatgcagtggccaaaattgatgcagcctcgcccctggagaaagtctgcctcattggctgtggattttcgactggttatgggtctgcagtcaaagttgccaaggtcaccccagggtctacctgtgctgtgtttggcctgggaggggtcggcctatctgttgttatgggctgtaaagcagctggagcagccagaatcattgctgtggacatcaacaaggacaaatttgcaaaggctaaagagttgggtgccactgaatgcatcaaccctcaagactacaagaaacccattcaggaagtgctaaaggaaatgactgatggaggtgtggatttttcgtttgaagtcatcggtcggcttgacaccatgatggcttccctgttatgttgtcatgaggcatgtggcacaagtgtcattgtaggggtacctcctgattcccagaacctctcaataaaccctatgctgctactgactggacgcacgtggaaaggagctatttttggaggctttaagagtaaagaatctgtccccaaacttgtggctgactttatggctaagaagttttcactggatgcattaataacaaatattttaccttttgaaaaaataaatgaaggatttgacctgcttcgctctggaaagagtatccgtaccgtcctgacgttttga

SEQ ID NO: 11533 - DNA, 3050 bp, synthetic construct; identical to SEQ ID NO: 7595
  misc_feature 1..3050: note = Synthetic polypeptide
  source 1..3050: mol_type = other DNA

SEQ ID NO: 11534 - DNA, 2267 bp, synthetic construct; identical to SEQ ID NO: 7596
  misc_feature 1..2267: note = Synthetic polypeptide
  source 1..2267: mol_type = other DNA

SEQ ID NO: 11535 - DNA, 2288 bp, synthetic construct; identical to SEQ ID NO: 7597
  misc_feature 1..2288: note = Synthetic polypeptide
  source 1..2288: mol_type = other DNA

SEQ ID NO: 11536 - DNA, 974 bp, synthetic construct
  misc_feature 1..974: note = Synthetic polypeptide
  source 1..974: mol_type = other DNA
caaaaagcttggattctgtcctagtgcttttgactccgttttggtgactctaagcaagttgtgttactctctccgtgctttgatttcttcagtggtaaaggtcagatgacttgtctgcaaagctgtgggatgtgagcacagggcagtgcgtttatggcatccagacccacacttgtgcagcggtgaagtttgatgaacagaagcttgtgacaggctcctttgacaacactgtggcttgctgggaatggagttccggagccaggacccagcactttcgggggcacacgggggcggtatttagcgtggactacaatgatgaactggatatcttggtgagcggctctgcagacttcactgtgaaagtatgggctttatctgctgggacatgcctgaacacactcaccgggcacacggaatgggtcaccaaggtagttttgcagaagtgcaaagtcaagtctctcttgcacagtcctggagactacatcctcttaagtgcagacaaatatgagattaagatttggccaattgggagagaaatcaactgtaagtgcttaaagacattgtctgtctctgaggatagaagtatctgcctgcagccaagacttcattttgatggcaaatacattgtctgtagttcagcacttggtctctaccagtgggactttgccagttatgatattctcagggtcatcaagactcctgagatagcaaacttggccttgcttggctttggagatatctttgccctgctgtttgacaaccgctacctgtacatcatggacttgcggacagagagcctgattagtcgctggcctctgccagagtacaggaaatcaaagagaggctcaagcttcctggcaggcgaagcatcctggctgaatggactggatgggcacaatgacacgggcttggtctttgccaccagcatgcctgaccacagtattcacctggtgttgtggaaggagcacggctga

SEQ ID NO: 11537 - DNA, 622 bp, synthetic construct
  misc_feature 1..622: note = Synthetic polypeptide
  source 1..622: mol_type = other DNA
caaaaagcttggattctgtcctagtgcttttgactccgttttggtgactctaagcaagttgtgttactctctccgtgctttgatttcttcagtggtaaaggtcagatgacttgtctgcaaagctgtgggatgtgagcacagggcagtgcgtttatggcatccagacccacacttgtgcagcggtgaagtttgatgaacagaagcttgtgacaggctcctttgacaacactgtggcttgctgggaatggagttccggagccaggacccagcactttcgggggcacacgggggcggtatttagcgtggactacaatgatgaactggatatcttggtgagcggctctgcagacttcactgtgaaagtatgggctttatctgctgggacatgcctgaacacactcaccgggcacacggaatgggtcaccaaggtagttttgcagaagtgcaaagtcaagtctctcttgcacagtcctggagactacatcctcttaagtgcagacaaatatgagattaagatttggccaattgggagagaaatcaactgtaagtgcttaaagacattgtctgtctctgaggatagaagtatctgcctgcagccaagacttcattttgatggcaaata

SEQ ID NO: 11538 - DNA, 902 bp, synthetic construct
  misc_feature 1..902: note = Synthetic polypeptide
  source 1..902: mol_type = other DNA
agcctacagattcagagtgtgcgttccagagccaggctctccagaaagcacgggaacggggcgccaaaatcatgcgggagccctgggtagagcaagacaagtttgggaaggtgaagtttgctgtgctgcagacgtatggggacaccacacacaccctggtggagaagatgaactacatcggccaattcttgcctggatatgaggccccagcgttcatggaccccctacttcctaaactgcccaaatgcagtctggagatgatcgaccacattgtgggaaaccagcctgatcaggagatggtgtccgcctccgaatggtacctgaaaaacctgcagttccaccgcttctggtccgtggatgacacgcaggtgcacacggaatatagctctctgcgatccattgtggtggccaactatgaagagtccatcaagatgcccatcaatgagccagcgcctggcaagaagaagtcccagatccaggaatatgtggactataacgggggcgctggggtccagcacatcgctctcaagaccgaagacatcatcacagcgattcgccacttgagagagagaggcctggagttcttatctgttccctccacgtactacaaacaactgcgggagaagctgaagacggccaagatcaaggtgaaggagaacattgatgccctggaggagctgaaaatcctggtggactacgacgagaaaggctacctcctgcagatcttcaccaaaccggtgcaggaccggcccacgctcttcctggaagtcatccagcgccacaaccaccagggttttggagccggcaacttcaactcactgttcaaggctttcgaggaggagcagaacctgcggggtaacctcaccaacatggagaccaatggggtggtgcccggcatgtaa

SEQ ID NO: 11539 - DNA, 333 bp, synthetic construct; identical to SEQ ID NO: 6583
  misc_feature 1..333: note = Synthetic polypeptide
  source 1..333: mol_type = other DNA

SEQ ID NO: 11540 - DNA, 1392 bp, synthetic construct; identical to SEQ ID NO: 806
  misc_feature 1..1392: note = Synthetic polypeptide
  source 1..1392: mol_type = other DNA

SEQ ID NO: 11541 - DNA, 1191 bp, synthetic construct; identical to SEQ ID NO: 807
  misc_feature 1..1191: note = Synthetic polypeptide
  source 1..1191: mol_type = other DNA

SEQ ID NO: 11542 - DNA, 412 bp, synthetic construct; identical to SEQ ID NO: 809
  misc_feature 1..412: note = Synthetic polypeptide
  source 1..412: mol_type = other DNA

SEQ ID NO: 11543 - DNA, 366 bp, synthetic construct; identical to SEQ ID NO: 810
  misc_feature 1..366: note = Synthetic polypeptide
  source 1..366: mol_type = other DNA

SEQ ID NO: 11544 - DNA, 297 bp, synthetic construct; identical to SEQ ID NO: 811
  misc_feature 1..297: note = Synthetic polypeptide
  source 1..297: mol_type = other DNA

SEQ ID NO: 11545 - DNA, 161 bp, synthetic construct; identical to SEQ ID NO: 812
  misc_feature 1..161: note = Synthetic polypeptide
  source 1..161: mol_type = other DNA

SEQ ID NO: 11546 - DNA, 1460 bp, synthetic construct
  misc_feature 1..1460: note = Synthetic polypeptide
  source 1..1460: mol_type = other DNA
tgcctgtcagaatgcatcctggaataggaccagaatcttccatttaccgcctctatggccaccacccatcatcacctgtctggatctgtgcagtcacccctgccctggcctccctccctcgttccctagagcagccagaggtcactgtgaacacccaaactctcttccagaacccagaagagggctggcagctgtacacctcagcccaggcccctgacgggaaatgcatctgcacggccgtgatcccagcgcagagtacctgctctcgagatggcaggagtcgggagctgcggcaactgatggagaaggtccagaacgtctcccagtccatggaggtccttgagttgcggacgtatcgcgacctccagtatgtacgcggcatggagaccctcatgcggagcctggatgcgcggctccgggcagctgatgggtccctctcggccaagagcttccaggagctgaaggacaggatgacggaactgttgcccctgagctcggtcctggagcagtacaaggcagacacgcggaccattgtacgcttgcgggaggaggtgaggaatctctccggcagtctggcggccattcaggaggagatgggtgcctacgggtatgaggacctgcagcaacgggtgatggccctggaggcccggctccacgcctgcgcccagaagctgggctgtgggaagctgaccggggtcagtaaccccatcaccgttcgggccatggggtcccgcttcggctcctggatgactgacacgatggcccccagtgcggatagccgggtctggtacatggatggctattacaaaggccgccgggtcctggagttccgtaccctgggagacttcatcaaaggccagaactttatccagcacctgctgccccagccgtgggcgggcacgggccacgtggtgtacaacggctccctgttctataacaagtaccagagcaacgtggtggtcaaataccacttccgctcgcgctctgtgctggtgcagaggagcctcccgggcgccggttacaacaacaccttcccctactcctggggcggcttctccgacatggacttcatggtggacgagagcgggctctgggctgtgtacaccaccaaccagaacgcgggcaacatcgtggtcagccggctggacccgcacaccctcgaggtcatgcggtcctgggacaccggctaccccaagcgcagcgctggcgaggccttcatgatctgcggtgtgctctacgtgaccaactcccacctggctggggccaaggtctacttcgcctattttaccaacacgtccagttacgagtacacggacgtgcccttccacaaccagtattcccacatctcgatgctggattacaacccccgggagcgcgccctctatacctggaacaacggccaccaggtgctctacaatgtcaccctgtttcacgtcatcagcacctctggggacccctga

SEQ ID NO: 11547 - DNA, 1030 bp, synthetic construct
  misc_feature 1..1030: note = Synthetic polypeptide
  source 1..1030: mol_type = other DNA
tgcctgtcagaatgcatcctggaataggaccagaatcttccatttaccgcctctatggccaccacccatcatcacctgtctggatctgtgcagtcacccctgccctggcctccctccctcgttccctagagcagccagaggtcactgtgaacacccaaactctcttccagaacccagaagagggctggcagctgtacacctcagcccaggcccctgacgggaaatgcatctgcacggccgtgatcccagcgcagagtacctgctctcgagatggcaggagtcgggagctgcggcaactgatggagaaggtccagaacgtctcccagtccatggaggtccttgagttgcggacgtatcgcgacctccagtatgtacgcggcatggagaccctcatgcggagcctggatgcgcggctccgggcagctgatgggtccctctcggccaagagcttccaggagctgaaggacaggatgacggaactgttgcccctgagctcggtcctggagcagtacaaggcagacacgcggaccattgtacgcttgcgggaggaggtgaggaatctctccggcagtctggcggccattcaggaggagatgggtgcctacgggtatgaggacctgcagcaacgggtgatggccctggaggcccggctccacgcctgcgcccagaagctgggctgtgggaagctgaccggggtcagtaaccccatcaccgttcgggccatggggtcccgcttcggctcctggatgactgacacgatggcccccagtgcggatagccgggtctggtacatggatggctattacaaaggccgccgggtcctggagttccgtaccctgggagacttcatcaaaggccagaactttatccagcacctgctgccccagccgtgggcgggcacgggccacgtggtgtacaacggctccctgttctataacaagtaccagagcaacgtggtggtcaaataccacttccgctcgcgctctgtgctggtgcagaggagcctcccgggcgccggttacaacaacac

SEQ ID NO: 11548 - DNA, 382 bp, synthetic construct; identical to SEQ ID NO: 434
  misc_feature 1..382: note = Synthetic polypeptide
  source 1..382: mol_type = other DNA

SEQ ID NO: 11549 - DNA, 1148 bp, synthetic construct; identical to SEQ ID NO: 436
  misc_feature 1..1148: note = Synthetic polypeptide
  source 1..1148: mol_type = other DNA

SEQ ID NO: 11550 - DNA, 871 bp, synthetic construct; identical to SEQ ID NO: 437
  misc_feature 1..871: note = Synthetic polypeptide
  source 1..871: mol_type = other DNA

SEQ ID NO: 11551 - DNA, 421 bp, synthetic construct; identical to SEQ ID NO: 441
  misc_feature 1..421: note = Synthetic polypeptide
  source 1..421: mol_type = other DNA

SEQ ID NO: 11552 - DNA, 638 bp, synthetic construct; identical to SEQ ID NO: 442
  misc_feature 1..638: note = Synthetic polypeptide
  source 1..638: mol_type = other DNA

SEQ ID NO: 11553 - DNA, 337 bp, synthetic construct; identical to SEQ ID NO: 443
  misc_feature 1..337: note = Synthetic polypeptide
  source 1..337: mol_type = other DNA

SEQ ID NO: 11554 - DNA, 1086 bp, synthetic construct; identical to SEQ ID NO: 444
  misc_feature 1..1086: note = Synthetic polypeptide
  source 1..1086: mol_type = other DNA

SEQ ID NO: 11555 - DNA, 564 bp, synthetic construct; identical to SEQ ID NO: 445
  misc_feature 1..564: note = Synthetic polypeptide
  source 1..564: mol_type = other DNA

SEQ ID NO: 11556 - DNA, 987 bp, synthetic construct; identical to SEQ ID NO: 446
  misc_feature 1..987: note = Synthetic polypeptide
  source 1..987: mol_type = other DNA

SEQ ID NO: 11557 - DNA, 1052 bp, synthetic construct; identical to SEQ ID NO: 447
  misc_feature 1..1052: note = Synthetic polypeptide
  source 1..1052: mol_type = other DNA

SEQ ID NO: 11558 - DNA, 1118 bp, synthetic construct; identical to SEQ ID NO: 448
  misc_feature 1..1118: note = Synthetic polypeptide
  source 1..1118: mol_type = other DNA

SEQ ID NO: 11559 - DNA, 3021 bp, synthetic construct; identical to SEQ ID NO: 449
  misc_feature 1..3021: note = Synthetic polypeptide
  source 1..3021: mol_type = other DNA

SEQ ID NO: 11560 - DNA, 3075 bp, synthetic construct; identical to SEQ ID NO: 450
  misc_feature 1..3075: note = Synthetic polypeptide
  source 1..3075: mol_type = other DNA

SEQ ID NO: 11561 - DNA, 1143 bp, synthetic construct; identical to SEQ ID NO: 451
  misc_feature 1..1143: note = Synthetic polypeptide
  source 1..1143: mol_type = other DNA

SEQ ID NO: 11562 - DNA, 347 bp, synthetic construct; identical to SEQ ID NO: 452
  misc_feature 1..347: note = Synthetic polypeptide
  source 1..347: mol_type = other DNA

SEQ ID NO: 11563 - DNA, 148 bp, synthetic construct; identical to SEQ ID NO: 454
  misc_feature 1..148: note = Synthetic polypeptide
  source 1..148: mol_type = other DNA

SEQ ID NO: 11564 - DNA, 594 bp, synthetic construct; identical to SEQ ID NO: 455
  misc_feature 1..594: note = Synthetic polypeptide
  source 1..594: mol_type = other DNA

SEQ ID NO: 11565 - DNA, 1031 bp, synthetic construct; identical to SEQ ID NO: 456
  misc_feature 1..1031: note = Synthetic polypeptide
  source 1..1031: mol_type = other DNA

SEQ ID NO: 11566 - DNA, 1267 bp, synthetic construct; identical to SEQ ID NO: 463
  misc_feature 1..1267: note = Synthetic polypeptide
  source 1..1267: mol_type = other DNA

SEQ ID NO: 11567 - DNA, 7329 bp, synthetic construct; identical to SEQ ID NO: 464
  misc_feature 1..7329: note = Synthetic polypeptide
  source 1..7329: mol_type = other DNA

SEQ ID NO: 11568 - DNA, 7320 bp, synthetic construct; identical to SEQ ID NO: 465
  misc_feature 1..7320: note = Synthetic polypeptide
  source 1..7320: mol_type = other DNA

SEQ ID NO: 11569 - DNA, 201 bp, synthetic construct; identical to SEQ ID NO: 466
  misc_feature 1..201: note = Synthetic polypeptide
  source 1..201: mol_type = other DNA

SEQ ID NO: 11570 - DNA, 165 bp, synthetic construct; identical to SEQ ID NO: 467
  misc_feature 1..165: note = Synthetic polypeptide
  source 1..165: mol_type = other DNA

SEQ ID NO: 11571 - DNA, 129 bp, synthetic construct; identical to SEQ ID NO: 468
  misc_feature 1..129: note = Synthetic polypeptide
  source 1..129: mol_type = other DNA

SEQ ID NO: 11572 - DNA, 201 bp, synthetic construct; identical to SEQ ID NO: 469
  misc_feature 1..201: note = Synthetic polypeptide
  source 1..201: mol_type = other DNA

SEQ ID NO: 11573 - DNA, 270 bp, synthetic construct; identical to SEQ ID NO: 470
  misc_feature 1..270: note = Synthetic polypeptide
  source 1..270: mol_type = other DNA

SEQ ID NO: 11574 - DNA, 1104 bp, synthetic construct; identical to SEQ ID NO: 472
  misc_feature 1..1104: note = Synthetic polypeptide
  source 1..1104: mol_type = other DNA

SEQ ID NO: 11575 - DNA, 7356 bp, synthetic construct; identical to SEQ ID NO: 473
  misc_feature 1..7356: note = Synthetic polypeptide
  source 1..7356: mol_type = other DNA

SEQ ID NO: 11576 - DNA, 246 bp, synthetic construct; identical to SEQ ID NO: 474
  misc_feature 1..246: note = Synthetic polypeptide
  source 1..246: mol_type = other DNA

SEQ ID NO: 11577 - DNA, 1201 bp, synthetic construct; identical to SEQ ID NO: 475
  misc_feature 1..1201: note = Synthetic polypeptide
  source 1..1201: mol_type = other DNA

SEQ ID NO: 11578 - DNA, 247 bp, synthetic construct; identical to SEQ ID NO: 476
  misc_feature 1..247: note = Synthetic polypeptide
  source 1..247: mol_type = other DNA

SEQ ID NO: 11579 - DNA, 874 bp, synthetic construct; identical to SEQ ID NO: 477
  misc_feature 1..874: note = Synthetic polypeptide
  source 1..874: mol_type = other DNA

SEQ ID NO: 11580 - DNA, 364 bp, synthetic construct; identical to SEQ ID NO: 478
  misc_feature 1..364: note = Synthetic polypeptide
  source 1..364: mol_type = other DNA

SEQ ID NO: 11581 - DNA, 424 bp, synthetic construct; identical to SEQ ID NO: 479
  misc_feature 1..424: note = Synthetic polypeptide
  source 1..424: mol_type = other DNA

SEQ ID NO: 11582 - DNA, 163 bp, synthetic construct; identical to SEQ ID NO: 480
  misc_feature 1..163: note = Synthetic polypeptide
  source 1..163: mol_type = other DNA

SEQ ID NO: 11583 - DNA, 104 bp, synthetic construct; identical to SEQ ID NO: 481
  misc_feature 1..104: note = Synthetic polypeptide
  source 1..104: mol_type = other DNA

SEQ ID NO: 11584 - DNA, 769 bp, synthetic construct; identical to SEQ ID NO: 6486
  misc_feature 1..769: note = Synthetic polypeptide
  source 1..769: mol_type = other DNA

SEQ ID NO: 11585 - DNA, 721 bp, synthetic construct; identical to SEQ ID NO: 482
  misc_feature 1..721: note = Synthetic polypeptide
  source 1..721: mol_type = other DNA

SEQ ID NO: 11586 - DNA, 522 bp, synthetic construct; identical to SEQ ID NO: 484
  misc_feature 1..522: note = Synthetic polypeptide
  source 1..522: mol_type = other DNA

SEQ ID NO: 11587 - DNA, 299 bp, synthetic construct; identical to SEQ ID NO: 485
  misc_feature 1..299: note = Synthetic polypeptide
  source 1..299: mol_type = other DNA

SEQ ID NO: 11588 - DNA, 213 bp, synthetic construct; identical to SEQ ID NO: 7877
  misc_feature 1..213: note = Synthetic polypeptide
  source 1..213: mol_type = other DNA

SEQ ID NO: 11589 - DNA, 239 bp, synthetic construct; identical to SEQ ID NO: 487
  misc_feature 1..239: note = Synthetic polypeptide
  source 1..239: mol_type = other DNA

SEQ ID NO: 11590 - DNA, 373 bp, synthetic construct
  misc_feature 1..373: note = Synthetic polypeptide
  source 1..373: mol_type = other DNA
ggccagttgcagtggctgacacctgtccccagtactttgggaggccgaggagggagaatcacttgagcccagcggttcgagaccagctctgtgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtatgatcttagctttgataaatgactga

SEQ ID NO: 11591 - DNA, 226 bp, synthetic construct
  misc_feature 1..226: note = Synthetic polypeptide
  source 1..226: mol_type = other DNA
ggccagttgcagtggctgacacctgtccccagtactttgggaggccgaggagggagaatcacttgagcccagcggttcgagaccagctctgtgggtaattccagaattgattggccataccattgtcactgtattactgctcatgtcattgcactggttcatcttccttctcaacttacctgttgccacttggaatatatatcgtggtagcaactgcccttgctaa

SEQ ID NO: 11592 - DNA, 232 bp, synthetic construct
  misc_feature 1..232: note = Synthetic polypeptide
  source 1..232: mol_type = other DNA
ggccagttgcagtggctgacacctgtccccagtactttgggaggccgaggagggagaatcacttgagcccagcggttcgagaccagctctgtgggtaattccagaattgattggccataccattgtcactgtattactgctcatgtcattgcactggttcatcttccttctcaacttacctgttgccacttggaatatatatcgtatgatcttagctttgataaatgactga

SEQ ID NO: 11593 - DNA, 367 bp, synthetic construct
  misc_feature 1..367: note = Synthetic polypeptide
  source 1..367: mol_type = other DNA
ggccagttgcagtggctgacacctgtccccagtactttgggaggccgaggagggagaatcacttgagcccagcggttcgagaccagctctgtgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtggtagcaactgcccttgctaa

SEQ ID NO: 11594 - DNA, 1481 bp, synthetic construct
  misc_feature 1..1481: note = Synthetic polypeptide
  source 1..1481: mol_type = other DNA
ctggctctgccattttgtaactcagtgagtcacttcatctctctgcttcagtttccctatcgcccatggcgctgcatggcttacatgagataatattcgcagtgcacttagatcagtgcctggcacacggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcatagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctaccctcctgaagtgtccatctccggctatgatgacaactggtacctcggccgtactgatgccaccctgagctgtgacgtccgcagcaacccagagcccacgggctatgactggagcacgacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgagaaacccccagggcctcgccccgagatgtgggcccgctggtgtggggggccgtgggggggacactgctggtgctgctgcttctggctggggggtccttggccttcatcctgctgagggtgaggaggaggaggaagagccctggaggagcaggaggaggagccagtggcgacgggggattctacgatccgaaagctcaggtgttgggaaatggggaccccgtcttctggacaccagtagtccctggtcccatggaaccagatggcaaggatgaggaggaggaggaggaggaagagaaggcagagaaaggcctcatgttgcctccacccccagcactcgaggatgacatggagtcccagctggacggctccctcatctcacggcgggcagtttatgtgtga

SEQ ID NO: 11595 - DNA, 1658 bp, synthetic construct
  misc_feature 1..1658: note = Synthetic polypeptide
  source 1..1658: mol_type = other DNA
ctggctctgccattttgtaactcagtgagtcacttcatctctctgcttcagtttccctatcgcccatggcgctgcatggcttacatgagataatattcgcagtgcacttagatcagtgcctggcacacggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcatagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctaccctcctgaagtgtccatctccggctatgatgacaactggtacctcggccgtactgatgccaccctgagctgtgacgtccgcagcaacccagagcccacgggctatgactggagcacgacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgagagacccccaacacagcaggcgcaggggccacaggcggcatcatcgggggcatcatcgccgccatcattgctactgctgtggctgccacgggcatccttatctgccggcagcagcggaaggagcagacgctgcagggggcagaggaggacgaagacctggagggacctccctcctacaagccaccaaccccaaaagcgaagctggaggcacaggagatgccctcccagctcttcactctgggggcctcggagcacagcccactcaagaccccctactttgatgctggcgcctcatgcactgagcaggaaatgcctcgataccatgagctgcccaccttggaagaacggtcaggacccttgcaccctggagccacaagcctggggtcccccatcccggtgcctccagggccacctgctgtggaagacgtttccctggatctagaggatgaggagggggaggaggaggaagagtatctggacaagatcaaccccatctatgatgctctgtcctatagcagcccctctgattcctaccagggcaaaggctttgtcatgtcccgggccatgtatgtgtga

SEQ ID NO: 11596 - DNA, 508 bp, synthetic construct
  misc_feature 1..508: note = Synthetic polypeptide
  source 1..508: mol_type = other DNA
ctgcccattccccaggactgttctcacatgtcacctgctcctcaaactttccttagaccctcacccagcacctcgagtaacacagttagaaggaaattcatgtgaaattttatgggagacggtaccatcaatgaaaggtgaccctgttaactacattctgcaggtattggttggaagagaatctgagtacaaacaggtgtacaagggagaagaagccacattccaaatctcaggcctccagaccaacacagactacaggttccgcgtatgtgcgtgtcgtcgctgtttagacacctctcaggagctaagcggagccttcagcccctctgcggcttttgtattacaacgaagtgaggtcatgcttacaggggacatggggagcttagatgatcccaaaatgaagagcatgatgcctactgatgaacagtttgcagccatcattgtgcttggctttgcaactttgtccattttatttgcctttatattacagtacttcttaatgaagtaa

SEQ ID NO: 11597 - DNA, 750 bp, synthetic construct; identical to SEQ ID NO: 489
  misc_feature 1..750: note = Synthetic polypeptide
  source 1..750: mol_type = other DNA

SEQ ID NO: 11598 - DNA, 38 bp, synthetic construct; identical to SEQ ID NO: 491
  misc_feature 1..38: note = Synthetic polypeptide
  source 1..38: mol_type = other DNA

SEQ ID NO: 11599 - DNA, 249 bp, synthetic construct; identical to SEQ ID NO: 492
  misc_feature 1..249: note = Synthetic polypeptide
  source 1..249: mol_type = other DNA

SEQ ID NO: 11600 - DNA, 503 bp, synthetic construct; identical to SEQ ID NO: 493
  misc_feature 1..503: note = Synthetic polypeptide
  source 1..503: mol_type = other DNA

SEQ ID NO: 11601 - DNA, 476 bp, synthetic construct; identical to SEQ ID NO: 495
  misc_feature 1..476: note = Synthetic polypeptide
  source 1..476: mol_type = other DNA

SEQ ID NO: 11602 - DNA, 539 bp, synthetic construct; identical to SEQ ID NO: 496
  misc_feature 1..539: note = Synthetic polypeptide
  source 1..539: mol_type = other DNA

SEQ ID NO: 11603 - DNA, 566 bp, synthetic construct; identical to SEQ ID NO: 500
  misc_feature 1..566: note = Synthetic polypeptide
  source 1..566: mol_type = other DNA

SEQ ID NO: 11604 - DNA, 1523 bp, synthetic construct; identical to SEQ ID NO: 501
  misc_feature 1..1523: note = Synthetic polypeptide
  source 1..1523: mol_type = other DNA

SEQ ID NO: 11605 - DNA, 1544 bp, synthetic construct; identical to SEQ ID NO: 502
  misc_feature 1..1544: note = Synthetic polypeptide
  source 1..1544: mol_type = other DNA

SEQ ID NO: 11606 - DNA, 1493 bp, synthetic construct; identical to SEQ ID NO: 504
  misc_feature 1..1493: note = Synthetic polypeptide
  source 1..1493: mol_type = other DNA

SEQ ID NO: 11607 - DNA, 602 bp, synthetic construct; identical to SEQ ID NO: 505
  misc_feature 1..602: note = Synthetic polypeptide
  source 1..602: mol_type = other DNA

SEQ ID NO: 11608 - DNA, 707 bp, synthetic construct; identical to SEQ ID NO: 506
  misc_feature 1..707: note = Synthetic polypeptide
  source 1..707: mol_type = other DNA

SEQ ID NO: 11609 - DNA, 887 bp, synthetic construct; identical to SEQ ID NO: 507
  misc_feature 1..887: note = Synthetic polypeptide
  source 1..887: mol_type = other DNA

SEQ ID NO: 11610 - DNA, 698 bp, synthetic construct; identical to SEQ ID NO: 508
  misc_feature 1..698: note = Synthetic polypeptide
  source 1..698: mol_type = other DNA

SEQ ID NO: 11611 - DNA, 1477 bp, synthetic construct; identical to SEQ ID NO: 509
  misc_feature 1..1477: note = Synthetic polypeptide
  source 1..1477: mol_type = other DNA

SEQ ID NO: 11612 - DNA, 1369 bp, synthetic construct; identical to SEQ ID NO: 510
  misc_feature 1..1369: note = Synthetic polypeptide
  source 1..1369: mol_type = other DNA

SEQ ID NO: 11613 - DNA, 709 bp, synthetic construct; identical to SEQ ID NO: 511
  misc_feature 1..709: note = Synthetic polypeptide
  source 1..709: mol_type = other DNA

SEQ ID NO: 11614 - DNA, 2850 bp, synthetic construct; identical to SEQ ID NO: 512
  misc_feature 1..2850: note = Synthetic polypeptide
  source 1..2850: mol_type = other DNA

SEQ ID NO: 11615 - DNA, 477 bp, synthetic construct; identical to SEQ ID NO: 513
  misc_feature 1..477: note = Synthetic polypeptide
  source 1..477: mol_type = other DNA

SEQ ID NO: 11616 - DNA, 2158 bp, synthetic construct; identical to SEQ ID NO: 514
  misc_feature 1..2158: note = Synthetic polypeptide
  source 1..2158: mol_type = other DNA

SEQ ID NO: 11617 - DNA, 124 bp, synthetic construct; identical to SEQ ID NO: 515
  misc_feature 1..124: note = Synthetic polypeptide
  source 1..124: mol_type = other DNA

SEQ ID NO: 11618 - DNA, 166 bp, synthetic construct; identical to SEQ ID NO: 516
  misc_feature 1..166: note = Synthetic polypeptide
  source 1..166: mol_type = other DNA

SEQ ID NO: 11619 - DNA, 1776 bp, synthetic construct; identical to SEQ ID NO: 517
  misc_feature 1..1776: note = Synthetic polypeptide
  source 1..1776: mol_type = other DNA

SEQ ID NO: 11620 - DNA, 319 bp, synthetic construct; identical to SEQ ID NO: 520
  misc_feature 1..319: note = Synthetic polypeptide
  source 1..319: mol_type = other DNA

SEQ ID NO: 11621 - DNA, 372 bp, synthetic construct; identical to SEQ ID NO: 521
  misc_feature 1..372: note = Synthetic polypeptide
  source 1..372: mol_type = other DNA

SEQ ID NO: 11622 - DNA, 2056 bp, synthetic construct; identical to SEQ ID NO: 522
  misc_feature 1..2056: note = Synthetic polypeptide
  source 1..2056: mol_type = other DNA

SEQ ID NO: 11623 - DNA, 2098 bp, synthetic construct; identical to SEQ ID NO: 523
  misc_feature 1..2098: note = Synthetic polypeptide
  source 1..2098: mol_type = other DNA

SEQ ID NO: 11624 - DNA, 463 bp, synthetic construct; identical to SEQ ID NO: 524
  misc_feature 1..463: note = Synthetic polypeptide
  source 1..463: mol_type = other DNA

SEQ ID NO: 11625 - DNA, 1211 bp, synthetic construct; identical to SEQ ID NO: 526
  misc_feature 1..1211: note = Synthetic polypeptide
  source 1..1211: mol_type = other DNA

SEQ ID NO: 11626 - DNA, 1133 bp, synthetic construct; identical to SEQ ID NO: 527
  misc_feature 1..1133: note = Synthetic polypeptide
  source 1..1133: mol_type = other DNA

SEQ ID NO: 11627 - DNA, 841 bp, synthetic construct; identical to SEQ ID NO: 529
  misc_feature 1..841: note = Synthetic polypeptide
  source 1..841: mol_type = other DNA

SEQ ID NO: 11628 - DNA, 659 bp, synthetic construct; identical to SEQ ID NO: 530
  misc_feature 1..659: note = Synthetic polypeptide
  source 1..659: mol_type = other DNA

SEQ ID NO: 11629 - DNA, 1636 bp, synthetic construct; identical to SEQ ID NO: 531
  misc_feature 1..1636: note = Synthetic polypeptide
  source 1..1636: mol_type = other DNA

SEQ ID NO: 11630 - DNA, 1328 bp, synthetic construct; identical to SEQ ID NO: 532
  misc_feature 1..1328: note = Synthetic polypeptide
  source 1..1328: mol_type = other DNA

SEQ ID NO: 11631 - DNA, 334 bp, synthetic construct; identical to SEQ ID NO: 533
  misc_feature 1..334: note = Synthetic polypeptide
  source 1..334: mol_type = other DNA

SEQ ID NO: 11632 - DNA, 1516 bp, synthetic construct; identical to SEQ ID NO: 534
  misc_feature 1..1516: note = Synthetic polypeptide
  source 1..1516: mol_type = other DNA

SEQ ID NO: 11633 - DNA, 591 bp, synthetic construct; identical to SEQ ID NO: 539
  misc_feature 1..591: note = Synthetic polypeptide
  source 1..591: mol_type = other DNA

SEQ ID NO: 11634 - DNA, 482 bp, synthetic construct; identical to SEQ ID NO: 540
  misc_feature 1..482: note = Synthetic polypeptide
  source 1..482: mol_type = other DNA

SEQ ID NO: 11635 - DNA, 444 bp, synthetic construct; identical to SEQ ID NO: 541
  misc_feature 1..444: note = Synthetic polypeptide
  source 1..444: mol_type = other DNA

SEQ ID NO: 11636 - DNA, 245 bp, synthetic construct; identical to SEQ ID NO: 542
  misc_feature 1..245: note = Synthetic polypeptide
  source 1..245: mol_type = other DNA

SEQ ID NO: 11637 - DNA, 38 bp, synthetic construct; identical to SEQ ID NO: 543
  misc_feature 1..38: note = Synthetic polypeptide
  source 1..38: mol_type = other DNA

SEQ ID NO: 11638 - DNA, 367 bp, synthetic construct; identical to SEQ ID NO: 548
  misc_feature 1..367: note = Synthetic polypeptide
  source 1..367: mol_type = other DNA

SEQ ID NO: 11639 - DNA, 387 bp, synthetic construct; identical to SEQ ID NO: 544
  misc_feature 1..387: note = Synthetic polypeptide
  source 1..387: mol_type = other DNA

SEQ ID NO: 11640 - DNA, 540 bp, synthetic construct; identical to SEQ ID NO: 545
  misc_feature 1..540: note = Synthetic polypeptide
  source 1..540: mol_type = other DNA

SEQ ID NO: 11641 - DNA, 303 bp, synthetic construct; identical to SEQ ID NO: 547
  misc_feature 1..303: note = Synthetic polypeptide
  source 1..303: mol_type = other DNA

SEQ ID NO: 11642 - DNA, 1331 bp, synthetic construct; identical to SEQ ID NO: 550
  misc_feature 1..1331: note = Synthetic polypeptide
  source 1..1331: mol_type = other DNA

SEQ ID NO: 11643 - DNA, 1028 bp, synthetic construct; identical to SEQ ID NO: 551
  misc_feature 1..1028: note = Synthetic polypeptide
  source 1..1028: mol_type = other DNA

SEQ ID NO: 11644 - DNA, 1295 bp, synthetic construct; identical to SEQ ID NO: 553
  misc_feature 1..1295: note = Synthetic polypeptide
  source 1..1295: mol_type = other DNA

SEQ ID NO: 11645 - DNA, 1322 bp, synthetic construct; identical to SEQ ID NO: 554
  misc_feature 1..1322: note = Synthetic polypeptide
  source 1..1322: mol_type = other DNA

SEQ ID NO: 11646 - DNA, 1013 bp, synthetic construct; identical to SEQ ID NO: 555
  misc_feature 1..1013: note = Synthetic polypeptide
  source 1..1013: mol_type = other DNA

SEQ ID NO: 11647 - DNA, 7501 bp, synthetic construct; identical to SEQ ID NO: 557
  misc_feature 1..7501: note = Synthetic polypeptide
  source 1..7501: mol_type = other DNA

SEQ ID NO: 11648 - DNA, 7492 bp, synthetic construct; identical to SEQ ID NO: 558
  misc_feature 1..7492: note = Synthetic polypeptide
  source 1..7492: mol_type = other DNA

SEQ ID NO: 11649 - DNA, 373 bp, synthetic construct; identical to SEQ ID NO: 559
  misc_feature 1..373: note = Synthetic polypeptide
  source 1..373: mol_type = other DNA

SEQ ID NO: 11650 - DNA, 337 bp, synthetic construct; identical to SEQ ID NO: 560
  misc_feature 1..337: note = Synthetic polypeptide
  source 1..337: mol_type = other DNA

SEQ ID NO: 11651 - DNA, 301 bp, synthetic construct; identical to SEQ ID NO: 561
  misc_feature 1..301: note = Synthetic polypeptide
  source 1..301: mol_type = other DNA

SEQ ID NO: 11652 - DNA, 373 bp, synthetic construct; identical to SEQ ID NO: 562
  misc_feature 1..373: note = Synthetic polypeptide
  source 1..373: mol_type = other DNA

SEQ ID NO: 11653 - DNA, 442 bp, synthetic construct; identical to SEQ ID NO: 563
  misc_feature 1..442: note = Synthetic polypeptide
  source 1..442: mol_type = other DNA

SEQ ID NO: 11654 - DNA, 1276 bp, synthetic construct; identical to SEQ ID NO: 565
  misc_feature 1..1276: note = Synthetic polypeptide
  source 1..1276: mol_type = other DNA

SEQ ID NO: 11655 - DNA, 7528 bp, synthetic construct; identical to SEQ ID NO: 566
  misc_feature 1..7528: note = Synthetic polypeptide
  source 1..7528: mol_type = other DNA

SEQ ID NO: 11656 - DNA, 418 bp, synthetic construct; identical to SEQ ID NO: 567
  misc_feature 1..418: note = Synthetic polypeptide
  source 1..418: mol_type = other DNA

SEQ ID NO: 11657 - DNA, 1775 bp, synthetic construct; identical to SEQ ID NO: 568
  misc_feature 1..1775: note = Synthetic polypeptide
  source 1..1775: mol_type = other DNA

SEQ ID NO: 11658 - DNA, 427 bp, synthetic construct; identical to SEQ ID NO: 573
  misc_feature 1..427: note = Synthetic polypeptide
  source 1..427: mol_type = other DNA

SEQ ID NO: 11659 - DNA, 898 bp, synthetic construct; identical to SEQ ID NO: 569
  misc_feature 1..898: note = Synthetic polypeptide
  source 1..898: mol_type = other DNA

SEQ ID NO: 11660 - DNA, 961 bp, synthetic construct; identical to SEQ ID NO: 570
  misc_feature 1..961: note = Synthetic polypeptide
  source 1..961: mol_type = other DNA

SEQ ID NO: 11661 - DNA, 818 bp, synthetic construct; identical to SEQ ID NO: 572
  misc_feature 1..818: note = Synthetic polypeptide
  source 1..818: mol_type = other DNA

SEQ ID NO: 11662 - DNA, 7177 bp, synthetic construct; identical to SEQ ID NO: 574
  misc_feature 1..7177: note = Synthetic polypeptide
  source 1..7177: mol_type = other DNA

SEQ ID NO: 11663 - DNA, 7195 bp, synthetic construct; identical to SEQ ID NO: 575
  misc_feature 1..7195: note = Synthetic polypeptide
  source 1..7195: mol_type = other DNA

SEQ ID NO: 11664 - DNA, 1407 bp, synthetic construct; identical to SEQ ID NO: 579
  misc_feature 1..1407: note = Synthetic polypeptide
  source 1..1407: mol_type = other DNA

SEQ ID NO: 11665 - DNA, 1084 bp, synthetic construct; identical to SEQ ID NO: 580
  misc_feature 1..1084: note = Synthetic polypeptide
  source 1..1084: mol_type = other DNA

SEQ ID NO: 11666 - DNA, 1815 bp, synthetic construct; identical to SEQ ID NO: 581
  misc_feature 1..1815: note = Synthetic polypeptide
  source 1..1815: mol_type = other DNA

SEQ ID NO: 11667 - DNA, 2471 bp, synthetic construct; identical to SEQ ID NO: 576
  misc_feature 1..2471: note = Synthetic polypeptide
  source 1..2471: mol_type = other DNA

SEQ ID NO: 11668 - DNA, 858 bp, synthetic construct; identical to SEQ ID NO: 582
  misc_feature 1..858: note = Synthetic polypeptide
  source 1..858: mol_type = other DNA

SEQ ID NO: 11669 - DNA, 921 bp, synthetic construct; identical to SEQ ID NO: 583
  misc_feature 1..921: note = Synthetic polypeptide
  source 1..921: mol_type = other DNA

SEQ ID NO: 11670 - DNA, 778 bp, synthetic construct; identical to SEQ ID NO: 585
  misc_feature 1..778: note = Synthetic polypeptide
  source 1..778: mol_type = other DNA

SEQ ID NO: 11671 - DNA, 2534 bp, synthetic construct; identical to SEQ ID NO: 586
  misc_feature 1..2534: note = Synthetic polypeptide
  source 1..2534: mol_type = other DNA

SEQ ID NO: 11672 - DNA, 463 bp, synthetic construct; identical to SEQ ID NO: 588
  misc_feature 1..463: note = Synthetic polypeptide
  source 1..463: mol_type = other DNA

SEQ ID NO: 11673 - DNA, 1022 bp, synthetic construct; identical to SEQ ID NO: 590
  misc_feature 1..1022: note = Synthetic polypeptide
  source 1..1022: mol_type = other DNA

SEQ ID NO: 11674 - DNA, 347 bp, synthetic construct; identical to SEQ ID NO: 591
  misc_feature 1..347: note = Synthetic polypeptide
  source 1..347: mol_type = other DNA

SEQ ID NO: 11675 - DNA, 1109 bp, synthetic construct; identical to SEQ ID NO: 592
  misc_feature 1..1109: note = Synthetic polypeptide
  source 1..1109: mol_type = other DNA

SEQ ID NO: 11676 - DNA, 269 bp, synthetic construct; identical to SEQ ID NO: 600
  misc_feature 1..269: note = Synthetic polypeptide
  source 1..269: mol_type = other DNA

SEQ ID NO: 11677 - DNA, 85 bp, synthetic construct; identical to SEQ ID NO: 601
  misc_feature 1..85: note = Synthetic polypeptide
  source 1..85: mol_type = other DNA

SEQ ID NO: 11678 - DNA, 414 bp, synthetic construct; identical to SEQ ID NO: 602
  misc_feature 1..414: note = Synthetic polypeptide
  source 1..414: mol_type = other DNA

SEQ ID NO: 11679 - DNA, 434 bp, synthetic construct; identical to SEQ ID NO: 603
  misc_feature 1..434: note = Synthetic polypeptide
  source 1..434: mol_type = other DNA

SEQ ID NO: 11680 - DNA, 861 bp, synthetic construct; identical to SEQ ID NO: 604
  misc_feature 1..861: note = Synthetic polypeptide
  source 1..861: mol_type = other DNA

SEQ ID NO: 11681 - DNA, 763 bp, synthetic construct; identical to SEQ ID NO: 606
  misc_feature 1..763: note = Synthetic polypeptide
  source 1..763: mol_type = other DNA

SEQ ID NO: 11682 - DNA, 56 bp, synthetic construct; identical to SEQ ID NO: 605
  misc_feature 1..56: note = Synthetic polypeptide
  source 1..56: mol_type = other DNA

SEQ ID NO: 11683 - DNA, 501 bp, synthetic construct; identical to SEQ ID NO: 609
  misc_feature 1..501: note = Synthetic polypeptide
  source 1..501: mol_type = other DNA

SEQ ID NO: 11684 - DNA, 1023 bp, synthetic construct; identical to SEQ ID NO: 611
  misc_feature 1..1023: note = Synthetic polypeptide
  source 1..1023: mol_type = other DNA

SEQ ID NO: 11685 - DNA, 895 bp, synthetic construct; identical to SEQ ID NO: 613
  misc_feature 1..895: note = Synthetic polypeptide
  source 1..895: mol_type = other DNA

SEQ ID NO: 11686 - DNA, 247 bp, synthetic construct; identical to SEQ ID NO: 614
  misc_feature 1..247: note = Synthetic polypeptide
  source 1..247: mol_type = other DNA

SEQ ID NO: 11687 - DNA, 551 bp, synthetic construct; identical to SEQ ID NO: 615
  misc_feature 1..551: note = Synthetic polypeptide
  source 1..551: mol_type = other DNA

SEQ ID NO: 11688 - DNA, 1269 bp, synthetic construct; identical to SEQ ID NO: 616
  misc_feature 1..1269: note = Synthetic polypeptide
  source 1..1269: mol_type = other DNA

SEQ ID NO: 11689 - DNA, 1134 bp, synthetic construct; identical to SEQ ID NO: 617
  misc_feature 1..1134: note = Synthetic polypeptide
  source 1..1134: mol_type = other DNA

SEQ ID NO: 11690 - DNA, 501 bp, synthetic construct; identical to SEQ ID NO: 618
  misc_feature 1..501: note = Synthetic polypeptide
  source 1..501: mol_type = other DNA

SEQ ID NO: 11691 - DNA, 1321 bp, synthetic construct; identical to SEQ ID NO: 619
  misc_feature 1..1321: note = Synthetic polypeptide
  source 1..1321: mol_type = other DNA

SEQ ID NO: 11692 - DNA, 1197 bp, synthetic construct; identical to SEQ ID NO: 620
  misc_feature 1..1197: note = Synthetic polypeptide
  source 1..1197: mol_type = other DNA

SEQ ID NO: 11693 - DNA, 1203 bp, synthetic construct; identical to SEQ ID NO: 621
  misc_feature 1..1203: note = Synthetic polypeptide
  source 1..1203: mol_type = other DNA

SEQ ID NO: 11694 - DNA, 1131 bp, synthetic construct; identical to SEQ ID NO: 622
  misc_feature 1..1131: note = Synthetic polypeptide
  source 1..1131: mol_type = other DNA

SEQ ID NO: 11695 - DNA, 642 bp, synthetic construct; identical to SEQ ID NO: 623
  misc_feature 1..642: note = Synthetic polypeptide
  source 1..642: mol_type = other DNA

SEQ ID NO: 11696 - DNA, 829 bp, synthetic construct; identical to SEQ ID NO: 624
  misc_feature 1..829: note = Synthetic polypeptide
  source 1..829: mol_type = other DNA

SEQ ID NO: 11697 - DNA, 641 bp, synthetic construct; identical to SEQ ID NO: 638
  misc_feature 1..641: note = Synthetic polypeptide
  source 1..641: mol_type = other DNA

SEQ ID NO: 11698 - DNA, 1257 bp, synthetic construct; identical to SEQ ID NO: 625
  misc_feature 1..1257: note = Synthetic polypeptide
  source 1..1257: mol_type = other DNA

SEQ ID NO: 11699 - DNA, 1215 bp, synthetic construct; identical to SEQ ID NO: 626
  misc_feature 1..1215: note = Synthetic polypeptide
  source 1..1215: mol_type = other DNA

SEQ ID NO: 11700 - DNA, 507 bp, synthetic construct; identical to SEQ ID NO: 628
  misc_feature 1..507: note = Synthetic polypeptide
  source 1..507: mol_type = other DNA

SEQ ID NO: 11701 - DNA, 313 bp, synthetic construct; identical to SEQ ID NO: 629
  misc_feature 1..313: note = Synthetic polypeptide
  source 1..313: mol_type = other DNA

SEQ ID NO: 11702 - DNA, 291 bp, synthetic construct; identical to SEQ ID NO: 630
  misc_feature 1..291: note = Synthetic polypeptide
  source 1..291: mol_type = other DNA

SEQ ID NO: 11703 - DNA, 1046 bp, synthetic construct; identical to SEQ ID NO: 631
  misc_feature 1..1046: note = Synthetic polypeptide
  source 1..1046: mol_type = other DNA

SEQ ID NO: 11704 - DNA, 968 bp, synthetic construct; identical to SEQ ID NO: 632
  misc_feature 1..968: note = Synthetic polypeptide
  source 1..968: mol_type = other DNA

SEQ ID NO: 11705 - DNA, 676 bp, synthetic construct; identical to SEQ ID NO: 634
  misc_feature 1..676: note = Synthetic polypeptide
  source 1..676: mol_type = other DNA

SEQ ID NO: 11706 - DNA, 494 bp, synthetic construct; identical to SEQ ID NO: 635
  misc_feature 1..494: note = Synthetic polypeptide
  source 1..494: mol_type = other DNA

SEQ ID NO: 11707 - DNA, 920 bp, synthetic construct; identical to SEQ ID NO: 636
  misc_feature 1..920: note = Synthetic polypeptide
  source 1..920: mol_type = other DNA

SEQ ID NO: 11708 - DNA, 2066 bp, synthetic construct; identical to SEQ ID NO: 639
  misc_feature 1..2066: note = Synthetic polypeptide
  source 1..2066: mol_type = other DNA

SEQ ID NO: 11709 - DNA, 476 bp, synthetic construct; identical to SEQ ID NO: 646
  misc_feature 1..476: note = Synthetic polypeptide
  source 1..476: mol_type = other DNA

SEQ ID NO: 11710 - DNA, 488 bp, synthetic construct; identical to SEQ ID NO: 647
  misc_feature 1..488: note = Synthetic polypeptide
  source 1..488: mol_type = other DNA

SEQ ID NO: 11711 - DNA, 1284 bp, synthetic construct; identical to SEQ ID NO: 648
  misc_feature 1..1284: note = Synthetic polypeptide
  source 1..1284: mol_type = other DNA

SEQ ID NO: 11712 - DNA, 1077 bp, synthetic construct; identical to SEQ ID NO: 649
  misc_feature 1..1077: note = Synthetic polypeptide
  source 1..1077: mol_type = other DNA

SEQ ID NO: 11713 - DNA, 972 bp, synthetic construct; identical to SEQ ID NO: 650
  misc_feature 1..972: note = Synthetic polypeptide
  source 1..972: mol_type = other DNA

SEQ ID NO: 11714 - DNA, 743 bp, synthetic construct; identical to SEQ ID NO: 651
  misc_feature 1..743: note = Synthetic polypeptide
  source 1..743: mol_type = other DNA

SEQ ID NO: 11715 - DNA, 539 bp, synthetic construct; identical to SEQ ID NO: 653
  misc_feature 1..539: note = Synthetic polypeptide
  source 1..539: mol_type = other DNA

SEQ ID NO: 11716 - DNA, 1218 bp, synthetic construct; identical to SEQ ID NO: 654
  misc_feature 1..1218: note = Synthetic polypeptide
  source 1..1218: mol_type = other DNA

SEQ ID NO: 11717 - DNA, 5350 bp, synthetic construct; identical to SEQ ID NO: 655
  misc_feature 1..5350: note = Synthetic polypeptide
  source 1..5350: mol_type = other DNA

SEQ ID NO: 11718 - DNA, 1397 bp, synthetic construct; identical to SEQ ID NO: 657
  misc_feature 1..1397: note = Synthetic polypeptide
  source 1..1397: mol_type = other DNA

SEQ ID NO: 11719 - DNA, 701 bp, synthetic construct; identical to SEQ ID NO: 658
  misc_feature 1..701: note = Synthetic polypeptide
  source 1..701: mol_type = other DNA

SEQ ID NO: 11720 - DNA, 611 bp, synthetic construct; identical to SEQ ID NO: 672
  misc_feature 1..611: note = Synthetic polypeptide
  source 1..611: mol_type = other DNA

SEQ ID NO: 11721 - DNA, 464 bp, synthetic construct; identical to SEQ ID NO: 673
  misc_feature 1..464: note = Synthetic polypeptide
  source 1..464: mol_type = other DNA

SEQ ID NO: 11722 - DNA, 470 bp, synthetic construct; identical to SEQ ID NO: 674
  misc_feature 1..470: note = Synthetic polypeptide
  source 1..470: mol_type = other DNA

SEQ ID NO: 11723 - DNA, 605 bp, synthetic construct; identical to SEQ ID NO: 675
  misc_feature 1..605: note = Synthetic polypeptide
  source 1..605: mol_type = other DNA

SEQ ID NO: 11724 - DNA, 861 bp, synthetic construct; identical to SEQ ID NO: 662
  misc_feature 1..861: note = Synthetic polypeptide
  source 1..861: mol_type = other DNA

SEQ ID NO: 11725 - DNA, 2429 bp, synthetic construct; identical to SEQ ID NO: 664
  misc_feature 1..2429: note = Synthetic polypeptide
  source 1..2429: mol_type = other DNA

SEQ ID NO: 11726 - DNA, 365 bp, synthetic construct; identical to SEQ ID NO: 665
  misc_feature 1..365: note = Synthetic polypeptide
  source 1..365: mol_type = other DNA

SEQ ID NO: 11727 - DNA, 136 bp, synthetic construct; identical to SEQ ID NO: 666
  misc_feature 1..136: note = Synthetic polypeptide
  source 1..136: mol_type = other DNA

SEQ ID NO: 11728 - DNA, 1014 bp, synthetic construct; identical to SEQ ID NO: 667
  misc_feature 1..1014: note = Synthetic polypeptide
  source 1..1014: mol_type = other DNA

SEQ ID NO: 11729 - DNA, 1158 bp, synthetic construct; identical to SEQ ID NO: 668
  misc_feature 1..1158: note = Synthetic polypeptide
  source 1..1158: mol_type = other DNA

SEQ ID NO: 11730 - DNA, 1125 bp, synthetic construct; identical to SEQ ID NO: 669
  misc_feature 1..1125: note = Synthetic polypeptide
  source 1..1125: mol_type = other DNA

SEQ ID NO: 11731 - DNA, 1694 bp, synthetic construct; identical to SEQ ID NO: 670
  misc_feature 1..1694: note = Synthetic polypeptide
  source 1..1694: mol_type = other DNA

SEQ ID NO: 11732 - DNA, 725 bp, synthetic construct; identical to SEQ ID NO: 671
  misc_feature 1..725: note = Synthetic polypeptide
  source 1..725: mol_type = other DNA

SEQ ID NO: 11733 - DNA, 1234 bp, synthetic construct; identical to SEQ ID NO: 676
  misc_feature 1..1234: note = Synthetic polypeptide
  source 1..1234: mol_type = other DNA

SEQ ID NO: 11734 - DNA, 586 bp, synthetic construct; identical to SEQ ID NO: 677
  misc_feature 1..586: note = Synthetic polypeptide
  source 1..586: mol_type = other DNA

SEQ ID NO: 11735 - DNA, 890 bp, synthetic construct; identical to SEQ ID NO: 678
  misc_feature 1..890: note = Synthetic polypeptide
  source 1..890: mol_type = other DNA

SEQ ID NO: 11736 - DNA, 380 bp, synthetic construct; identical to SEQ ID NO: 682
  misc_feature 1..380: note = Synthetic polypeptide
  source 1..380: mol_type = other DNA

SEQ ID NO: 11737 - DNA, 422 bp, synthetic construct; identical to SEQ ID NO: 683
  misc_feature 1..422: note = Synthetic polypeptide
  source 1..422: mol_type = other DNA

SEQ ID NO: 11738 - DNA, 271 bp, synthetic construct; identical to SEQ ID NO: 684
  misc_feature 1..271: note = Synthetic polypeptide
  source 1..271: mol_type = other DNA

SEQ ID NO: 11739 - DNA, 197 bp, synthetic construct; identical to SEQ ID NO: 685
  misc_feature 1..197: note = Synthetic polypeptide
  source 1..197: mol_type = other DNA

SEQ ID NO: 11740 - DNA, 524 bp, synthetic construct; identical to SEQ ID NO: 686
  misc_feature 1..524: note = Synthetic polypeptide
  source 1..524: mol_type = other DNA

SEQ ID NO: 11741 - DNA, 1718 bp, synthetic construct; identical to SEQ ID NO: 695
  misc_feature 1..1718: note = Synthetic polypeptide
  source 1..1718: mol_type = other DNA

SEQ ID NO: 11742 - DNA, 1769 bp, synthetic construct; identical to SEQ ID NO: 696
  misc_feature 1..1769: note = Synthetic polypeptide
  source 1..1769: mol_type = other DNA

SEQ ID NO: 11743 - DNA, 1763 bp, synthetic construct; identical to SEQ ID NO: 697
  misc_feature 1..1763: note = Synthetic polypeptide
  source 1..1763: mol_type = other DNA

SEQ ID NO: 11744 - DNA, 394 bp, synthetic construct; identical to SEQ ID NO: 701
  misc_feature 1..394: note = Synthetic polypeptide
  source 1..394: mol_type = other DNA

SEQ ID NO: 11745 - DNA, 700 bp, synthetic construct; identical to SEQ ID NO: 702
  misc_feature 1..700: note = Synthetic polypeptide
  source 1..700: mol_type = other DNA

SEQ ID NO: 11746 - DNA, 568 bp, synthetic construct; identical to SEQ ID NO: 703
  misc_feature 1..568: note = Synthetic polypeptide
  source 1..568: mol_type = other DNA

SEQ ID NO: 11747 - DNA, 535 bp, synthetic construct; identical to SEQ ID NO: 704
  misc_feature 1..535: note = Synthetic polypeptide
  source 1..535: mol_type = other DNA

SEQ ID NO: 11748 - DNA, 129 bp, synthetic construct; identical to SEQ ID NO: 705
  misc_feature 1..129: note = Synthetic polypeptide
  source 1..129: mol_type = other DNA

SEQ ID NO: 11749 - DNA, 435 bp, synthetic construct; identical to SEQ ID NO: 706
  misc_feature 1..435: note = Synthetic polypeptide
  source 1..435: mol_type = other DNA

SEQ ID NO: 11750 - DNA, 303 bp, synthetic construct; identical to SEQ ID NO: 707
  misc_feature 1..303: note = Synthetic polypeptide
  source 1..303: mol_type = other DNA

SEQ ID NO: 11751 - DNA, 270 bp, synthetic construct; identical to SEQ ID NO: 708
  misc_feature 1..270: note = Synthetic polypeptide
  source 1..270: mol_type = other DNA

SEQ ID NO: 11752 - DNA, 3055 bp, synthetic construct; identical to SEQ ID NO: 709
  misc_feature 1..3055: note = Synthetic polypeptide
  source 1..3055: mol_type = other DNA

SEQ ID NO: 11753 - DNA, 3058 bp, synthetic construct; identical to SEQ ID NO: 710
  misc_feature 1..3058: note = Synthetic polypeptide
  source 1..3058: mol_type = other DNA

SEQ ID NO: 11754 - DNA, 1680 bp, synthetic construct; identical to SEQ ID NO: 733
  misc_feature 1..1680: note = Synthetic polypeptide
  source 1..1680: mol_type = other DNA

SEQ ID NO: 11755 - DNA, 1584 bp, synthetic construct; identical to SEQ ID NO: 734
  misc_feature 1..1584: note = Synthetic polypeptide
  source 1..1584: mol_type = other DNA

SEQ ID NO: 11756 - DNA, 1494 bp, synthetic construct; identical to SEQ ID NO: 736
  misc_feature 1..1494: note = Synthetic polypeptide
  source 1..1494: mol_type = other DNA

SEQ ID NO: 11757 - DNA, 1491 bp, synthetic construct; identical to SEQ ID NO: 737
  misc_feature 1..1491: note = Synthetic polypeptide
  source 1..1491: mol_type = other DNA

SEQ ID NO: 11758 - DNA, 1482 bp, synthetic construct; identical to SEQ ID NO: 738
  misc_feature 1..1482: note = Synthetic polypeptide
  source 1..1482: mol_type = other DNA

SEQ ID NO: 11759 - DNA, 1485 bp, synthetic construct; identical to SEQ ID NO: 739
  misc_feature 1..1485: note = Synthetic polypeptide
  source 1..1485: mol_type = other DNA

SEQ ID NO: 11760 - DNA, 515 bp, synthetic construct; identical to SEQ ID NO: 679
  misc_feature 1..515: note = Synthetic polypeptide
  source 1..515: mol_type = other DNA

SEQ ID NO: 11761 - DNA, 407 bp, synthetic construct; identical to SEQ ID NO: 680
  misc_feature 1..407: note = Synthetic polypeptide
  source 1..407: mol_type = other DNA

SEQ ID NO: 11762 - DNA, 485 bp, synthetic construct; identical to SEQ ID NO: 681
  misc_feature 1..485: note = Synthetic polypeptide
  source 1..485: mol_type = other DNA

SEQ ID NO: 11763 - DNA, 2194 bp, synthetic construct; identical to SEQ ID NO: 687
  misc_feature 1..2194: note = Synthetic polypeptide
  source 1..2194: mol_type = other DNA

SEQ ID NO: 11764 - DNA, 362 bp, synthetic construct; identical to SEQ ID NO: 688
  misc_feature 1..362: note = Synthetic polypeptide
  source 1..362: mol_type = other DNA

SEQ ID NO: 11765 - DNA, 781 bp, synthetic construct; identical to SEQ ID NO: 689
  misc_feature 1..781: note = Synthetic polypeptide
  source 1..781: mol_type = other DNA

SEQ ID NO: 11766 - DNA, 844 bp, synthetic construct; identical to SEQ ID NO: 690
  misc_feature 1..844: note = Synthetic polypeptide
  source 1..844: mol_type = other DNA

SEQ ID NO: 11767 - DNA, 701 bp, synthetic construct; identical to SEQ ID NO: 692
  misc_feature 1..701: note = Synthetic polypeptide
  source 1..701: mol_type = other DNA

SEQ ID NO: 11768 - DNA, 812 bp, synthetic construct; identical to SEQ ID NO: 693
  misc_feature 1..812: note = Synthetic polypeptide
  source 1..812: mol_type = other DNA

SEQ ID NO: 11769 - DNA, 752 bp, synthetic construct; identical to SEQ ID NO: 694
  misc_feature 1..752: note = Synthetic polypeptide
  source 1..752: mol_type = other DNA

SEQ ID NO: 11770 - DNA, 970 bp, synthetic construct; identical to SEQ ID NO: 711
  misc_feature 1..970: note = Synthetic polypeptide
  source 1..970: mol_type = other DNA

SEQ ID NO: 11771 - DNA, 1681 bp, synthetic construct; identical to SEQ ID NO: 714
  misc_feature 1..1681: note = Synthetic polypeptide
  source 1..1681: mol_type = other DNA

SEQ ID NO: 11772 - DNA, 1543 bp, synthetic construct; identical to SEQ ID NO: 717
  misc_feature 1..1543: note = Synthetic polypeptide
  source 1..1543: mol_type = other DNA

SEQ ID NO: 11773 - DNA, 258 bp, synthetic construct; identical to SEQ ID NO: 719
  misc_feature 1..258: note = Synthetic polypeptide
  source 1..258: mol_type = other DNA

SEQ ID NO: 11774 - DNA, 1027 bp, synthetic construct; identical to SEQ ID NO: 720
  misc_feature 1..1027: note = Synthetic polypeptide
  source 1..1027: mol_type = other DNA

SEQ ID NO: 11775 - DNA, 648 bp, synthetic construct; identical to SEQ ID NO: 721
  misc_feature 1..648: note = Synthetic polypeptide
  source 1..648: mol_type = other DNA

SEQ ID NO: 11776 - DNA, 643 bp, synthetic construct; identical to SEQ ID NO: 722
  misc_feature 1..643: note = Synthetic polypeptide
  source 1..643: mol_type = other DNA

SEQ ID NO: 11777 - DNA, 335 bp, synthetic construct; identical to SEQ ID NO: 723
  misc_feature 1..335: note = Synthetic polypeptide
  source 1..335: mol_type = other DNA

SEQ ID NO: 11778 - DNA, 767 bp, synthetic construct; identical to SEQ ID NO: 724
  misc_feature 1..767: note = Synthetic polypeptide
  source 1..767: mol_type = other DNA

SEQ ID NO: 11779 - DNA, 1211 bp, synthetic construct; identical to SEQ ID NO: 729
  misc_feature 1..1211: note = Synthetic polypeptide
  source 1..1211: mol_type = other DNA

SEQ ID NO: 11780 - DNA, 806 bp, synthetic construct; identical to SEQ ID NO: 730
  misc_feature 1..806: note = Synthetic polypeptide
  source 1..806: mol_type = other DNA

SEQ ID NO: 11781 - DNA, 1175 bp, synthetic construct; identical to SEQ ID NO: 731
  misc_feature 1..1175: note = Synthetic polypeptide
  source 1..1175: mol_type = other DNA

SEQ ID NO: 11782 - DNA, 59 bp, synthetic construct; identical to SEQ ID NO: 742
  misc_feature 1..59: note = Synthetic polypeptide
  source 1..59: mol_type = other DNA

SEQ ID NO: 11783 - DNA, 123 bp, synthetic construct; identical to SEQ ID NO: 743
  misc_feature 1..123: note = Synthetic polypeptide
  source 1..123: mol_type = other DNA

SEQ ID NO: 11784 - DNA, 445 bp, synthetic construct; identical to SEQ ID NO: 744
  misc_feature 1..445: note = Synthetic polypeptide
  source 1..445: mol_type = other DNA

SEQ ID NO: 11785 - DNA, 677 bp, synthetic construct; identical to SEQ ID NO: 747
  misc_feature 1..677: note = Synthetic polypeptide
  source 1..677: mol_type = other DNA

SEQ ID NO: 11786 - DNA, 674 bp, synthetic construct; identical to SEQ ID NO: 748
  misc_feature 1..674: note = Synthetic polypeptide
  source 1..674: mol_type = other DNA

SEQ ID NO: 11787 - DNA, 400 bp, synthetic construct; identical to SEQ ID NO: 749
  misc_feature 1..400: note = Synthetic polypeptide
  source 1..400: mol_type = other DNA

SEQ ID NO: 11788 - DNA, 2301 bp, synthetic construct; identical to SEQ ID NO: 750
  misc_feature 1..2301: note = Synthetic polypeptide
  source 1..2301: mol_type = other DNA

SEQ ID NO: 11789 - DNA, 2381 bp, synthetic construct; identical to SEQ ID NO: 751
  misc_feature 1..2381: note = Synthetic polypeptide
  source 1..2381: mol_type = other DNA

SEQ ID NO: 11790 - DNA, 692 bp, synthetic construct; identical to SEQ ID NO: 752
  misc_feature 1..692: note = Synthetic polypeptide
  source 1..692: mol_type = other DNA

SEQ ID NO: 11791 - DNA, 852 bp, synthetic construct; identical to SEQ ID NO: 753
  misc_feature 1..852: note = Synthetic polypeptide
  source 1..852: mol_type = other DNA

SEQ ID NO: 11792 - DNA, 1036 bp, synthetic construct; identical to SEQ ID NO: 754
  misc_feature 1..1036: note = Synthetic polypeptide
  source 1..1036: mol_type = other DNA

SEQ ID NO: 11793 - DNA, 204 bp, synthetic construct; identical to SEQ ID NO: 755
  misc_feature 1..204: note = Synthetic polypeptide
  source 1..204: mol_type = other DNA

SEQ ID NO: 11794 - DNA, 564 bp, synthetic construct; identical to SEQ ID NO: 756
  misc_feature 1..564: note = Synthetic polypeptide
  source 1..564: mol_type = other DNA

SEQ ID NO: 11795 - DNA, 597 bp, synthetic construct; identical to SEQ ID NO: 759
  misc_feature 1..597: note = Synthetic polypeptide
  source 1..597: mol_type = other DNA

SEQ ID NO: 11796 - DNA, 654 bp, synthetic construct; identical to SEQ ID NO: 760
  misc_feature 1..654: note = Synthetic polypeptide
  source 1..654: mol_type = other DNA

SEQ ID NO: 11797 - DNA, 318 bp, synthetic construct; identical to SEQ ID NO: 770
  misc_feature 1..318: note = Synthetic polypeptide
  source 1..318: mol_type = other DNA

SEQ ID NO: 11798 - DNA, 1471 bp, synthetic construct; identical to SEQ ID NO: 771
  misc_feature 1..1471: note = Synthetic polypeptide
  source 1..1471: mol_type = other DNA

SEQ ID NO: 11799 - DNA, 1366 bp, synthetic construct; identical to SEQ ID NO: 772
  misc_feature 1..1366: note = Synthetic polypeptide
  source 1..1366: mol_type = other DNA

SEQ ID NO: 11800 - DNA, 1328 bp, synthetic construct; identical to SEQ ID NO: 783
  misc_feature 1..1328: note = Synthetic polypeptide
  source 1..1328: mol_type = other DNA

SEQ ID NO: 11801 - DNA, 1325 bp, synthetic construct; identical to SEQ ID NO: 784
  misc_feature 1..1325: note = Synthetic polypeptide
  source 1..1325: mol_type = other DNA

SEQ ID NO: 11802 - DNA, 541 bp, synthetic construct; identical to SEQ ID NO: 787
  misc_feature 1..541: note = Synthetic polypeptide
  source 1..541: mol_type = other DNA

SEQ ID NO: 11803 - DNA, 1024 bp, synthetic construct; identical to SEQ ID NO: 794
  misc_feature 1..1024: note = Synthetic polypeptide
  source 1..1024: mol_type = other DNA

SEQ ID NO: 11804 - DNA, 1279 bp, synthetic construct; identical to SEQ ID NO: 795
  misc_feature 1..1279: note = Synthetic polypeptide
  source 1..1279: mol_type = other DNA

SEQ ID NO: 11805 - DNA, 590 bp, synthetic construct; identical to SEQ ID NO: 796
  misc_feature 1..590: note = Synthetic polypeptide
  source 1..590: mol_type = other DNA

SEQ ID NO: 11806 - DNA, 1175 bp, synthetic construct; identical to SEQ ID NO: 761
  misc_feature 1..1175: note = Synthetic polypeptide
  source 1..1175: mol_type = other DNA

SEQ ID NO: 11807 - DNA, 770 bp, synthetic construct; identical to SEQ ID NO: 762
  misc_feature 1..770: note = Synthetic polypeptide
  source 1..770: mol_type = other DNA

SEQ ID NO: 11808 - DNA, 1139 bp, synthetic construct; identical to SEQ ID NO: 763
  misc_feature 1..1139: note = Synthetic polypeptide
  source 1..1139: mol_type = other DNA

SEQ ID NO: 11809 - DNA, 1217 bp, synthetic construct; identical to SEQ ID NO: 765
  misc_feature 1..1217: note = Synthetic polypeptide
  source 1..1217: mol_type = other DNA

SEQ ID NO: 11810 - DNA, 1139 bp, synthetic construct; identical to SEQ ID NO: 766
  misc_feature 1..1139: note = Synthetic polypeptide
  source 1..1139: mol_type = other DNA

SEQ ID NO: 11811 - DNA, 847 bp, synthetic construct; identical to SEQ ID NO: 768
  misc_feature 1..847: note = Synthetic polypeptide
  source 1..847: mol_type = other DNA

SEQ ID NO: 11812 - DNA, 665 bp, synthetic construct; identical to SEQ ID NO: 769
  misc_feature 1..665: note = Synthetic polypeptide
  source 1..665: mol_type = other DNA

SEQ ID NO: 11813 - DNA, 299 bp, synthetic construct; identical to SEQ ID NO: 773
  misc_feature 1..299: note = Synthetic polypeptide
  source 1..299: mol_type = other DNA

SEQ ID NO: 11814 - DNA, 503 bp, synthetic construct; identical to SEQ ID NO: 774
  misc_feature 1..503: note = Synthetic polypeptide
  source 1..503: mol_type = other DNA

SEQ ID NO: 11815 - DNA, 317 bp, synthetic construct; identical to SEQ ID NO: 780
  misc_feature 1..317: note = Synthetic polypeptide
  source 1..317: mol_type = other DNA

SEQ ID NO: 11816 - DNA, 344 bp, synthetic construct; identical to SEQ ID NO: 782
  misc_feature 1..344: note = Synthetic polypeptide
  source 1..344: mol_type = other DNA

SEQ ID NO: 11817 - DNA, 1052 bp, synthetic construct; identical to SEQ ID NO: 789
  misc_feature 1..1052: note = Synthetic polypeptide
  source 1..1052: mol_type = other DNA

SEQ ID NO: 11818 - DNA, 974 bp, synthetic construct; identical to SEQ ID NO: 790
  misc_feature 1..974: note = Synthetic polypeptide
  source 1..974: mol_type = other DNA

SEQ ID NO: 11819 - DNA, 682 bp, synthetic construct; identical to SEQ ID NO: 792
  misc_feature 1..682: note = Synthetic polypeptide
  source 1..682: mol_type = other DNA

SEQ ID NO: 11820 - DNA, 500 bp, synthetic construct; identical to SEQ ID NO: 793
  misc_feature 1..500: note = Synthetic polypeptide
  source 1..500: mol_type = other DNA

SEQ ID NO: 11821 - DNA, 463 bp, synthetic construct; identical to SEQ ID NO: 803
  misc_feature 1..463: note = Synthetic polypeptide
  source 1..463: mol_type = other DNA

SEQ ID NO: 11822 - DNA, 745 bp, synthetic construct; identical to SEQ ID NO: 804
  misc_feature 1..745: note = Synthetic polypeptide
  source 1..745: mol_type = other DNA

SEQ ID NO: 11823 - DNA, 1392 bp, synthetic construct; identical to SEQ ID NO: 806
  misc_feature 1..1392: note = Synthetic polypeptide
  source 1..1392: mol_type = other DNA

SEQ ID NO: 11824 - DNA, 1191 bp, synthetic construct; identical to SEQ ID NO: 807
  misc_feature 1..1191: note = Synthetic polypeptide
  source 1..1191: mol_type = other DNA

SEQ ID NO: 11825 - DNA, 412 bp, synthetic construct; identical to SEQ ID NO: 809
  misc_feature 1..412: note = Synthetic polypeptide
  source 1..412: mol_type = other DNA

SEQ ID NO: 11826 - DNA, 366 bp, synthetic construct; identical to SEQ ID NO: 810
  misc_feature 1..366: note = Synthetic polypeptide
  source 1..366: mol_type = other DNA

SEQ ID NO: 11827 - DNA, 297 bp, synthetic construct; identical to SEQ ID NO: 811
  misc_feature 1..297: note = Synthetic polypeptide
  source 1..297: mol_type = other DNA

SEQ ID NO: 11828 - DNA, 161 bp, synthetic construct; identical to SEQ ID NO: 812
  misc_feature 1..161: note = Synthetic polypeptide
  source 1..161: mol_type = other DNA

SEQ ID NO: 11829 - DNA, 636 bp, synthetic construct; identical to SEQ ID NO: 817
  misc_feature 1..636: note = Synthetic polypeptide
  source 1..636: mol_type = other DNA

SEQ ID NO: 11830 - DNA, 582 bp, synthetic construct; identical to SEQ ID NO: 819
  misc_feature 1..582: note = Synthetic polypeptide
  source 1..582: mol_type = other DNA

SEQ ID NO: 11831 - DNA, 718 bp, synthetic construct; identical to SEQ ID NO: 821
  misc_feature 1..718: note = Synthetic polypeptide
  source 1..718: mol_type = other DNA

SEQ ID NO: 11832 - DNA, 1913 bp, synthetic construct; identical to SEQ ID NO: 822
  misc_feature 1..1913: note = Synthetic polypeptide
  source 1..1913: mol_type = other DNA

SEQ ID NO: 11833 - DNA, 1874 bp, synthetic construct; identical to SEQ ID NO: 824
  misc_feature 1..1874: note = Synthetic polypeptide
  source 1..1874: mol_type = other DNA

SEQ ID NO: 11834 - DNA, 136 bp, synthetic construct; identical to SEQ ID NO: 830
  misc_feature 1..136: note = Synthetic polypeptide
  source 1..136: mol_type = other DNA

SEQ ID NO: 11835 - DNA, 164 bp, synthetic construct; identical to SEQ ID NO: 831
  misc_feature 1..164: note = Synthetic polypeptide
  source 1..164: mol_type = other DNA

SEQ ID NO: 11836 - DNA, 193 bp, synthetic construct; identical to SEQ ID NO: 834
  misc_feature 1..193: note = Synthetic polypeptide
  source 1..193: mol_type = other DNA

SEQ ID NO: 11837 - DNA, 915 bp, synthetic construct; identical to SEQ ID NO: 835
  misc_feature 1..915: note = Synthetic polypeptide
  source 1..915: mol_type = other DNA

SEQ ID NO: 11838 - DNA, 735 bp, synthetic construct; identical to SEQ ID NO: 836
  misc_feature 1..735: note = Synthetic polypeptide
  source 1..735: mol_type = other DNA

SEQ ID NO: 11839 - DNA, 451 bp, synthetic construct; identical to SEQ ID NO: 837
  misc_feature 1..451: note = Synthetic polypeptide
  source 1..451: mol_type = other DNA

SEQ ID NO: 11840 - DNA, 546 bp, synthetic construct; identical to SEQ ID NO: 840
  misc_feature 1..546: note = Synthetic polypeptide
  source 1..546: mol_type = other DNA

SEQ ID NO: 11841 - DNA, 1557 bp, synthetic construct; identical to SEQ ID NO: 845
  misc_feature 1..1557: note = Synthetic polypeptide
  source 1..1557: mol_type = other DNA

SEQ ID NO: 11842 - DNA, 1449 bp, synthetic construct; identical to SEQ ID NO: 846
  misc_feature 1..1449: note = Synthetic polypeptide
  source 1..1449: mol_type = other DNA

SEQ ID NO: 11843 - DNA, 789 bp, synthetic construct; identical to SEQ ID NO: 847
  misc_feature 1..789: note = Synthetic polypeptide
  source 1..789: mol_type = other DNA

SEQ ID NO: 11844 - DNA, 904 bp, synthetic construct; identical to SEQ ID NO: 848
  misc_feature 1..904: note = Synthetic polypeptide
  source 1..904: mol_type = other DNA

SEQ ID NO: 11845 - DNA, 430 bp, synthetic construct; identical to SEQ ID NO: 849
  misc_feature 1..430: note = Synthetic polypeptide
  source 1..430: mol_type = other DNA

SEQ ID NO: 11846 - DNA, 649 bp, synthetic construct; identical to SEQ ID NO: 853
  misc_feature 1..649: note = Synthetic polypeptide
  source 1..649: mol_type = other DNA

SEQ ID NO: 11847 - DNA, 425 bp, synthetic construct; identical to SEQ ID NO: 855
  misc_feature 1..425: note = Synthetic polypeptide
  source 1..425: mol_type = other DNA

SEQ ID NO: 11848 - DNA, 233 bp, synthetic construct; identical to SEQ ID NO: 856
  misc_feature 1..233: note = Synthetic polypeptide
  source 1..233: mol_type = other DNA

SEQ ID NO: 11849 - DNA, 566 bp, synthetic construct; identical to SEQ ID NO: 869
  misc_feature 1..566: note = Synthetic polypeptide
  source 1..566: mol_type = other DNA

SEQ ID NO: 11850 - DNA, 343 bp, synthetic construct; identical to SEQ ID NO: 891
  misc_feature 1..343: note = Synthetic polypeptide
  source 1..343: mol_type = other DNA

SEQ ID NO: 11851 - DNA, 838 bp, synthetic construct; identical to SEQ ID NO: 893
  misc_feature 1..838: note = Synthetic polypeptide
  source 1..838: mol_type = other DNA

SEQ ID NO: 11852 - DNA, 547 bp, synthetic construct; identical to SEQ ID NO: 894
  misc_feature 1..547: note = Synthetic polypeptide
  source 1..547: mol_type = other DNA

SEQ ID NO: 11853 - DNA, 394 bp, synthetic construct; identical to SEQ ID NO: 897
  misc_feature 1..394: note = Synthetic polypeptide
  source 1..394: mol_type = other DNA

SEQ ID NO: 11854 - DNA, 473 bp, synthetic construct; identical to SEQ ID NO: 903
  misc_feature 1..473: note = Synthetic polypeptide
  source 1..473: mol_type = other DNA

SEQ ID NO: 11855 - DNA, 586 bp, synthetic construct; identical to SEQ ID NO: 904
  misc_feature 1..586: note = Synthetic polypeptide
  source 1..586: mol_type = other DNA

SEQ ID NO: 11856 - DNA, 373 bp, synthetic construct; identical to SEQ ID NO: 896
  misc_feature 1..373: note = Synthetic polypeptide
  source 1..373: mol_type = other DNA

SEQ ID NO: 11857 - DNA, 460 bp, synthetic construct; identical to SEQ ID NO: 813
  misc_feature 1..460: note = Synthetic polypeptide
  source 1..460: mol_type = other DNA

SEQ ID NO: 11858 - DNA, 362 bp, synthetic construct; identical to SEQ ID NO: 827
  misc_feature 1..362: note = Synthetic polypeptide
  source 1..362: mol_type = other DNA

SEQ ID NO: 11859 - DNA, 1583 bp, synthetic construct; identical to SEQ ID NO: 828
  misc_feature 1..1583: note = Synthetic polypeptide
  source 1..1583: mol_type = other DNA

SEQ ID NO: 11860 - DNA, 1421 bp, synthetic construct; identical to SEQ ID NO: 829
  misc_feature 1..1421: note = Synthetic polypeptide
  source 1..1421: mol_type = other DNA

SEQ ID NO: 11861 - DNA, 818 bp, synthetic construct; identical to SEQ ID NO: 841
  misc_feature 1..818: note = Synthetic polypeptide
  source 1..818: mol_type = other DNA

SEQ ID NO: 11862 - DNA, 881 bp, synthetic construct; identical to SEQ ID NO: 842
  misc_feature 1..881: note = Synthetic polypeptide
  source 1..881: mol_type = other DNA

SEQ ID NO: 11863 - DNA, 738 bp, synthetic construct; identical to SEQ ID NO: 844
  misc_feature 1..738: note = Synthetic polypeptide
  source 1..738: mol_type = other DNA

SEQ ID NO: 11864 - DNA, 1595 bp, synthetic construct; identical to SEQ ID NO: 851
  misc_feature 1..1595: note = Synthetic polypeptide
  source 1..1595: mol_type = other DNA

SEQ ID NO: 11865 - DNA, 1433 bp, synthetic construct; identical to SEQ ID NO: 852
  misc_feature 1..1433: note = Synthetic polypeptide
  source 1..1433: mol_type = other DNA

SEQ ID NO: 11866 - DNA, 375 bp, synthetic construct; identical to SEQ ID NO: 860
  misc_feature 1..375: note = Synthetic polypeptide
  source 1..375: mol_type = other DNA

SEQ ID NO: 11867 - DNA, 255 bp, synthetic construct; identical to SEQ ID NO: 862
  misc_feature 1..255: note = Synthetic polypeptide
  source 1..255: mol_type = other DNA

SEQ ID NO: 11868 - DNA, 1389 bp, synthetic construct; identical to SEQ ID NO: 863
  misc_feature 1..1389: note = Synthetic polypeptide
  source 1..1389: mol_type = other DNA

SEQ ID NO: 11869 - DNA, 2094 bp, synthetic construct; identical to SEQ ID NO: 865
  misc_feature 1..2094: note = Synthetic polypeptide
  source 1..2094: mol_type = other DNA

SEQ ID NO: 11870 - DNA, 2067 bp, synthetic construct; identical to SEQ ID NO: 868
  misc_feature 1..2067: note = Synthetic polypeptide
  source 1..2067: mol_type = other DNA

SEQ ID NO: 11871 - DNA, 1593 bp, synthetic construct; identical to SEQ ID NO: 870
  misc_feature 1..1593: note = Synthetic polypeptide
  source 1..1593: mol_type = other DNA

SEQ ID NO: 11872 - DNA, 1431 bp, synthetic construct; identical to SEQ ID NO: 871
  misc_feature 1..1431: note = Synthetic polypeptide
  source 1..1431: mol_type = other DNA

SEQ ID NO: 11873 - DNA, 1002 bp, synthetic construct; identical to SEQ ID NO: 872
  misc_feature 1..1002: note = Synthetic polypeptide
  source 1..1002: mol_type = other DNA

SEQ ID NO: 11874 - DNA, 897 bp, synthetic construct; identical to SEQ ID NO: 873
  misc_feature 1..897: note = Synthetic polypeptide
  source 1..897: mol_type = other DNA

SEQ ID NO: 11875 - DNA, 836 bp, synthetic construct; identical to SEQ ID NO: 874
  misc_feature 1..836: note = Synthetic polypeptide
  source 1..836: mol_type = other DNA

SEQ ID NO: 11876 - DNA, 528 bp, synthetic construct; identical to SEQ ID NO: 875
  misc_feature 1..528: note = Synthetic polypeptide
  source 1..528: mol_type = other DNA

SEQ ID NO: 11877 - DNA, 549 bp, synthetic construct; identical to SEQ ID NO: 876
  misc_feature 1..549: note = Synthetic polypeptide
  source 1..549: mol_type = other DNA

SEQ ID NO: 11878 - DNA, 1795 bp, synthetic construct; identical to SEQ ID NO: 879
  misc_feature 1..1795: note = Synthetic polypeptide
  source 1..1795: mol_type = other DNA

SEQ ID NO: 11879 - DNA, 1171 bp, synthetic construct; identical to SEQ ID NO: 880
  misc_feature 1..1171: note = Synthetic polypeptide
  source 1..1171: mol_type = other DNA

SEQ ID NO: 11880 - DNA, 507 bp, synthetic construct; identical to SEQ ID NO: 881
  misc_feature 1..507: note = Synthetic polypeptide
  source 1..507: mol_type = other DNA

SEQ ID NO: 11881 - DNA, 1194 bp, synthetic construct; identical to SEQ ID NO: 898
  misc_feature 1..1194: note = Synthetic polypeptide
  source 1..1194: mol_type = other DNA

SEQ ID NO: 11882 - DNA, 1116 bp, synthetic construct; identical to SEQ ID NO: 899
  misc_feature 1..1116: note = Synthetic polypeptide
  source 1..1116: mol_type = other DNA

SEQ ID NO: 11883 - DNA, 824 bp, synthetic construct; identical to SEQ ID NO: 901
  misc_feature 1..824: note = Synthetic polypeptide
  source 1..824: mol_type = other DNA

SEQ ID NO: 11884 - DNA, 642 bp, synthetic construct; identical to SEQ ID NO: 902
  misc_feature 1..642: note = Synthetic polypeptide
  source 1..642: mol_type = other DNA

SEQ ID NO: 11885 - DNA, 1737 bp, synthetic construct; identical to SEQ ID NO: 905
  misc_feature 1..1737: note = Synthetic polypeptide
  source 1..1737: mol_type = other DNA

SEQ ID NO: 11886 - DNA, 284 bp, synthetic construct; identical to SEQ ID NO: 906
  misc_feature 1..284: note = Synthetic polypeptide
  source 1..284: mol_type = other DNA

SEQ ID NO: 11887 - DNA, 856 bp, synthetic construct; identical to SEQ ID NO: 907
  misc_feature 1..856: note = Synthetic polypeptide
  source 1..856: mol_type = other DNA

SEQ ID NO: 11888 - DNA, 802 bp, synthetic construct; identical to SEQ ID NO: 908
  misc_feature 1..802: note = Synthetic polypeptide
  source 1..802: mol_type = other DNA

SEQ ID NO: 11889 - DNA, 561 bp, synthetic construct; identical to SEQ ID NO: 909
  misc_feature 1..561: note = Synthetic polypeptide
  source 1..561: mol_type = other DNA

SEQ ID NO: 11890 - DNA, 582 bp, synthetic construct; identical to SEQ ID NO: 910
  misc_feature 1..582: note = Synthetic polypeptide
  source 1..582: mol_type = other DNA

SEQ ID NO: 11891 - DNA, 163 bp, synthetic construct; identical to SEQ ID NO: 480
  misc_feature 1..163: note = Synthetic polypeptide
  source 1..163: mol_type = other DNA

SEQ ID NO: 11892 - DNA, 104 bp, synthetic construct; identical to SEQ ID NO: 481
  misc_feature 1..104: note = Synthetic polypeptide
  source 1..104: mol_type = other DNA

SEQ ID NO: 11893 - DNA, 1148 bp, synthetic construct; identical to SEQ ID NO: 436
  misc_feature 1..1148: note = Synthetic polypeptide
  source 1..1148: mol_type = other DNA

SEQ ID NO: 11894 - DNA, 3021 bp, synthetic construct; identical to SEQ ID NO: 449
  misc_feature 1..3021: note = Synthetic polypeptide
  source 1..3021: mol_type = other DNA

SEQ ID NO: 11895 - DNA, 3075 bp, synthetic construct; identical to SEQ ID NO: 450
  misc_feature 1..3075: note = Synthetic polypeptide
  source 1..3075: mol_type = other DNA

SEQ ID NO: 11896 - DNA, 1143 bp, synthetic construct; identical to SEQ ID NO: 451
  misc_feature 1..1143: note = Synthetic polypeptide
  source 1..1143: mol_type = other DNA

SEQ ID NO: 11897 - DNA, 382 bp, synthetic construct; identical to SEQ ID NO: 434
  misc_feature 1..382: note = Synthetic polypeptide
  source 1..382: mol_type = other DNA

SEQ ID NO: 11898 - DNA, 252 bp, synthetic construct; identical to SEQ ID NO: 7309
  misc_feature 1..252: note = Synthetic polypeptide
  source 1..252: mol_type = other DNA

SEQ ID NO: 11899 - DNA, 1629 bp, synthetic construct; identical to SEQ ID NO: 8070
  misc_feature 1..1629: note = Synthetic polypeptide
  source 1..1629: mol_type = other DNA

SEQ ID NO: 11900 - DNA, 1500 bp, synthetic construct; identical to SEQ ID NO: 8071
  misc_feature 1..1500: note = Synthetic polypeptide
  source 1..1500: mol_type = other DNA

SEQ ID NO: 11901 - DNA, 792 bp, synthetic construct; identical to SEQ ID NO: 6418
  misc_feature 1..792: note = Synthetic polypeptide
  source 1..792: mol_type = other DNA

SEQ ID NO: 11902 - DNA, 369 bp, synthetic construct; identical to SEQ ID NO: 6419
  misc_feature 1..369: note = Synthetic polypeptide
  source 1..369: mol_type = other DNA

SEQ ID NO: 11903 - DNA, 249 bp, synthetic construct; identical to SEQ ID NO: 6420
  misc_feature 1..249: note = Synthetic polypeptide
  source 1..249: mol_type = other DNA

SEQ ID NO: 11904 - DNA, 369 bp, synthetic construct; identical to SEQ ID NO: 6421
  misc_feature 1..369: note = Synthetic polypeptide
  source 1..369: mol_type = other DNA

SEQ ID NO: 11905 - DNA, 843 bp, synthetic construct; identical to SEQ ID NO: 6422
  misc_feature 1..843: note = Synthetic polypeptide
  source 1..843: mol_type = other DNA

SEQ ID NO: 11906 - DNA, 853 bp, synthetic construct; identical to SEQ ID NO: 8074
  misc_feature 1..853: note = Synthetic polypeptide
  source 1..853: mol_type = other DNA

SEQ ID NO: 11907 - DNA, 1331 bp, synthetic construct; identical to SEQ ID NO: 550
  misc_feature 1..1331: note = Synthetic polypeptide
  source 1..1331: mol_type = other DNA

SEQ ID NO: 11908 - DNA, 1028 bp, synthetic construct; identical to SEQ ID NO: 551
  misc_feature 1..1028: note = Synthetic polypeptide
  source 1..1028: mol_type = other DNA

SEQ ID NO: 11909 - DNA, 1295 bp, synthetic construct; identical to SEQ ID NO: 553
  misc_feature 1..1295: note = Synthetic polypeptide
  source 1..1295: mol_type = other DNA

SEQ ID NO: 11910 - DNA, 1322 bp, synthetic construct; identical to SEQ ID NO: 554
  misc_feature 1..1322: note = Synthetic polypeptide
  source 1..1322: mol_type = other DNA

SEQ ID NO: 11911 - DNA, 1013 bp, synthetic construct; identical to SEQ ID NO: 555
  misc_feature 1..1013: note = Synthetic polypeptide
  source 1..1013: mol_type = other DNA

SEQ ID NO: 11912 - DNA, 2588 bp, synthetic construct; identical to SEQ ID NO: 6741
  misc_feature 1..2588: note = Synthetic polypeptide
  source 1..2588: mol_type = other DNA

SEQ ID NO: 11913 - DNA, 1964 bp, synthetic construct; identical to SEQ ID NO: 6742
  misc_feature 1..1964: note = Synthetic polypeptide
  source 1..1964: mol_type = other DNA

SEQ ID NO: 11914 - DNA, 871 bp, synthetic construct; identical to SEQ ID NO: 437
  misc_feature 1..871: note = Synthetic polypeptide
  source 1..871: mol_type = other DNA

SEQ ID NO: 11915 - DNA, 421 bp, synthetic construct; identical to SEQ ID NO: 441
  misc_feature 1..421: note = Synthetic polypeptide
  source 1..421: mol_type = other DNA

SEQ ID NO: 11916 - DNA, 638 bp, synthetic construct; identical to SEQ ID NO: 442
  misc_feature 1..638: note = Synthetic polypeptide
  source 1..638: mol_type = other DNA

SEQ ID NO: 11917 - DNA, 337 bp, synthetic construct; identical to SEQ ID NO: 443
  misc_feature 1..337: note = Synthetic polypeptide
  source 1..337: mol_type = other DNA

SEQ ID NO: 11918 - DNA, 1052 bp, synthetic construct; identical to SEQ ID NO: 447
  misc_feature 1..1052: note = Synthetic polypeptide
  source 1..1052: mol_type = other DNA

SEQ ID NO: 11919 - DNA, 1118 bp, synthetic construct; identical to SEQ ID NO: 448
  misc_feature 1..1118: note = Synthetic polypeptide
  source 1..1118: mol_type = other DNA

SEQ ID NO: 11920 - DNA, 742 bp, synthetic construct; identical to SEQ ID NO: 6357
  misc_feature 1..742: note = Synthetic polypeptide
  source 1..742: mol_type = other DNA

SEQ ID NO: 11921 - DNA, 590 bp, synthetic construct; identical to SEQ ID NO: 6358
  misc_feature 1..590: note = Synthetic polypeptide
  source 1..590: mol_type = other DNA

SEQ ID NO: 11922 - DNA, 577 bp, synthetic construct; identical to SEQ ID NO: 6359
  misc_feature 1..577: note = Synthetic polypeptide
  source 1..577: mol_type = other DNA

SEQ ID NO: 11923 - DNA, 430 bp, synthetic construct; identical to SEQ ID NO: 6360
  misc_feature 1..430: note = Synthetic polypeptide
  source 1..430: mol_type = other DNA

SEQ ID NO: 11924 - DNA, 670 bp, synthetic construct; identical to SEQ ID NO: 6361
  misc_feature 1..670: note = Synthetic polypeptide
  source 1..670: mol_type = other DNA

SEQ ID NO: 11925 - DNA, 906 bp, synthetic construct
  misc_feature 1..906: note = Synthetic polypeptide
  source 1..906: mol_type = other DNA
catgcctttgctgctgtccttggtcagaatgactcatcattcgtgtaattcttgctacttgctcaatccagttcaaatgctgctccttctcagaagccttccctgttctctccctccctgcacagataattgttttttctggctctggcccttcatcactctgctgttgcaccttctgcagtgtctgtgttctgatcagactgtgggctactggaatgcaggcaccagcttgagtcatccttgtgaatctggggtcttctgccgatttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctga

SEQ ID NO: 11926 - DNA, 1216 bp, synthetic construct; identical to SEQ ID NO: 6819
  misc_feature 1..1216: note = Synthetic polypeptide
  source 1..1216: mol_type = other DNA

SEQ ID NO: 11927 - DNA, 510 bp, synthetic construct; identical to SEQ ID NO: 6820
  misc_feature 1..510: note = Synthetic polypeptide
  source 1..510: mol_type = other DNA

SEQ ID NO: 11928 - DNA, 1188 bp, synthetic construct; identical to SEQ ID NO: 8232
  misc_feature 1..1188: note = Synthetic polypeptide
  source 1..1188: mol_type = other DNA

SEQ ID NO: 11929 - DNA, 337 bp, synthetic construct; identical to SEQ ID NO: 6393
  misc_feature 1..337: note = Synthetic polypeptide
  source 1..337: mol_type = other DNA

SEQ ID NO: 11930 - DNA, 2537 bp, synthetic construct; identical to SEQ ID NO: 7357
  misc_feature 1..2537: note = Synthetic polypeptide
  source 1..2537: mol_type = other DNA

SEQ ID NO: 11931 - DNA, 1913 bp, synthetic construct; identical to SEQ ID NO: 7358
  misc_feature 1..1913: note = Synthetic polypeptide
  source 1..1913: mol_type = other DNA

SEQ ID NO: 11932 - DNA, 1871 bp, synthetic construct; identical to SEQ ID NO: 10627
  misc_feature 1..1871: note = Synthetic polypeptide
  source 1..1871: mol_type = other DNA

SEQ ID NO: 11933 - DNA, 1625 bp, synthetic construct; identical to SEQ ID NO: 10628
  misc_feature 1..1625: note = Synthetic polypeptide
  source 1..1625: mol_type = other DNA

SEQ ID NO: 11934 - DNA, 446 bp, synthetic construct; identical to SEQ ID NO: 10629
  misc_feature 1..446: note = Synthetic polypeptide
  source 1..446: mol_type = other DNA

SEQ ID NO: 11935 - DNA, 594 bp, synthetic construct; identical to SEQ ID NO: 455
  misc_feature 1..594: note = Synthetic polypeptide
  source 1..594: mol_type = other DNA

SEQ ID NO: 11936 - DNA, 1031 bp, synthetic construct; identical to SEQ ID NO: 456
  misc_feature 1..1031: note = Synthetic polypeptide
  source 1..1031: mol_type = other DNA

SEQ ID NO: 11937 - DNA, 1019 bp, synthetic construct; identical to SEQ ID NO: 8194
  misc_feature 1..1019: note = Synthetic polypeptide
  source 1..1019: mol_type = other DNA

SEQ ID NO: 11938 - DNA, 962 bp, synthetic construct; identical to SEQ ID NO: 8195
  misc_feature 1..962: note = Synthetic polypeptide
  source 1..962: mol_type = other DNA

SEQ ID NO: 11939 - DNA, 287 bp, synthetic construct; identical to SEQ ID NO: 8196
  misc_feature 1..287: note = Synthetic polypeptide
  source 1..287: mol_type = other DNA

SEQ ID NO: 11940 - DNA, 80 bp, synthetic construct; identical to SEQ ID NO: 6364
  misc_feature 1..80: note = Synthetic polypeptide
  source 1..80: mol_type = other DNA

SEQ ID NO: 11941 - DNA, 217 bp, synthetic construct; identical to SEQ ID NO: 6365
  misc_feature 1..217: note = Synthetic polypeptide
  source 1..217: mol_type = other DNA

SEQ ID NO: 11942 - DNA, 220 bp, synthetic construct; identical to SEQ ID NO: 7991
  misc_feature 1..220: note = Synthetic polypeptide
  source 1..220: mol_type = other DNA

SEQ ID NO: 11943 - DNA, 334 bp, synthetic construct; identical to SEQ ID NO: 7992
  misc_feature 1..334: note = Synthetic polypeptide
  source 1..334: mol_type = other DNA

SEQ ID NO: 11944 - DNA, 520 bp, synthetic construct; identical to SEQ ID NO: 6424
  misc_feature 1..520: note = Synthetic polypeptide
  source 1..520: mol_type = other DNA

SEQ ID NO: 11945 - DNA, 1452 bp, synthetic construct; identical to SEQ ID NO: 7300
  misc_feature 1..1452: note = Synthetic polypeptide
  source 1..1452: mol_type = other DNA

SEQ ID NO: 11946 - DNA, 1149 bp, synthetic construct; identical to SEQ ID NO: 7301
  misc_feature 1..1149: note = Synthetic polypeptide
  source 1..1149: mol_type = other DNA

SEQ ID NO: 11947 - DNA, 1416 bp, synthetic construct; identical to SEQ ID NO: 7302
  misc_feature 1..1416: note = Synthetic polypeptide
  source 1..1416: mol_type = other DNA

SEQ ID NO: 11948 - DNA, 1443 bp, synthetic construct; identical to SEQ ID NO: 7303
  misc_feature 1..1443: note = Synthetic polypeptide
  source 1..1443: mol_type = other DNA

SEQ ID NO: 11949 - DNA, 1134 bp, synthetic construct; identical to SEQ ID NO: 7304
  misc_feature 1..1134: note = Synthetic polypeptide
  source 1..1134: mol_type = other DNA

SEQ ID NO: 11950 - DNA, 839 bp, synthetic construct; identical to SEQ ID NO: 9123
  misc_feature 1..839: note = Synthetic polypeptide
  source 1..839: mol_type = other DNA

SEQ ID NO: 11951 - DNA, 1854 bp, synthetic construct; identical to SEQ ID NO: 6613
  misc_feature 1..1854: note = Synthetic polypeptide
  source 1..1854: mol_type = other DNA

SEQ ID NO: 11952 - DNA, 238 bp, synthetic construct; identical to SEQ ID NO: 6628
  misc_feature 1..238: note = Synthetic polypeptide
  source 1..238: mol_type = other DNA

SEQ ID NO: 11953 - DNA, 486 bp, synthetic construct; identical to SEQ ID NO: 7296
  misc_feature 1..486: note = Synthetic polypeptide
  source 1..486: mol_type = other DNA

SEQ ID NO: 11954 - DNA, 3055 bp, synthetic construct; identical to SEQ ID NO: 709
  misc_feature 1..3055: note = Synthetic polypeptide
  source 1..3055: mol_type = other DNA

SEQ ID NO: 11955 - DNA, 3058 bp, synthetic construct; identical to SEQ ID NO: 710
  misc_feature 1..3058: note = Synthetic polypeptide
  source 1..3058: mol_type = other DNA

SEQ ID NO: 11956 - DNA, 427 bp, synthetic construct; identical to SEQ ID NO: 573
  misc_feature 1..427: note = Synthetic polypeptide
  source 1..427: mol_type = other DNA

SEQ ID NO: 11957 - DNA, 365 bp, synthetic construct; identical to SEQ ID NO: 6504
  misc_feature 1..365: note = Synthetic polypeptide
  source 1..365: mol_type = other DNA

SEQ ID NO: 11958 - DNA, 509 bp, synthetic construct; identical to SEQ ID NO: 6505
  misc_feature 1..509: note = Synthetic polypeptide
  source 1..509: mol_type = other DNA

SEQ ID NO: 11959 - DNA, 851 bp, synthetic construct; identical to SEQ ID NO: 8176
  misc_feature 1..851: note = Synthetic polypeptide
  source 1..851: mol_type = other DNA

SEQ ID NO: 11960 - DNA, 1385 bp, synthetic construct; identical to SEQ ID NO: 8177
  misc_feature 1..1385: note = Synthetic polypeptide
  source 1..1385: mol_type = other DNA

SEQ ID NO: 11961 - DNA, 299 bp, synthetic construct; identical to SEQ ID NO: 485
  misc_feature 1..299: note = Synthetic polypeptide
  source 1..299: mol_type = other DNA

SEQ ID NO: 11962 - DNA, 576 bp, synthetic construct
  misc_feature 1..576: note = Synthetic polypeptide
  source 1..576: mol_type = other DNA
tgatatggtttggctgtgtcgccatccaaatctcatcttgaatttccacatgttgtgggagggactcagtgggaggtaattgaaccatgggggcaggtctttcccatgctgttctcctgatagtgaataagtctcatgagatctgatggttttataaggcggagcttccctgcacaagctctctctctgcttgctgccatgcacgtaagatgtgatttgctcttctttatcttccaccatgattgtgaggcttccccagccacaaggaactaccaaagtctgcagtgtaacaaaatgctcagattctgctgtctctggccaatgggaggtggtcactatgcatgaagagaagcaagagtcagccatctttgatgctgtcatggtctgcactggctttcttactaatccttatttgccactggattcctttccaggtattaatgcctttaaaggccagtactttcatagccggcaatataagcatccagatatatttaaggacaagagagtccttgtgattggaatgggaaattctggcacagacattgctgtggaggccagccacctggcggaaaa

SEQ ID NO: 11963 - DNA, 1549 bp, synthetic construct
  misc_feature 1..1549: note = Synthetic polypeptide
  source 1..1549: mol_type = other DNA
tgatatggtttggctgtgtcgccatccaaatctcatcttgaatttccacatgttgtgggagggactcagtgggaggtaattgaaccatgggggcaggtctttcccatgctgttctcctgatagtgaataagtctcatgagatctgatggttttataaggcggagcttccctgcacaagctctctctctgcttgctgccatgcacgtaagatgtgatttgctcttctttatcttccaccatgattgtgaggcttccccagccacaaggaactaccaaagtctgcagtgtaacaaaatgctcagattctgctgtctctggccaatgggaggtggtcactatgcatgaagagaagcaagagtcagccatctttgatgctgtcatggtctgcactggctttcttactaatccttatttgccactggattcctttccaggtattaatgcctttaaaggccagtactttcatagccggcaatataagcatccagatatatttaaggacaagagagtccttgtgattggaatgggaaattctggcacagacattgctgtggaggccagccacctggcggaaaaggtgttcctcagcaccaccggagggggatgggtgatcagccgaatctttgactcgggctacccatgggacatggtgttcatgacacgctttcagaacatgttgagaaattccctcccaaccccaattgtgacttggttgatggagcgaaagataaacaactggctcaatcatgcaaattacggcttaataccagaagacaggactcagctgaaagagtttgtgctaaatgatgagctcccaggacgcatcatcactgggaaagtgttcatcaggccaagcataaaagaggtaaaggaaaactctgtcatatttaacaatacttcaaaggaagagcctattgacatcattgtctttgccactggatacacatttgctttccccttccttgatgagtctgtagtgaaagttgaagatggccaggcctcactgtacaagtatatcttccctgcacatctgcaaaagccaaccctggccattattggcctcatcaaacccttgggctccatgatacctacaggagaaacacaagctcggtgggctgttcgagtcctgaaaggtgtaaataagttaccaccaccaagtgtcatgatagaggaaattaatgcaaggaaagaaaacaagcccagttggtttggcttgtgctactgcaaggctttacaatcagattatatcacatacatagatgaactcctgacctatatcaatgcaaaacccaacctgttctctatgctcctaacggatccacatctggctctgaccgtcttctttggcccatgctcaccataccagttccgcttgactggcccaggaaaatgggaaggagccagaaatgccatcatgacccagtgggaccgaacattcaaggtcatcaaagctcgagttgtacaagagtctccatctccctttgaaagttttcttaaagtctttagctttctggctttgcttgtggctatttttctgattttcctataa

SEQ ID NO: 11964 - DNA, 259 bp, synthetic construct; identical to SEQ ID NO: 7895
  misc_feature 1..259: note = Synthetic polypeptide
  source 1..259: mol_type = other DNA

SEQ ID NO: 11965 - DNA, 310 bp, synthetic construct; identical to SEQ ID NO: 7896
  misc_feature 1..310: note = Synthetic polypeptide
  source 1..310: mol_type = other DNA

SEQ ID NO: 11966 - DNA, 383 bp, synthetic construct; identical to SEQ ID NO: 8181
  misc_feature 1..383: note = Synthetic polypeptide
  source 1..383: mol_type = other DNA

SEQ ID NO: 11967 - DNA, 637 bp, synthetic construct
  misc_feature 1..637: note = Synthetic polypeptide
  source 1..637: mol_type = other DNA
actctgttcttcaagactttgcttggttgtcagctccccggaaactcttggctgactcacctgaggttgcgggaacagtgccctgagctacgagctgttcctcggaggcttccctaatgtgaccagtgtggactactcatcagtcgtggtggctgccatgcaggctcgccatgcccatgtgccgcagctgcgctgggagaccatggatgtgcggaagctggacttccccagtgcttcttttgatgtggtgctcgagaagggcacgctggatgccctgctggctggggaacgagatccctggaccgtgtcctctgaaggtgtccacactgtggaccaggtgttgagtgaggtgagccgcgtgcttgtccctggaggccggtttatctcaatgacttctgctgccccccactttcggaccagacactatgcccaagcctattatggctggtccctgaggcatgctacctatggcagcggtttccacttccatctctacctcatgcacaagggcgggaagctcagtgtggcccagctggctctgggggcccaaatcctctcaccccccagacctcccacctcaccttgcttccttcaggactcagatcatgaggacttccttagtgccattcagctctga

SEQ ID NO: 11968 - DNA, 2521 bp, synthetic construct
  misc_feature 1..2521: note = Synthetic polypeptide
  source 1..2521: mol_type = other DNA
actctgttcttcaagactttgcttggttgtcagctccccggaaactcttggctgactcacctgaggttgcgggaacagtgccctgagctacgagctgttcctcggaggcttccctaatgtgaccagtgtggactactcatcagtcgtggtggctgccatgcaggctcgccatgcccatgtgccgcagctgcgctgggagaccatggatgtgcggaagctggacttccccagtgcttcttttgatgtggtgctcgagaagggcacgctggatgccctgctggctggggaacgagatccctggaccgtgtcctctgaaggtgtccacactgtggaccaggtgttgagtgaggtgggattccagaaggggacaagacagctgttaggctcacgcacgcagctggagctggtcttagcaggtgcctctctactgctggctgcactgcttctgggctgccttgtggccctaggggtccagtaccacagagacccatcccacagcacctgccttacagaggcctgcattcgagtggctggaaaaatcctggagtccctggaccgaggggtgagcccctgtgaggacttttaccagttctcctgtgggggctggattcggaggaaccccctgcccgatgggcgttctcgctggaacaccttcaacagcctctgggaccaaaaccaggccatactgaagcacctgcttgaaaacaccaccttcaactccagcagtgaagctgagcagaagacacagcgcttctacctatcttgcctacaggtggagcgcattgaggagctgggagcccagccactgagagacctcattgagaagattggtggttggaacattacggggccctgggaccaggacaactttatggaggtgttgaaggcagtagcagggacctacagggccaccccattcttcaccgtctacatcagtgccgactctaagagttccaacagcaatgttatccaggtggaccagtctgggctctttctgccctctcgggattactacttaaacagaactgccaatgagaaagtgctcactgcctatctggattacatggaggaactggggatgctgctgggtgggcggcccacctccacgagggagcagatgcagcaggtgctggagttggagatacagctggccaacatcacagtgccccaggaccagcggcgcgacgaggagaagatctaccacaagatgagcatttcggagctgcaggctctggcgccctccatggactggcttgagttcctgtctttcttgctgtcaccattggagttgagtgactctgagcctgtggtggtgtatgggatggattatttgcagcaggtgtcagagctcatcaaccgcacggaaccaagcatcctgaacaattacctgatctggaacctggtgcaaaagacaacctcaagcctggaccgacgctttgagtctgcacaagagaagctgctggagaccctctatggcactaagaagtcctgtgtgccgaggtggcagacctgcatctccaacacggatgacgcccttggctttgctttggggtccctcttcgtgaaggccacgtttgaccggcaaagcaaagaaattgcagaggggatgatcagcgaaatccggaccgcatttgaggaggccctgggacagctggtttggatggatgagaagacccgccaggcagccaaggagaaagcagatgccatctatgatatgattggtttcccagactttatcctggagcccaaagagctggatgatgtttatgacgggtacgaaatttctgaagattctttcttccaaaacatgttgaatttgtacaacttctctgccaaggttatggctgaccagctccgcaagcctcccagccgagaccagtggagcatgaccccccagacagtgaatgcctactaccttccaactaagaatgagatcgtcttccccgctggcatcctgcaggcccccttctatgcccgcaaccaccccaaggccctgaacttcggtggcatcggtgtggtcatgggccatgagttgacgcatgcctttgatgaccaagggcgcgagtatgacaaagaagggaacctgcggccctggtggcagaatgagtccctggcagccttccggaaccacacggcctgcatggaggaacagtacaatcaataccaggtcaatggggagaggctcaacggccgccagacgctgggggagaacattgctgacaacggggggctgaaggctgcctacaatgcttacaaagcatggctgagaaagcatggggaggagcagcaactgccagccgtggggctcaccaaccaccagctcttcttcgtgggatttgcccaggtgtggtgctcggtccgcacaccagagagctctcacgaggggctggtgaccgacccccacagccctgcccgcttccgcgtgctgggcactctctccaactcccgtgacttcctgcggcacttcggctgccctgtcggctcccccatgaacccagggcagctgtgtgaggtgtggtag

SEQ ID NO: 11969 - DNA, 1267 bp, synthetic construct; identical to SEQ ID NO: 463
  misc_feature 1..1267: note = Synthetic polypeptide
  source 1..1267: mol_type = other DNA

SEQ ID NO: 11970 - DNA, 2672 bp, synthetic construct; identical to SEQ ID NO: 6621
  misc_feature 1..2672: note = Synthetic polypeptide
  source 1..2672: mol_type = other DNA

SEQ ID NO: 11971 - DNA, 1767 bp, synthetic construct; identical to SEQ ID NO: 6622
  misc_feature 1..1767: note = Synthetic polypeptide
  source 1..1767: mol_type = other DNA

SEQ ID NO: 11972 - DNA, 1692 bp, synthetic construct; identical to SEQ ID NO: 6623
  misc_feature 1..1692: note = Synthetic polypeptide
  source 1..1692: mol_type = other DNA

SEQ ID NO: 11973 - DNA, 2448 bp, synthetic construct; identical to SEQ ID NO: 6618
  misc_feature 1..2448: note = Synthetic polypeptide
  source 1..2448: mol_type = other DNA

SEQ ID NO: 11974 - DNA, 1543 bp, synthetic construct; identical to SEQ ID NO: 6619
  misc_feature 1..1543: note = Synthetic polypeptide
  source 1..1543: mol_type = other DNA

SEQ ID NO: 11975 - DNA, 1468 bp, synthetic construct; identical to SEQ ID NO: 6620
  misc_feature 1..1468: note = Synthetic polypeptide
  source 1..1468: mol_type = other DNA

SEQ ID NO: 11976 - DNA, 1516 bp, synthetic construct; identical to SEQ ID NO: 534
  misc_feature 1..1516: note = Synthetic polypeptide
  source 1..1516: mol_type = other DNA

SEQ ID NO: 11977 - DNA, 591 bp, synthetic construct; identical to SEQ ID NO: 539
  misc_feature 1..591: note = Synthetic polypeptide
  source 1..591: mol_type = other DNA

SEQ ID NO: 11978 - DNA, 482 bp, synthetic construct; identical to SEQ ID NO: 540
  misc_feature 1..482: note = Synthetic polypeptide
  source 1..482: mol_type = other DNA

SEQ ID NO: 11979 - DNA, 444 bp, synthetic construct; identical to SEQ ID NO: 541
  misc_feature 1..444: note = Synthetic polypeptide
  source 1..444: mol_type = other DNA

SEQ ID NO: 11980 - DNA, 334 bp, synthetic construct; identical to SEQ ID NO: 533
  misc_feature 1..334: note = Synthetic polypeptide
  source 1..334: mol_type = other DNA

SEQ ID NO: 11981 - DNA, 38 bp, synthetic construct; identical to SEQ ID NO: 543
  misc_feature 1..38: note = Synthetic polypeptide
  source 1..38: mol_type = other DNA

SEQ ID NO: 11982 - DNA, 245 bp, synthetic construct; identical to SEQ ID NO: 542
  misc_feature 1..245: note = Synthetic polypeptide
  source 1..245: mol_type = other DNA

SEQ ID NO: 11983 - DNA, 934 bp, synthetic construct
  misc_feature 1..934: note = Synthetic polypeptide
  source 1..934: mol_type = other DNA
cattcctctgacttctgctccagtcactctactgaaactcctctcaatcaggtccactggctattctgaggtgatagttgtcgttggaggatgtgagcgagttggaggatttaatcttccatacactgagtgctacgatcctgtaacaggagaatggaagtctttggctaagcttccagaatttaccaaatcagagtatgcagtctgtgctctaaggaatgacattcttgtttcaggtggaagaatcaacagccgtgatgtctggatttataactcacagttaaatatttggatcagagttgcctctctcaataaaggcagatggcgtcacaaaatggctgtcctccttggtaaagtatatgttgtcggtggctatgatgggcaaaacagacttagcagcgtagaatgttatgattccttttcaaatcgatggactgaagttgctccccttaaggaagccgtgagttctcctgcagtgactagctgtgtaggcaaactgtttgtgattggtggaggacctgatgataatacttgttctgataaggttcaatcttatgatccagaaaccaattcttggctacttcgtgcagctatcccaattgccaaaaggtgtataacagctgtatccctaaacaacctgatctatgttgccggtggactgaccaaggcaatatactgttacgatccagttgaagattactggatgcacgtacagaatacattcagccgtcaggaaaactgtggtatgtctgtgtgtaatggtaaaatatatatcctgggcggaagacgggaaaatggagaagccacagacactattctctgttatgatcctgcaacaagtatcatcacaggggtagctgcaatgcccaggccagtgtcctatcatggctgtgtgactattcatagatacaatgagaaatgctttaaactctga

SEQ ID NO: 11984 - DNA, 745 bp, synthetic construct
  misc_feature 1..745: note = Synthetic polypeptide
  source 1..745: mol_type = other DNA
cattcctctgacttctgctccagtcactctactgaaactcctctcaatcaggtccactggctattctgaggtgatagttgtcgttggaggatgtgagcgagttggaggatttaatcttccatacactgagtgctacgatcctgtaacaggagaatggaagtctttggctaagcttccagaatttaccaaatcagagtatgcagtctgtgctctaaggaatgacattcttgtttcaggtggaagaatcaacagccgtgatgtctggatttataactcacagttaaatatttggatcagagttgcctctctcaataaaggcagatggcgtcacaaaatggctgtcctccttggtaaagtatatgttgtcggtggctatgatgggcaaaacagacttagcagcgtagaatgttatgattccttttcaaatcgatggactgaagttgctccccttaaggaagccgtgagttctcctgcagtgactagctgtgtaggcaaactgtttgtgattggtggaggacctgatgataatacttgttctgataaggttcaatcttatgatccagaaaccaattcttggctacttcgtgcagctatcccaattgccaaaaggtgtataacagctgtatccctaaacaacctgatctatgttgccggtggactgaccaaggcaatatactgttacgatccagttgaagattactggatgcacgtacagaatacattcagccgtcaggtaataacataa

SEQ ID NO: 11985 - DNA, 545 bp, synthetic construct; identical to SEQ ID NO: 7336
  misc_feature 1..545: note = Synthetic polypeptide
  source 1..545: mol_type = other DNA

SEQ ID NO: 11986 - DNA, 1409 bp, synthetic construct
  misc_feature 1..1409: note = Synthetic polypeptide
  source 1..1409: mol_type = other DNA
ccactaaaaggtctagaaacaatgaccaacccagtatgaatgaacattcttagtgcccaaattatgatcttgaaataccatttacccatttagagaaactggggtttcttagggaaatggctaattctaggttttagggcaggaaatgtataggatgatcctagaatgttgtgataacagataacatgaaagtttatcaaagtctactggagtcatcttgaaaggacttaggatctaacttgaagaggctcccactgaccaaagagggataatttgagtttcagtaaggtaagaattgcaatagattaaaactcataaatatatttaaatccaggcactcataatgttactaaaaaggaaacctacttggctaaattaggagaattgataagaaatcagttcattgtattgaaaactggataaaggaaaaaaataagtatttgtcctgcctttcctgtaccactagataaccatatagtaggtgacagaaatatatctttataaaattatttcaacttacaaatgaaaacaaaatgataggatagcatcattttacaaccccttatggtctaggtactgagcatcaataactgctgacatcagaaacaaaaaccaagcctcctgacaaaagaacattacccaccaccaaagtttgccaaaaggataaaatccaaaattgatcaagcctctggatatagctgcaatttgcaagaaatactgaaaacaagcggcagtacatacctgtgaaaatgaagagcaaagccttctggatcttttcttgggagtatgccatgatgtatgtgggaagcctagtggtaatcatttgcctctccttcttccttctcagctcttgggatttcatccccgcagtctatggctttatactttctgttccagatctcactccaaacattggtcttttctggtacttctttgcagagatgtttgagcacttcagcctcttctttgtatgtgtgtttcagatcaacgtcttcttctacaccatccccttagccataaagctaaaggagcaccccatcttcttcatgtttatccagatcgctgtcatcgccatctttaagtcctacccgacagtgggggacgtggcgctctacatggccttcttccccgtgtggaaccatctctacagattcctgagaaacatctttgtcctcacctgcatcatcatcgtctgttccctgctcttccctgtcctgtggcacctctggatttatgcaggaagtgccaactctaatttcttttatgccatcacactgaccttcaacgttgggcagatcctgctcatctctgattacttctatgccttcctgcggcgggagtactacctcacacatggcctctacttgaccgccaaggatggcacagaggccatgctcgtgctcaagtag

SEQ ID NO: 11987 - DNA, 1373 bp, synthetic construct
  misc_feature 1..1373: note = Synthetic polypeptide
  source 1..1373: mol_type = other DNA
ccactaaaaggtctagaaacaatgaccaacccagtatgaatgaacattcttagtgcccaaattatgatcttgaaataccatttacccatttagagaaactggggtttcttagggaaatggctaattctaggttttagggcaggaaatgtataggatgatcctagaatgttgtgataacagataacatgaaagtttatcaaagtctactggagtcatcttgaaaggacttaggatctaacttgaagaggctcccactgaccaaagagggataatttgagtttcagtaaggtaagaattgcaatagattaaaactcataaatatatttaaatccaggcactcataatgttactaaaaaggaaacctacttggctaaattaggagaattgataagaaatcagttcattgtattgaaaactggataaaggaaaaaaataagtatttgtcctgcctttcctgtaccactagataaccatatagtaggtgacagaaatatatctttataaaattatttcaacttacaaatgaaaacaaaatgataggatagcatcattttacaaccccttatggtctaggtactgagcatcaataactgctgacatcagaaacaaaaaccaagcctcctgacaaaagaacattacccaccaccaaagtttgccaaaaggataaaatccaaaattgatcaagcctctggatatagctgcaatttgcaagaaatactgaaaacaagcggcagtacatacctgtgaaaatgaagagcaaagccttctggatcttttcttgggagtatgccatgatgtatgtgggaagcctagtggtaatcatttgcctctccttcttccttctcagctcttgggatttcatccccgcagtctatggctttatactttctgttccagatctcactccaaacattggtcttttctggtacttctttgcagagatgtttgagcacttcagcctcttctttgtatgtgtgtttcagatcaacgtcttcttctacaccatccccttagccataaagctaaaggagcaccccatcttcttcatgtttatccagatcgctgtcatcgccatctttaagtcctacccgacagtgggggacgtggcgctctacatggccttcttccccgtgtggaaccatctctacagattcctgagaaacatctttgtcctcacctgcatcatcatcgtctgttccctgctcttccctgtcctgtggcacctctggatttatgcaggaagtgccaactctaatttcttttatgccatcacactgaccttcaacgttgggcagatgggcttctgtggtgatagaatggcaggtacttgtcctgaggccatcagagctgctggtgacaggacaccttcctga

SEQ ID NO: 11988 - DNA, 1185 bp, synthetic construct
  misc_feature 1..1185: note = Synthetic polypeptide
  source 1..1185: mol_type = other DNA
ccactaaaaggtctagaaacaatgaccaacccagtatgaatgaacattcttagtgcccaaattatgatcttgaaataccatttacccatttagagaaactggggtttcttagggaaatggctaattctaggttttagggcaggaaatgtataggatgatcctagaatgttgtgataacagataacatgaaagtttatcaaagtctactggagtcatcttgaaaggacttaggatctaacttgaagaggctcccactgaccaaagagggataatttgagtttcagtaaggtaagaattgcaatagattaaaactcataaatatatttaaatccaggcactcataatgttactaaaaaggaaacctacttggctaaattaggagaattgataagaaatcagttcattgtattgaaaactggataaaggaaaaaaataagtatttgtcctgcctttcctgtaccactagataaccatatagtaggtgacagaaatatatctttataaaattatttcaacttacaaatgaaaacaaaatgataggatagcatcattttacaaccccttatggtctaggtactgagcatcaataactgctgacatcagaaacaaaaaccaagcctcctgacaaaagaacattacccaccaccaaagtttgccaaaaggataaaatccaaaattgatcaagcctctggatatagctgcaatttgcaagaaatactgaaaacaagcggcagtacatacctgtgaaaatgaagagcaaagccttctggatcttttcttgggagtatgccatgatatcaacgtcttcttctacaccatccccttagccataaagctaaaggagcaccccatcttcttcatgtttatccagatcgctgtcatcgccatctttaagtcctacccgacagtgggggacgtggcgctctacatggccttcttccccgtgtggaaccatctctacagattcctgagaaacatctttgtcctcacctgcatcatcatcgtctgttccctgctcttccctgtcctgtggcacctctggatttatgcaggaagtgccaactctaatttcttttatgccatcacactgaccttcaacgttgggcagatcctgctcatctctgattacttctatgccttcctgcggcgggagtactacctcacacatggcctctacttgaccgc

SEQ ID NO: 11989 - DNA, 448 bp, synthetic construct; identical to SEQ ID NO: 11129
  misc_feature 1..448: note = Synthetic polypeptide
  source 1..448: mol_type = other DNA

SEQ ID NO: 11990 - DNA, 374 bp, synthetic construct; identical to SEQ ID NO: 11130
  misc_feature 1..374: note = Synthetic polypeptide
  source 1..374: mol_type = other DNA

SEQ ID NO: 11991 - DNA, 543 bp, synthetic construct; identical to SEQ ID NO: 6496
  misc_feature 1..543: note = Synthetic polypeptide
  source 1..543: mol_type = other DNA

SEQ ID NO: 11992 - DNA, 378 bp, synthetic construct; identical to SEQ ID NO: 6497
  misc_feature 1..378: note = Synthetic polypeptide
  source 1..378: mol_type = other DNA

SEQ ID NO: 11993 - DNA, 267 bp, synthetic construct; identical to SEQ ID NO: 6498
  misc_feature 1..267: note = Synthetic polypeptide
  source 1..267: mol_type = other DNA

SEQ ID NO: 11994 - DNA, 416 bp, synthetic construct; identical to SEQ ID NO: 6499
  misc_feature 1..416: note = Synthetic polypeptide
  source 1..416: mol_type = other DNA

SEQ ID NO: 11995 - DNA, 162 bp, synthetic construct; identical to SEQ ID NO: 6500
  misc_feature 1..162: note = Synthetic polypeptide
  source 1..162: mol_type = other DNA

SEQ ID NO: 11996 - DNA, 923 bp, synthetic construct
  misc_feature 1..923: note = Synthetic polypeptide
  source 1..923: mol_type = other DNA
catgcctttgctgctgtccttggtcagaatgactcatcattcgtgtaattcttgctacttgctcaatccagttcaaatgctgctccttctcagaagccttccctgttctctccctccctgcacagataattgttttttctggctctggcccttcatcactctgctgttgcaccttctgcagtgtctgtgttctgatcagactgtgggctactggaatgcaggcaccagcttgagtcatccttgtgaatctggggtcttctgccgagtgggtggttgataagttttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctga

SEQ ID NO: 11997 - DNA, 883 bp, synthetic construct; identical to SEQ ID NO: 9631
  misc_feature 1..883: note = Synthetic polypeptide
  source 1..883: mol_type = other DNA

SEQ ID NO: 11998 - DNA, 1023 bp, synthetic construct; identical to SEQ ID NO: 611
  misc_feature 1..1023: note = Synthetic polypeptide
  source 1..1023: mol_type = other DNA

SEQ ID NO: 11999 - DNA, 1022 bp, synthetic construct; identical to SEQ ID NO: 590
  misc_feature 1..1022: note = Synthetic polypeptide
  source 1..1022: mol_type = other DNA

SEQ ID NO: 12000 - DNA, 347 bp, synthetic construct; identical to SEQ ID NO: 591
  misc_feature 1..347: note = Synthetic polypeptide
  source 1..347: mol_type = other DNA

SEQ ID NO: 12001 - DNA, 1109 bp, synthetic construct; identical to SEQ ID NO: 592
  misc_feature 1..1109: note = Synthetic polypeptide
  source 1..1109: mol_type = other DNA

SEQ ID NO: 12002 - DNA, 85 bp, synthetic construct; identical to SEQ ID NO: 601
  misc_feature 1..85: note = Synthetic polypeptide
  source 1..85: mol_type = other DNA

SEQ ID NO: 12003 - DNA, 269 bp, synthetic construct; identical to SEQ ID NO: 600
  misc_feature 1..269: note = Synthetic polypeptide
  source 1..269: mol_type = other DNA

SEQ ID NO: 12004 - DNA, 1211 bp, synthetic construct; identical to SEQ ID NO: 526
  misc_feature 1..1211: note = Synthetic polypeptide
  source 1..1211: mol_type = other DNA

SEQ ID NO: 12005 - DNA, 1133 bp, synthetic construct; identical to SEQ ID NO: 527
  misc_feature 1..1133: note = Synthetic polypeptide
  source 1..1133: mol_type = other DNA

SEQ ID NO: 12006 - DNA, 841 bp, synthetic construct; identical to SEQ ID NO: 529
  misc_feature 1..841: note = Synthetic polypeptide
  source 1..841: mol_type = other DNA

SEQ ID NO: 12007 - DNA, 659 bp, synthetic construct; identical to SEQ ID NO: 530
  misc_feature 1..659: note = Synthetic polypeptide
  source 1..659: mol_type = other DNA

SEQ ID NO: 12008 - DNA, 1636 bp, synthetic construct; identical to SEQ ID NO: 531
  misc_feature 1..1636: note = Synthetic polypeptide
  source 1..1636: mol_type = other DNA

SEQ ID NO: 12009 - DNA, 1328 bp, synthetic construct; identical to SEQ ID NO: 532
  misc_feature 1..1328: note = Synthetic polypeptide
  source 1..1328: mol_type = other DNA

SEQ ID NO: 12010 - DNA, 852 bp, synthetic construct; identical to SEQ ID NO: 753
  misc_feature 1..852: note = Synthetic polypeptide
  source 1..852: mol_type = other DNA

SEQ ID NO: 12011 - DNA, 809 bp, synthetic construct; identical to SEQ ID NO: 8505
  misc_feature 1..809: note = Synthetic polypeptide
  source 1..809: mol_type = other DNA

SEQ ID NO: 12012 - DNA, 809 bp, synthetic construct; identical to SEQ ID NO: 8506
  misc_feature 1..809: note = Synthetic polypeptide
  source 1..809: mol_type = other DNA

SEQ ID NO: 12013 - DNA, 809 bp, synthetic construct; identical to SEQ ID NO: 8586
  misc_feature 1..809: note = Synthetic polypeptide
  source 1..809: mol_type = other DNA

SEQ ID NO: 12014 - DNA, 809 bp, synthetic construct; identical to SEQ ID NO: 8587
  misc_feature 1..809: note = Synthetic polypeptide
  source 1..809: mol_type = other DNA

SEQ ID NO: 12015 - DNA, 809 bp, synthetic construct; identical to SEQ ID NO: 8613
  misc_feature 1..809: note = Synthetic polypeptide
  source 1..809: mol_type = other DNA

SEQ ID NO: 12016 - DNA, 1691 bp, synthetic construct; identical to SEQ ID NO: 7480
  misc_feature 1..1691: note = Synthetic polypeptide
  source 1..1691: mol_type = other DNA

SEQ ID NO: 12017 - DNA, 1727 bp, synthetic construct; identical to SEQ ID NO: 7481
  misc_feature 1..1727: note = Synthetic polypeptide
  source 1..1727: mol_type = other DNA

SEQ ID NO: 12018 - DNA, 629 bp, synthetic construct; identical to SEQ ID NO: 7482
  misc_feature 1..629: note = Synthetic polypeptide
  source 1..629: mol_type = other DNA

SEQ ID NO: 12019 - DNA, 1553 bp, synthetic construct; identical to SEQ ID NO: 7483
  misc_feature 1..1553: note = Synthetic polypeptide
  source 1..1553: mol_type = other DNA

SEQ ID NO: 12020 - DNA, 2120 bp, synthetic construct; identical to SEQ ID NO: 6752
  misc_feature 1..2120: note = Synthetic polypeptide
  source 1..2120: mol_type = other DNA

SEQ ID NO: 12021 - DNA, 1046 bp, synthetic construct; identical to SEQ ID NO: 631
  misc_feature 1..1046: note = Synthetic polypeptide
  source 1..1046: mol_type = other DNA

SEQ ID NO: 12022 - DNA, 968 bp, synthetic construct; identical to SEQ ID NO: 632
  misc_feature 1..968: note = Synthetic polypeptide
  source 1..968: mol_type = other DNA

SEQ ID NO: 12023 - DNA, 676 bp, synthetic construct; identical to SEQ ID NO: 634
  misc_feature 1..676: note = Synthetic polypeptide
  source 1..676: mol_type = other DNA

SEQ ID NO: 12024 - DNA, 494 bp, synthetic construct; identical to SEQ ID NO: 635
  misc_feature 1..494: note = Synthetic polypeptide
  source 1..494: mol_type = other DNA

SEQ ID NO: 12025 - DNA, 809 bp, synthetic construct; identical to SEQ ID NO: 8505
  misc_feature 1..809: note = Synthetic polypeptide
  source 1..809: mol_type = other DNA

SEQ ID NO: 12026 - DNA, 809 bp, synthetic construct; identical to SEQ ID NO: 8643
  misc_feature 1..809: note = Synthetic polypeptide
  source 1..809: mol_type = other DNA

SEQ ID NO: 12027 - DNA, 809 bp, synthetic construct; identical to SEQ ID NO: 8643
  misc_feature 1..809: note = Synthetic polypeptide
  source 1..809: mol_type = other DNA

SEQ ID NO: 12028 - DNA, 952 bp, synthetic construct; identical to SEQ ID NO: 8583
  misc_feature 1..952: note = Synthetic polypeptide
  source 1..952: mol_type = other DNA

SEQ ID NO: 12029 - DNA, 87 bp, synthetic construct; identical to SEQ ID NO: 8584
  misc_feature 1..87: note = Synthetic polypeptide
  source 1..87: mol_type = other DNA

SEQ ID NO: 12030 - DNA, 809 bp, synthetic construct; identical to SEQ ID NO: 8699
  misc_feature 1..809: note = Synthetic polypeptide
  source 1..809: mol_type = other DNA

SEQ ID NO: 12031 - DNA, 809 bp, synthetic construct; identical to SEQ ID NO: 8699
  misc_feature 1..809: note = Synthetic polypeptide
  source 1..809: mol_type = other DNA

SEQ ID NO: 12032 - DNA, 463 bp, synthetic construct; identical to SEQ ID NO: 524
  misc_feature 1..463: note = Synthetic polypeptide
  source 1..463: mol_type = other DNA

SEQ ID NO: 12033 - DNA, 1084 bp, synthetic construct; identical to SEQ ID NO: 580
  misc_feature 1..1084: note = Synthetic polypeptide
  source 1..1084: mol_type = other DNA

SEQ ID NO: 12034 - DNA, 278 bp, synthetic construct; identical to SEQ ID NO: 8451
  misc_feature 1..278: note = Synthetic polypeptide
  source 1..278: mol_type = other DNA

SEQ ID NO: 12035 - DNA, 136 bp, synthetic construct; identical to SEQ ID NO: 8452
  misc_feature 1..136: note = Synthetic polypeptide
  source 1..136: mol_type = other DNA

SEQ ID NO: 12036 - DNA, 809 bp, synthetic construct; identical to SEQ ID NO: 8613
  misc_feature 1..809: note = Synthetic polypeptide
  source 1..809: mol_type = other DNA

SEQ ID NO: 12037 - DNA, 364 bp, synthetic construct; identical to SEQ ID NO: 7502
  misc_feature 1..364: note = Synthetic polypeptide
  source 1..364: mol_type = other DNA

SEQ ID NO: 12038 - DNA, 785 bp, synthetic construct; identical to SEQ ID NO: 6642
  misc_feature 1..785: note = Synthetic polypeptide
  source 1..785: mol_type = other DNA

SEQ ID NO: 12039 - DNA, 440 bp, synthetic construct; identical to SEQ ID NO: 6643
  misc_feature 1..440: note = Synthetic polypeptide
  source 1..440: mol_type = other DNA

SEQ ID NO: 12040 - DNA, 1232 bp, synthetic construct; identical to SEQ ID NO: 6566
  misc_feature 1..1232: note = Synthetic polypeptide
  source 1..1232: mol_type = other DNA

SEQ ID NO: 12041 - DNA, 497 bp, synthetic construct; identical to SEQ ID NO: 6567
  misc_feature 1..497: note = Synthetic polypeptide
  source 1..497: mol_type = other DNA

SEQ ID NO: 12042 - DNA, 575 bp, synthetic construct; identical to SEQ ID NO: 6568
  misc_feature 1..575: note = Synthetic polypeptide
  source 1..575: mol_type = other DNA

SEQ ID NO: 12043 - DNA, 2111 bp, synthetic construct
  misc_feature 1..2111: note = Synthetic polypeptide
  source 1..2111: mol_type = other DNA
gggtccccaagtcccccgtccacagaccagtaccaatctatggccggttaggaacggggctttcacagcaagaagtgagtggcaggccagagagcaaagcttcacctgtttttacagccactccccattgctcaaattacggcctgaactccacctcctgtaagatcagcagtggtattagatgctcaaaggagcgcaaaccctactgtgaactgtgcatataggggatctgggttgtgcgctccttatgagaatctaatgcctgatgatctgtcactgtctcccatcacctccagatgaaaatgtctagttgcaggaaaacgagctcaggctaccattgattctacgttatggcgggcattaatgaaaatgatttttatgacggagcgtggtgcgcgggaagaaatgacctccagcagtggattgaagtggatgctcggcgcctgaccagattcactggtgtcatcactcaagggaggaactccctctggctgagtgactgggtgacatcctataaggtcatggtgagcaatgacagccacacgtgggtcactgttaagaatggatctggagacatgatatttgagggaaacagtgagaaggagatccctgttctcaatgagctacccgtccccatggtggcccgctacatccgcataaaccctcagtcctggtttgataatgggagcatctgcatgagaatggagatcctgggctgcccactgccagatcctaataattattatcaccgccggaacgagatgaccaccactgatgacctggattttaagcaccacaattataaggaaatgcgccagttgatgaaagttgtgaatgaaatgtgtcccaatatcaccagaatttacaacattggaaaaagccaccagggcctgaagctgtatgctgtggagatctcagatcaccctggggagcatgaagtcggtgagcccgagttccactacatcgcgggggcccacggcaatgaggtgctgggccgggagctgctgctgctgctggtgcagttcgtgtgtcaggagtacttggcccggaatgcgcgcatcgtccacctggtggaggagacgcggattcacgtcctcccctccctcaaccccgatggctacgagaaggcctacgaagggggctcggagctgggaggctggtccctgggacgctggacccacgatggaattgacatcaacaacaactttcctgatttaaacacgctgctctgggaggcagaggatcgacagaatgtccccaggaaagttcccaatcactatattgcaatccctgagtggtttctgtcggaaaatgccacggtggctgccgagaccagagcagtcatagcctggatggaaaaaatcccttttgtgctgggcggcaacctgcagggcggcgagctggtggtggcgtacccctacgacctggtgcggtccccctggaagacgcaggaacacacccccacccccgacgaccacgtgttccgctggctggcctactcctatgcctccacacaccgcctcatgacagacgcccggaggagggtgtgccacacggaggacttccagaaggaggagggcactgtcaatggggcctcctggcacaccgtcgctggaagtctgaacgatttcagctaccttcatacaaactgcttcgaactgtccatctacgtgggctgtgataaatacccacatgagagccagctgcccgaggagtgggagaataaccgggaatctctgatcgtgttcatggagcaggttcatcgtggcattaaaggcttggtgagagattcacatggaaaaggaatcccaaacgccattatctccgtagaaggcattaaccatgacatccgaacagccaacgatggggattactggcgcctcctgaaccctggagagtatgtggtcacagcaaaggccgaaggtttcactgcatccaccaagaactgtatggttggctatgacatgggggccacaaggtgtgacttcacacttagcaaaaccaacatggccaggatccgagagatcatggagaagtttgggaagcagcccgtcagcctgccagccaggcggctgaagctgcgggggcagaagagacgacagcgtgggtga

SEQ ID NO: 12044 - DNA, 1194 bp, synthetic construct; identical to SEQ ID NO: 898
  misc_feature 1..1194: note = Synthetic polypeptide
  source 1..1194: mol_type = other DNA

SEQ ID NO: 12045 - DNA, 1116 bp, synthetic construct; identical to SEQ ID NO: 899
  misc_feature 1..1116: note = Synthetic polypeptide
  source 1..1116: mol_type = other DNA

SEQ ID NO: 12046 - DNA, 824 bp, synthetic construct; identical to SEQ ID NO: 901
  misc_feature 1..824: note = Synthetic polypeptide
  source 1..824: mol_type = other DNA

SEQ ID NO: 12047 - DNA, 642 bp, synthetic construct; identical to SEQ ID NO: 902
  misc_feature 1..642: note = Synthetic polypeptide
  source 1..642: mol_type = other DNA

SEQ ID NO: 12048 - DNA, 285 bp, synthetic construct; identical to SEQ ID NO: 6932
  misc_feature 1..285: note = Synthetic polypeptide
  source 1..285: mol_type = other DNA

SEQ ID NO: 12049 - DNA, 333 bp, synthetic construct; identical to SEQ ID NO: 6933
  misc_feature 1..333: note = Synthetic polypeptide
  source 1..333: mol_type = other DNA

SEQ ID NO: 12050 - DNA, 207 bp, synthetic construct; identical to SEQ ID NO: 6934
  misc_feature 1..207: note = Synthetic polypeptide
  source 1..207: mol_type = other DNA

SEQ ID NO: 12051 - DNA, 555 bp, synthetic construct; identical to SEQ ID NO: 6935
  misc_feature 1..555: note = Synthetic polypeptide
  source 1..555: mol_type = other DNA

SEQ ID NO: 12052 - DNA, 225 bp, synthetic construct; identical to SEQ ID NO: 6936
  misc_feature 1..225: note = Synthetic polypeptide
  source 1..225: mol_type = other DNA

SEQ ID NO: 12053 - DNA, 1815 bp, synthetic construct; identical to SEQ ID NO: 581
  misc_feature 1..1815: note = Synthetic polypeptide
  source 1..1815: mol_type = other DNA

SEQ ID NO: 12054 - DNA, 423 bp, synthetic construct; identical to SEQ ID NO: 6550
  misc_feature 1..423: note = Synthetic polypeptide
  source 1..423: mol_type = other DNA

SEQ ID NO: 12055 - DNA, 1530 bp, synthetic construct; identical to SEQ ID NO: 7238
  misc_feature 1..1530: note = Synthetic polypeptide
  source 1..1530: mol_type = other DNA

SEQ ID NO: 12056 - DNA, 369 bp, synthetic construct; identical to SEQ ID NO: 7239
  misc_feature 1..369: note = Synthetic polypeptide
  source 1..369: mol_type = other DNA

SEQ ID NO: 12057 - DNA, 342 bp, synthetic construct; identical to SEQ ID NO: 7240
  misc_feature 1..342: note = Synthetic polypeptide
  source 1..342: mol_type = other DNA

SEQ ID NO: 12058 - DNA, 1419 bp, synthetic construct; identical to SEQ ID NO: 7241
  misc_feature 1..1419: note = Synthetic polypeptide
  source 1..1419: mol_type = other DNA

SEQ ID NO: 12059 - DNA, 864 bp, synthetic construct; identical to SEQ ID NO: 6975
  misc_feature 1..864: note = Synthetic polypeptide
  source 1..864: mol_type = other DNA

SEQ ID NO: 12060 - DNA, 471 bp, synthetic construct; identical to SEQ ID NO: 6976
  misc_feature 1..471: note = Synthetic polypeptide
  source 1..471: mol_type = other DNA

SEQ ID NO: 12061 - DNA, 1775 bp, synthetic construct; identical to SEQ ID NO: 568
  misc_feature 1..1775: note = Synthetic polypeptide
  source 1..1775: mol_type = other DNA

SEQ ID NO: 12062 - DNA, 1038 bp, synthetic construct
  misc_feature 1..1038: note = Synthetic polypeptide
  source 1..1038: mol_type = other DNA
tgctatagactgaatgcttgtatcccttctcaaattcatatgttgaaattctaacgcataacgtggtggtactaagaggtggggcttttgggaggtaattagatcatgagaggagagccctcatgaatgggcttagtgccctgataaagcaatacaagagagcttgcttcctctctctgttctctaccaaaggagaatacaacaagaagatgcccatctgtagaccaggaggtggtccctccccagaaactggatgggccagcacgttgattctgaacttctagcctccagaactgccaaaaggtgtgttttgctgacttcaagcatccctgctacaaaatggcctacttccatgaactgtccagccgagtgagctttcaggaggcacgcctggcttgtgagagtgagggaggagtcctcctcagccttgagaatgaagcagaacagaagttaatagagagcatgttgcaaaacctgacaaaacccgggacagggatttctgatggtgatttctggatagggctttggaggaatggagatgggcaaacatctggtgcctgcccagatctctaccagtggtctgatggaagcaattcccagtaccgaaactggtacacagatgaaccttcctgcggaagtgaaaagtgtgttgtgatgtatcaccaaccaactgccaatcctggccttgggggtccctacctttaccagtggaatgatgacaggtgtaacatgaagcacaattatatttgcaagtatgaaccagagattaatccaacagcccctgtagaaaagccttatcttacaaatcaaccaggagacacccatcagaatgtggttgttactgaagcaggtataattcccaatctaatttatgttgttataccaacaatacccctgctcttactgatactggttgcttttggaacctgttgtttccagatgctgcataaaagtaaaggaagaacaaaaactagtccaaaccagtctacactgtggatttcaaagagtaccagaaaagaaagtggcatggaagtataa

SEQ ID NO: 12063 - DNA, 842 bp, synthetic construct; identical to SEQ ID NO: 6534
  misc_feature 1..842: note = Synthetic polypeptide
  source 1..842: mol_type = other DNA

SEQ ID NO: 12064 - DNA, 1931 bp, synthetic construct; identical to SEQ ID NO: 7491
  misc_feature 1..1931: note = Synthetic polypeptide
  source 1..1931: mol_type = other DNA

SEQ ID NO: 12065 - DNA, 2578 bp, synthetic construct; identical to SEQ ID NO: 7194
  misc_feature 1..2578: note = Synthetic polypeptide
  source 1..2578: mol_type = other DNA

SEQ ID NO: 12066 - DNA, 2305 bp, synthetic construct; identical to SEQ ID NO: 7195
  misc_feature 1..2305: note = Synthetic polypeptide
  source 1..2305: mol_type = other DNA

SEQ ID NO: 12067 - DNA, 1759 bp, synthetic construct; identical to SEQ ID NO: 7196
  misc_feature 1..1759: note = Synthetic polypeptide
  source 1..1759: mol_type = other DNA

SEQ ID NO: 12068 - DNA, 5464 bp, synthetic construct; identical to SEQ ID NO: 7409
  misc_feature 1..5464: note = Synthetic polypeptide
  source 1..5464: mol_type = other DNA

SEQ ID NO: 12069 - DNA, 4444 bp, synthetic construct; identical to SEQ ID NO: 7410
  misc_feature 1..4444: note = Synthetic polypeptide
  source 1..4444: mol_type = other DNA

SEQ ID NO: 12070 - DNA, 574 bp, synthetic construct; identical to SEQ ID NO: 7411
  misc_feature 1..574: note = Synthetic polypeptide
  source 1..574: mol_type = other DNA

SEQ ID NO: 12071 - DNA, 236 bp, synthetic construct; identical to SEQ ID NO: 9570
  misc_feature 1..236: note = Synthetic polypeptide
  source 1..236: mol_type = other DNA

SEQ ID NO: 12072 - DNA, 542 bp, synthetic construct; identical to SEQ ID NO: 9571
  misc_feature 1..542: note = Synthetic polypeptide
  source 1..542: mol_type = other DNA

SEQ ID NO: 12073 - DNA, 1214 bp, synthetic construct; identical to SEQ ID NO: 9572
  misc_feature 1..1214: note = Synthetic polypeptide
  source 1..1214: mol_type = other DNA

SEQ ID NO: 12074 - DNA, 144 bp, synthetic construct; identical to SEQ ID NO: 9573
  misc_feature 1..144: note = Synthetic polypeptide
  source 1..144: mol_type = other DNA

SEQ ID NO: 12075 - DNA, 515 bp, synthetic construct; identical to SEQ ID NO: 9574
  misc_feature 1..515: note = Synthetic polypeptide
  source 1..515: mol_type = other DNA

SEQ ID NO: 12076 - DNA, 4048 bp, synthetic construct; identical to SEQ ID NO: 9554
  misc_feature 1..4048: note = Synthetic polypeptide
  source 1..4048: mol_type = other DNA

SEQ ID NO: 12077 - DNA, 466 bp, synthetic construct; identical to SEQ ID NO: 8369
  misc_feature 1..466: note = Synthetic polypeptide
  source 1..466: mol_type = other DNA

SEQ ID NO: 12078 - DNA, 526 bp, synthetic construct; identical to SEQ ID NO: 8370
  misc_feature 1..526: note = Synthetic polypeptide
  source 1..526: mol_type = other DNA

SEQ ID NO: 12079 - DNA, 319 bp, synthetic construct; identical to SEQ ID NO: 8371
  misc_feature 1..319: note = Synthetic polypeptide
  source 1..319: mol_type = other DNA

SEQ ID NO: 12080 - DNA, 520 bp, synthetic construct; identical to SEQ ID NO: 8372
  misc_feature 1..520: note = Synthetic polypeptide
  source 1..520: mol_type = other DNA

SEQ ID NO: 12081 - DNA, 763 bp, synthetic construct; identical to SEQ ID NO: 606
  misc_feature 1..763: note = Synthetic polypeptide
  source 1..763: mol_type = other DNA

SEQ ID NO: 12082 - DNA, 375 bp, synthetic construct; identical to SEQ ID NO: 860
  misc_feature 1..375: note = Synthetic polypeptide
  source 1..375: mol_type = other DNA

SEQ ID NO: 12083 - DNA, 255 bp, synthetic construct; identical to SEQ ID NO: 862
  misc_feature 1..255: note = Synthetic polypeptide
  source 1..255: mol_type = other DNA

SEQ ID NO: 12084 - DNA, 1967 bp, synthetic construct; identical to SEQ ID NO: 7428
  misc_feature 1..1967: note = Synthetic polypeptide
  source 1..1967: mol_type = other DNA

SEQ ID NO: 12085 - DNA, 1142 bp, synthetic construct; identical to SEQ ID NO: 7429
  misc_feature 1..1142: note = Synthetic polypeptide
  source 1..1142: mol_type = other DNA

SEQ ID NO: 12086 - DNA, 367 bp, synthetic construct; identical to SEQ ID NO: 548
  misc_feature 1..367: note = Synthetic polypeptide
  source 1..367: mol_type = other DNA

SEQ ID NO: 12087 - DNA, 761 bp, synthetic construct; identical to SEQ ID NO: 7260
  misc_feature 1..761: note = Synthetic polypeptide
  source 1..761: mol_type = other DNA

SEQ ID NO: 12088 - DNA, 675 bp, synthetic construct; identical to SEQ ID NO: 7261
  misc_feature 1..675: note = Synthetic polypeptide
  source 1..675: mol_type = other DNA

SEQ ID NO: 12089 - DNA, 779 bp, synthetic construct; identical to SEQ ID NO: 8578
  misc_feature 1..779: note = Synthetic polypeptide
  source 1..779: mol_type = other DNA

SEQ ID NO: 12090 - DNA, 409 bp, synthetic construct; identical to SEQ ID NO: 8579
  misc_feature 1..409: note = Synthetic polypeptide
  source 1..409: mol_type = other DNA

SEQ ID NO: 12091 - DNA, 1498 bp, synthetic construct; identical to SEQ ID NO: 8305
  misc_feature 1..1498: note = Synthetic polypeptide
  source 1..1498: mol_type = other DNA

SEQ ID NO: 12092 - DNA, 1195 bp, synthetic construct; identical to SEQ ID NO: 8306
  misc_feature 1..1195: note = Synthetic polypeptide
  source 1..1195: mol_type = other DNA

SEQ ID NO: 12093 - DNA, 1462 bp, synthetic construct; identical to SEQ ID NO: 8307
  misc_feature 1..1462: note = Synthetic polypeptide
  source 1..1462: mol_type = other DNA

SEQ ID NO: 12094 - DNA, 1489 bp, synthetic construct; identical to SEQ ID NO: 8308
  misc_feature 1..1489: note = Synthetic polypeptide
  source 1..1489: mol_type = other DNA

SEQ ID NO: 12095 - DNA, 1180 bp, synthetic construct; identical to SEQ ID NO: 8309
  misc_feature 1..1180: note = Synthetic polypeptide
  source 1..1180: mol_type = other DNA

SEQ ID NO: 12096 - DNA, 829 bp, synthetic construct; identical to SEQ ID NO: 6626
  misc_feature 1..829: note = Synthetic polypeptide
  source 1..829: mol_type = other DNA

SEQ ID NO: 12097 - DNA, 484 bp, synthetic construct; identical to SEQ ID NO: 6627
  misc_feature 1..484: note = Synthetic polypeptide
  source 1..484: mol_type = other DNA

SEQ ID NO: 12098 - DNA, 233 bp, synthetic construct; identical to SEQ ID NO: 9987
  misc_feature 1..233: note = Synthetic polypeptide
  source 1..233: mol_type = other DNA

SEQ ID NO: 12099 - DNA, 585 bp, synthetic construct; identical to SEQ ID NO: 9988
  misc_feature 1..585: note = Synthetic polypeptide
  source 1..585: mol_type = other DNA

SEQ ID NO: 12100 - DNA, 342 bp, synthetic construct; identical to SEQ ID NO: 9989
  misc_feature 1..342: note = Synthetic polypeptide
  source 1..342: mol_type = other DNA

SEQ ID NO: 12101 - DNA, 346 bp, synthetic construct; identical to SEQ ID NO: 9990
  misc_feature 1..346: note = Synthetic polypeptide
  source 1..346: mol_type = other DNA

SEQ ID NO: 12102 - DNA, 3052 bp, synthetic construct; identical to SEQ ID NO: 7029
  misc_feature 1..3052: note = Synthetic polypeptide
  source 1..3052: mol_type = other DNA

SEQ ID NO: 12103 - DNA, 3055 bp, synthetic construct; identical to SEQ ID NO: 7030
  misc_feature 1..3055: note = Synthetic polypeptide
  source 1..3055: mol_type = other DNA

SEQ ID NO: 12104 - DNA, 3140 bp, synthetic construct; identical to SEQ ID NO: 9634
  misc_feature 1..3140: note = Synthetic polypeptide
  source 1..3140: mol_type = other DNA

SEQ ID NO: 12105 - DNA, 3209 bp, synthetic construct; identical to SEQ ID NO: 9635
  misc_feature 1..3209: note = Synthetic polypeptide
  source 1..3209: mol_type = other DNA

SEQ ID NO: 12106 - DNA, 2637 bp, synthetic construct; identical to SEQ ID NO: 9636
  misc_feature 1..2637: note = Synthetic polypeptide
  source 1..2637: mol_type = other DNA

SEQ ID NO: 12107 - DNA, 823 bp, synthetic construct
  misc_feature 1..823: note = Synthetic polypeptide
  source 1..823: mol_type = other DNA
catgcctttgctgctgtccttggtcagaatgactcatcattcgtgtaattcttgctacttgctcaatccagttcaaatgctgctccttctcagaagccttccctgttctctccctccctgcacagataattgttttttctggctctggcccttcatcactctgctgttgcaccttctgcagttttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctga

SEQ ID NO: 12108 - DNA, 340 bp, synthetic construct; identical to SEQ ID NO: 8550
  misc_feature 1..340: note = Synthetic polypeptide
  source 1..340: mol_type = other DNA

SEQ ID NO: 12109 - DNA, 249 bp, synthetic construct
  misc_feature 1..249: note = Synthetic polypeptide
  source 1..249: mol_type = other DNA
aagacggccgaataggaacagctccggtctacagctcccagcgtgagcaatgcagaagaccggtgatttctgcatttccatctgaggtaccgggttcatctcactagggagtgccagacagtgggcgcagtgtgtatgtacagagaaccatcgctacatgaaattggagaaaaacaagggcgttcaaggaaaagttctggaacaccaaccatgaatggaggcaaagttgtgaatcaagattcaacatag

SEQ ID NO: 12110 - DNA, 198 bp, synthetic construct
  misc_feature 1..198: note = Synthetic polypeptide
  source 1..198: mol_type = other DNA
aagacggccgaataggaacagctccggtctacagctcccagcgtgagcaatgcagaagaccggtgatttctgcatttccatctgaggtaccgggttcatctcactagggagtgccagacagtgggcgcagtgtgtatgtacagagaaccatcgctacatgaaattggagaaaaacaagggcgttcaaggaaaagttct

SEQ ID NO: 12111 - DNA, 2322 bp, synthetic construct; identical to SEQ ID NO: 7493
  misc_feature 1..2322: note = Synthetic polypeptide
  source 1..2322: mol_type = other DNA

SEQ ID NO: 12112 - DNA, 1698 bp, synthetic construct; identical to SEQ ID NO: 7494
  misc_feature 1..1698: note = Synthetic polypeptide
  source 1..1698: mol_type = other DNA

SEQ ID NO: 12113 - DNA, 784 bp, synthetic construct; identical to SEQ ID NO: 6798
  misc_feature 1..784: note = Synthetic polypeptide
  source 1..784: mol_type = other DNA

SEQ ID NO: 12114 - DNA, 1257 bp, synthetic construct; identical to SEQ ID NO: 625
  misc_feature 1..1257: note = Synthetic polypeptide
  source 1..1257: mol_type = other DNA

SEQ ID NO: 12115 - DNA, 1215 bp, synthetic construct; identical to SEQ ID NO: 626
  misc_feature 1..1215: note = Synthetic polypeptide
  source 1..1215: mol_type = other DNA

SEQ ID NO: 12116 - DNA, 507 bp, synthetic construct; identical to SEQ ID NO: 628
  misc_feature 1..507: note = Synthetic polypeptide
  source 1..507: mol_type = other DNA

SEQ ID NO: 12117 - DNA, 313 bp, synthetic construct; identical to SEQ ID NO: 629
  misc_feature 1..313: note = Synthetic polypeptide
  source 1..313: mol_type = other DNA

SEQ ID NO: 12118 - DNA, 291 bp, synthetic construct; identical to SEQ ID NO: 630
  misc_feature 1..291: note = Synthetic polypeptide
  source 1..291: mol_type = other DNA

SEQ ID NO: 12119 - DNA, 463 bp, synthetic construct; identical to SEQ ID NO: 7109
  misc_feature 1..463: note = Synthetic polypeptide
  source 1..463: mol_type = other DNA

SEQ ID NO: 12120 - DNA, 156 bp, synthetic construct; identical to SEQ ID NO: 6906
  misc_feature 1..156: note = Synthetic polypeptide
  source 1..156: mol_type = other DNA

SEQ ID NO: 12121 - DNA, 153 bp, synthetic construct; identical to SEQ ID NO: 11159
  misc_feature 1..153: note = Synthetic polypeptide
  source 1..153: mol_type = other DNA

SEQ ID NO: 12122 - DNA, 1608 bp, synthetic construct; identical to SEQ ID NO: 11160
  misc_feature 1..1608: note = Synthetic polypeptide
  source 1..1608: mol_type = other DNA

SEQ ID NO: 12123 - DNA, 509 bp, synthetic construct; identical to SEQ ID NO: 7445
  misc_feature 1..509: note = Synthetic polypeptide
  source 1..509: mol_type = other DNA

SEQ ID NO: 12124 - DNA, 1052 bp, synthetic construct; identical to SEQ ID NO: 789
  misc_feature 1..1052: note = Synthetic polypeptide
  source 1..1052: mol_type = other DNA

SEQ ID NO: 12125 - DNA, 974 bp, synthetic construct; identical to SEQ ID NO: 790
  misc_feature 1..974: note = Synthetic polypeptide
  source 1..974: mol_type = other DNA

SEQ ID NO: 12126 - DNA, 682 bp, synthetic construct; identical to SEQ ID NO: 792
  misc_feature 1..682: note = Synthetic polypeptide
  source 1..682: mol_type = other DNA

SEQ ID NO: 12127 - DNA, 500 bp, synthetic construct; identical to SEQ ID NO: 793
  misc_feature 1..500: note = Synthetic polypeptide
  source 1..500: mol_type = other DNA

SEQ ID NO: 12128 - DNA, 1206 bp, synthetic construct; identical to SEQ ID NO: 7670
  misc_feature 1..1206: note = Synthetic polypeptide
  source 1..1206: mol_type = other DNA

SEQ ID NO: 12129 - DNA, 1134 bp, synthetic construct; identical to SEQ ID NO: 7671
  misc_feature 1..1134: note = Synthetic polypeptide
  source 1..1134: mol_type = other DNA

SEQ ID NO: 12130 - DNA, 1002 bp, synthetic construct; identical to SEQ ID NO: 7672
  misc_feature 1..1002: note = Synthetic polypeptide
  source 1..1002: mol_type = other DNA

SEQ ID NO: 12131 - DNA, 287 bp, synthetic construct; identical to SEQ ID NO: 7101
  misc_feature 1..287: note = Synthetic polypeptide
  source 1..287: mol_type = other DNA

SEQ ID NO: 12132 - DNA, 281 bp, synthetic construct; identical to SEQ ID NO: 7102
  misc_feature 1..281: note = Synthetic polypeptide
  source 1..281: mol_type = other DNA

SEQ ID NO: 12133 - DNA, 630 bp, synthetic construct
  misc_feature 1..630: note = Synthetic polypeptide
  source 1..630: mol_type = other DNA
tggtctcatcttctaccgattcctcgccctgtaccaccactaggttccctatgctccagccacagacctttttttctgttccttacaaactacaagatcatcactgcttctgggcttttgtgcacttagatccctgaaatcacctcatatcatgcaggtctcagctcacttgtcgccacttcagagaaacctactttcatcctccaaactgaagaaggcacattgcaagcaacccgtgccttgatggtggttggcatcctcctgggagtgatagcaatctttgtggccaccgttggcatgaagtgtatgaagtgcttggaagacgatgaggtgcagaagatgaggatggctgtcattgggggtgcgatatttcttcttgcaggtctggctattttagttgccacagcatggtatggcaatagaatcgttcaagaattctatgaccctatgaccccagtcaatgccaggtacgaatttggtcaggctctcttcactggctgggctgctgcttctctctgccttctgggaggtgccctactttgctgttcctgtccccgaaaaacaacctcttacccaacaccaaggccctatccaaaacctgcaccttccagcgggaaagactacgtgtga

SEQ ID NO: 12134 - DNA, 127 bp, synthetic construct; identical to SEQ ID NO: 8697
  misc_feature 1..127: note = Synthetic polypeptide
  source 1..127: mol_type = other DNA

SEQ ID NO: 12135 - DNA, 785 bp, synthetic construct
  misc_feature 1..785: note = Synthetic polypeptide
  source 1..785: mol_type = other DNA
gggggaggagccaagatggccgaataggaacagctccggtgtacagctcccagcgtgagcgacgcagaagacgggtgatttctgcatttccatctgaggctggaagtgatggagagagtattggaaactgtcccttttgccaacgccttttcatgatcctctggcttaaaggagttaaatttaatgtgacaactgttgacatgaccagaaagcctgaagaactaaaggacttagccccaggtaccaatcctccgttcctggtgtataacaaggagttgaaaacagacttcattaaaattgaggagtttttagaacaaaccctggctcctccaaggtaccctcacctgagtcccaagtacaaggagtcttttgatgtgggctgtaacctctttgccaagttttctgcatacattaagaatacacaaaaggaggcaaataagaattttgaaaaatctctgctcaaagaattcaagcgtctggatgactacttaaacaccccacttctggatgaaattgatccagacagtgctgaggaacccccagtttccagaagactattcttggatggggaccagctaacactggctgattgtagcttgttacccaagctgaacattattaaagttgctgccaagaaatatcgtgactttgacattccagcagaattctcaggagtctggcgttatctccacaatgcctatgcccgtgaagaatttacccacacgtgtcctgaagacaaagaaattgaaaatacttacgcaaatgtggctaaacagaagagttag

SEQ ID NO: 12136 - DNA, 440 bp, synthetic construct
  misc_feature 1..440: note = Synthetic polypeptide
  source 1..440: mol_type = other DNA
gggggaggagccaagatggccgaataggaacagctccggtgtacagctcccagcgtgagcgacgcagaagacgggtgatttctgcatttccatctgaggctggaagtgatggagagagtattggaaactgtcccttttgccaacgccttttcatgatcctctggcttaaaggagttaaatttaatgtgacaactgttgacatgaccaggtaccctcacctgagtcccaagtacaaggagtcttttgatgtgggctgtaacctctttgccaagttttctgcatacattaagaatacacaaaaggaggcaaataagaattttgaaaaatctctgctcaaagaattcaagcgtctggatgactacttaaacaccccacttctggatgaaattgatccagacagtgctgaggaacccccagtttccagaagactattcttggat

SEQ ID NO: 12137 - DNA, 2419 bp, synthetic construct; identical to SEQ ID NO: 7455
  misc_feature 1..2419: note = Synthetic polypeptide
  source 1..2419: mol_type = other DNA

SEQ ID NO: 12138 - DNA, 829 bp, synthetic construct; identical to SEQ ID NO: 624
  misc_feature 1..829: note = Synthetic polypeptide
  source 1..829: mol_type = other DNA

SEQ ID NO: 12139 - DNA, 665 bp, synthetic construct; identical to SEQ ID NO: 6745
  misc_feature 1..665: note = Synthetic polypeptide
  source 1..665: mol_type = other DNA

SEQ ID NO: 12140 - DNA, 1443 bp, synthetic construct; identical to SEQ ID NO: 6760
  misc_feature 1..1443: note = Synthetic polypeptide
  source 1..1443: mol_type = other DNA

SEQ ID NO: 12141 - DNA, 984 bp, synthetic construct; identical to SEQ ID NO: 6761
  misc_feature 1..984: note = Synthetic polypeptide
  source 1..984: mol_type = other DNA

SEQ ID NO: 12142 - DNA, 1032 bp, synthetic construct; identical to SEQ ID NO: 6762
  misc_feature 1..1032: note = Synthetic polypeptide
  source 1..1032: mol_type = other DNA

SEQ ID NO: 12143 - DNA, 1533 bp, synthetic construct; identical to SEQ ID NO: 8543
  misc_feature 1..1533: note = Synthetic polypeptide
  source 1..1533: mol_type = other DNA

SEQ ID NO: 12144 - DNA, 1392 bp, synthetic construct; identical to SEQ ID NO: 6782
  misc_feature 1..1392: note = Synthetic polypeptide
  source 1..1392: mol_type = other DNA

SEQ ID NO: 12145 - DNA, 933 bp, synthetic construct; identical to SEQ ID NO: 6783
  misc_feature 1..933: note = Synthetic polypeptide
  source 1..933: mol_type = other DNA

SEQ ID NO: 12146 - DNA, 981 bp, synthetic construct; identical to SEQ ID NO: 6784
  misc_feature 1..981: note = Synthetic polypeptide
  source 1..981: mol_type = other DNA

SEQ ID NO: 12147 - DNA, 711 bp, synthetic construct; identical to SEQ ID NO: 7377
  misc_feature 1..711: note = Synthetic polypeptide
  source 1..711: mol_type = other DNA

SEQ ID NO: 12148 - DNA, 503 bp, synthetic construct; identical to SEQ ID NO: 493
  misc_feature 1..503: note = Synthetic polypeptide
  source 1..503: mol_type = other DNA

SEQ ID NO: 12149 - DNA, 476 bp, synthetic construct; identical to SEQ ID NO: 495
  misc_feature 1..476: note = Synthetic polypeptide
  source 1..476: mol_type = other DNA

SEQ ID NO: 12150 - DNA, 539 bp, synthetic construct; identical to SEQ ID NO: 496
  misc_feature 1..539: note = Synthetic polypeptide
  source 1..539: mol_type = other DNA

SEQ ID NO: 12151 - DNA, 2535 bp, synthetic construct; identical to SEQ ID NO: 6677
  misc_feature 1..2535: note = Synthetic polypeptide
  source 1..2535: mol_type = other DNA

SEQ ID NO: 12152 - DNA, 2181 bp, synthetic construct; identical to SEQ ID NO: 6678
  misc_feature 1..2181: note = Synthetic polypeptide
  source 1..2181: mol_type = other DNA

SEQ ID NO: 12153 - DNA, 1119 bp, synthetic construct; identical to SEQ ID NO: 6679
  misc_feature 1..1119: note = Synthetic polypeptide
  source 1..1119: mol_type = other DNA

SEQ ID NO: 12154 - DNA, 1808 bp, synthetic construct
  misc_feature 1..1808: note = Synthetic polypeptide
  source 1..1808: mol_type = other DNA
agaggaaagaagatagactttggagacagacctggttttctaccccagatttgccacttactagctgtgcgatgttgagctggtattatttagtctgagctttgctttcctcatgtgcaaaatgagaataatacctgccagaattttctttctttgatcctaatgatgcatcatgccaggaaattctttttgatcccaaaacttcagtttcagaattatttgccattttgagacagtgggttcctcaggtccaacaaaacattgacattattggaaatgagattcttaagagaggttgcaatgtgaatgatagagatggattgacagatatgactcttttacattatacctgcaaatctggagctcatggtattggtgatgtggaaacagctgtaaaatttgcaactcagcttattgacctgggagcagacattagtttgcggagtcgctggacaaacatgaatgctttgcattatgctgcttattttgatgtccctgaacttataagagtgattttgaaaacatcgaaaccaaaagatgtggatgccacttgcagtgattttaattttggaacagctttgcatattgcagcatacaacttgtgtgcaggtgctgtgaagtgcctcttggagcagggagcaaatcctgcatttaggaatgacaaaggacagatccctgctgatgttgttccagacccagtagatatgccgttagagatggctgacgccgcagccactgctaaggaaatcaagcagatgcttctagatgcggtgcctctgtcatgtaacatctcaaaggccatgctcccaaattatgatcatgtcactggcaaggcaatgcttacgtcacttggcctgaagttgggggatcgtgttgttattgcaggacagaaggttggtacattaagattttgtggaacaactgaatttgcaagtgggcagtgggctggcattgaactggatgaaccagaaggaaaaaataatggaagtgttggaaaagtccagtactttaaatgtgcccccaagtatggtatttttgcacctctttcaaagataagtaaagcaaaaggtcgaaggaagaatataacacacactccttctacaaaagctgctgtacctctcatcaggtcccagaaaattgacgtagctcatgtgacgtcaaaagtaaatactggattaatgacatcaaaaaaagatagtgcttctgagtcaacactttcattgcctcctggtgaagaacttaaaactgtgacagagaaagatgttgccctgcttggatctgtcagcagctgctcctctacatcttctttggaacacagacagagctaccccaagaaacagaatgcaatcagcagtaacaagaagacaatgagcaaaagcccttccctttcatccagagccagtgctggtttgaattcctcagcaacatctacagcaaataatagccgttgcgagggggaactccgcctcggagagagagtgttagtggtaggacagagactgggcaccattaggttctttgggacaacaaacttcgctccaggatattggtatggtatagagcttgaaaaaccccatggcaagaatgatggttcagttggaggtgtgcagtattttagctgttctccaagatatggaatatttgctcccccatccagggtgcaaagagtaacagattccctggataccctttcagaaatttcttcaaataaacagaaccattcttatcctggttttaggagaagttttagcacaacttctgcttcttcccaaaaggagattaacagaagaaatgctttttccaagtga

SEQ ID NO: 12155 - DNA, 1496 bp, synthetic construct
  misc_feature 1..1496: note = Synthetic polypeptide
  source 1..1496: mol_type = other DNA
agaggaaagaagatagactttggagacagacctggttttctaccccagatttgccacttactagctgtgcgatgttgagctggtattatttagtctgagctttgctttcctcatgtgcaaaatgagaataatacctgccagaattttctttctttgatcctaatgatgcatcatgccaggaaattctttttgatcccaaaacttcagtttcagaattatttgccattttgagacagtgggttcctcaggtccaacaaaacattgacattattggaaatgagattcttaagagaggttgcaatgtgaatgatagagatggattgacagatatgactcttttacattatacctgcaaatctggagctcatggtattggtgatgtggaaacagctgtaaaatttgcaactcagcttattgacctgggagcagacattagtttgcggagtcgctggacaaacatgaatgctttgcattatgctgcttattttgatgtccctgaacttataagagtgattttgaaaacatcgaaaccaaaagatgtggatgccacttgcagtgattttaattttggaacagctttgcatattgcagcatacaacttgtgtgcaggtgctgtgaagtgcctcttggagcagggagcaaatcctgcatttaggaatgacaaaggacagatccctgctgatgttgttccagacccagtagatatgccgttagagatggctgacgccgcagccactgctaaggaaatcaagcagatgcttctagatgcggtgcctctgtcatgtaacatctcaaaggccatgctcccaaattatgatcatgtcactggcaaggcaatgcttacgtcacttggcctgaagttgggggatcgtgttgttattgcaggacagaaggttggtacattaagattttgtggaacaactgaatttgcaagtgggcagtgggctggcattgaactggatgaaccagaaggaaaaaataatggaagtgttggaaaagtccagtactttaaatgtgcccccaagtatggtatttttgcacctctttcaaagataagtaaagcaaaaggtcgaaggaagaatataacacacactccttctacaaaagctgctgtacctctcatcaggtcccagaaaattgacgtagctcatgtgacgtcaaaagtaaatactggattaatgacatcaaaaaaagatagtgcttctgagtcaacactttcattgcctcctggtgaagaacttaaaactgtgacagagaaagatgttgccctgcttggatctgtcagcagctgctcctctacatcttctttggaacacagacagagctaccccaagaaacagaatgcaatcagcagtaacaagaagacaatgagcaaaagcccttccctttcatccagagccagtgctggtatctatggctttttcaaccaggctttcttggtgttttttatcttggtttgtttgtttgaattcctcagcaacatctacagcaaataa

SEQ ID NO: 12156 - DNA, 2126 bp, synthetic construct
  misc_feature 1..2126: note = Synthetic polypeptide
  source 1..2126: mol_type = other DNA
agaggaaagaagatagactttggagacagacctggttttctaccccagatttgccacttactagctgtgcgatgttgagctggtattatttagtctgagctttgctttcctcatgtgcaaaatgagaataatacctgccagaattttctttctttgatcctaatgatgcatcatgccaggaaattctttttgatcccaaaacttcagtttcagaattatttgccattttgagacagtgggttcctcaggtccaacaaaacattgacattattggaaatgagattcttaagagaggttgcaatgtgaatgatagagatggattgacagatatgactcttttacattatacctgcaaatctggagctcatggtattggtgatgtggaaacagctgtaaaatttgcaactcagcttattgacctgggagcagacattagtttgcggagtcgctggacaaacatgaatgctttgcattatgctgcttattttgatgtccctgaacttataagagtgattttgaaaacatcgaaaccaaaagatgtggatgccacttgcagtgattttaattttggaacagctttgcatattgcagcatacaacttgtgtgcaggtgctgtgaagtgcctcttggagcagggagcaaatcctgcatttaggaatgacaaaggacagatccctgctgatgttgttccagacccagtagatatgccgttagagatggctgacgccgcagccactgctaaggaaatcaagcagatgcttctagatgcggtgcctctgtcatgtaacatctcaaaggccatgctcccaaattatgatcatgtcactggcaaggcaatgcttacgtcacttggcctgaagttgggggatcgtgttgttattgcaggacagaaggttggtacattaagattttgtggaacaactgaatttgcaagtgggcagtgggctggcattgaactggatgaaccagaaggaaaaaataatggaagtgttggaaaagtccagtactttaaatgtgcccccaagtatggtatttttgcacctctttcaaagataagtaaagcaaaaggtcgaaggaagaatataacacacactccttctacaaaagctgctgtacctctcatcaggtcccagaaaattgacgtagctcatgtgacgtcaaaagtaaatactggattaatgacatcaaaaaaagatagtgcttctgagtcaacactttcattgcctcctggtgaagaacttaaaactgtgacagagaaagatgttgccctgcttggatctgtcagcagctgctcctctacatcttctttggaacacagacagagctaccccaagaaacagaatgcaatcagcagtaacaagaagacaatgagcaaaagcccttccctttcatccagagccagtgctggtttgaattcctcagcaacatctacagcaaataatagccgttgcgagggggaactccgcctcggagagagagtgttagtggtaggacagagactgggcaccattaggttctttgggacaacaaacttcgctccaggatattggtatggtatagagcttgaaaaaccccatggcaagaatgatggttcagttggaggtgtgcagtattttagctgttctccaagatatggaatatttgctcccccatccagggtgcaaagagtaacagattccctggataccctttcagaaatttcttcaaataaacagaaccattcttatcctggttttaggagaagttttagcacaacttctgcttcttcccaaaaggagattaacagaagaaatgctttttccaaatcgaaagctgctttgcgtcgcagttggagcagcacccccaccgcaggtggcattgaagggagcgtgaagctgcacgaggggtctcaggtcctgctcacgagctccaatgagatgggtactgttaggtatgtgggccccactgactttgcttcaggtatctggcttggacttgagctccgaagcgccaagggaaaaaatgatgggtcagtgggtgacaagcgctatttcacctgtaagccgaaccatggagtcttagttcgaccgagcagagtgacctatcggggaattaatgggtcaaaacttgtggatgagaattgttaa

SEQ ID NO: 12157 - DNA, 302 bp, synthetic construct
  misc_feature 1..302: note = Synthetic polypeptide
  source 1..302: mol_type = other DNA
agaggaaagaagatagactttggagacagacctggttttctaccccagatttgccacttactagctgtgcgatgttgagctggtattatttagtctgagctttgctttcctcatgtgcaaaatgagaataatacctgccagaattttctttctttgatcctaatgatgcatcatgccaggaaattctttttgatcccaaaacttcagtttcagaattatttgccattttgagacagtgggttcctcaggtccaacaaaacattgacattattggaaatgaggtgatgtggaaacagctgtaa

SEQ ID NO: 12158 - DNA, 652 bp, synthetic construct
  misc_feature 1..652: note = Synthetic polypeptide
  source 1..652: mol_type = other DNA
agaggaaagaagatagactttggagacagacctggttttctaccccagatttgccacttactagctgtgcgatgttgagctggtattatttagtctgagctttgctttcctcatgtgcaaaatgagaataatacctgccagaattttctttctttgatcctaatgatgcatcatgccaggaaattctttttgatcccaaaacttcagtttcagaattatttgccattttgagacagtgggttcctcaggtccaacaaaacattgacattattggaaatgagattcttaagagaggttgcaatgtgaatgatagagatggattgacagatatgactcttttacattatacctgcaaatctggagctcatggtattggtgatgtggaaacagctgtaaaatttgcaactcagcttattgacctgggagcagacattagtttgcggagtcgctggacaaacatgaatgctttgcattatgctgcttattttgatgtccctgaacttataagagtgattttgaaaacatcgaaaccaaaagatgtggatgccacttgcagtgattttaattttggaacagctttgcatattgcagcatacaacttgtgtgcaggtgctgtgaagtgcctcttggagcagggagcaaatcctgcatt

SEQ ID NO: 12159 - DNA, 809 bp, synthetic construct
  misc_feature 1..809: note = Synthetic polypeptide
  source 1..809: mol_type = other DNA
cctggttctctggggcacgaggcttctcctcagcactctggcgcccccaacaggttcccagtgttcggctggggcaggcacgctgtggctggctgcttcccttccttccatcccctttggaccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgctgtctctcctccagcaagggaatgtgacagtccttcgtatcagaaaaggcagaggatggccctgttggcaaggaaacaaggagcaggagacagccttattgcaggctctgccatgtccaaagcaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacgagaaattaatgctgatataaaacgtaaattagtgaaggaactccgatgcgttggacaaaaatatgaaaaaatcttcgaaatgcttgaaggagtgcaaggacctactgcagtcaggaagcgattttttgaatccatcatcaaggaagcagcaagatgtatgagacgagactttgttaagcaccttaagaagaaactgaaacgtatgatttga

SEQ ID NO: 12160 - DNA, 718 bp, synthetic construct; identical to SEQ ID NO: 821
  misc_feature 1..718: note = Synthetic polypeptide
  source 1..718: mol_type = other DNA

SEQ ID NO: 12161 - DNA, 369 bp, synthetic construct; identical to SEQ ID NO: 6492
  misc_feature 1..369: note = Synthetic polypeptide
  source 1..369: mol_type = other DNA

SEQ ID NO: 12162 - DNA, 233 bp, synthetic construct; identical to SEQ ID NO: 856
  misc_feature 1..233: note = Synthetic polypeptide
  source 1..233: mol_type = other DNA

SEQ ID NO: 12163 - DNA, 610 bp, synthetic construct; identical to SEQ ID NO: 8445
  misc_feature 1..610: note = Synthetic polypeptide
  source 1..610: mol_type = other DNA

SEQ ID NO: 12164 - DNA, 1047 bp, synthetic construct; identical to SEQ ID NO: 8446
  misc_feature 1..1047: note = Synthetic polypeptide
  source 1..1047: mol_type = other DNA

SEQ ID NO: 12165 - DNA, 809 bp, synthetic construct
  misc_feature 1..809: note = Synthetic polypeptide
  source 1..809: mol_type = other DNA
cctggttctctggggcacgaggcttctcctcagcactctggcgcccccaacaggttcccagtgttcggctggggcaggcacgctgtggctggctgcttcccttccttccatcccctttggaccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgctgtctctcctccagcaagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacgagaaattaatgctgatataaaacgtaaattagtgaaggaactccgatgcgttggacaaaaatatgaaaaaatcttcgaaatgcttgaaggagtgcaaggacctactgcagtcaggaagcgattttttgaatccatcatcaaggaagcagcaagatgtatgagacgagactttgttaagcaccttaagaagaaactgaaacgtatgatttga

SEQ ID NO: 12166 - DNA, 1083 bp, synthetic construct; identical to SEQ ID NO: 7080
  misc_feature 1..1083: note = Synthetic polypeptide
  source 1..1083: mol_type = other DNA

SEQ ID NO: 12167 - DNA, 809 bp, synthetic construct
  misc_feature 1..809: note = Synthetic polypeptide
  source 1..809: mol_type = other DNA
cctggttctctggggcacgaggcttctcctcagcactctggcgcccccaacaggttcccagtgttcggctggggcaggcacgctgtggctggctgcttcccttccttccatcccctttggaccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgctgtctctcctccagcaagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 12168 - DNA, 499 bp, synthetic construct
  misc_feature 1..499: note = Synthetic polypeptide
  source 1..499: mol_type = other DNA
ctaatatgatgaatgatttggaaaccatgtcatgagaacccaggagaactgtgaacatttcccttgtcaggagaagacttcatggcggcggctatggttgccttctgataattgaaggatccctagtggaataaggaacgaatttattgcagacattgtaagcaagaacaactggtaaatgttatagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaagagttcccgattttgaaatgctgggctcactcagaagtggcagccccttgtgctttggagaatgaggatatctgccaatggaacaagatgaagtataaatcag

SEQ ID NO: 12169 - DNA, 642 bp, synthetic construct
  misc_feature 1..642: note = Synthetic polypeptide
  source 1..642: mol_type = other DNA
ctaatatgatgaatgatttggaaaccatgtcatgagaacccaggagaactgtgaacatttcccttgtcaggagaagacttcatggcggcggctatggttgccttctgataattgaaggatccctagtggaataaggaacgaatttattgcagacattgtaagcaagaacaactggtaaatgttatagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaagagttcccgattttgaaatgctgggctcactcagaagtggcagccccttgtgctttggagaatgaggatatctgccaatggaacaagatgaagtataaatcagtatataagaatgtgattctacaagttccagtgggactgactgtacatacctctctagtatgttctgtgactctgctcattacaatcctgtgctctacattgatccttgtagcagttttcaaatatggccatttttccctataa

SEQ ID NO: 12170 - DNA, 696 bp, synthetic construct
  misc_feature 1..696: note = Synthetic polypeptide
  source 1..696: mol_type = other DNA
ctaatatgatgaatgatttggaaaccatgtcatgagaacccaggagaactgtgaacatttcccttgtcaggagaagacttcatggcggcggctatggttgccttctgataattgaaggatccctagtggaataaggaacgaatttattgcagacattgtaagcaagaacaactggtaaatgttatagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaagctggctccagaagaatgatcagattccggtttgattcctttgacaaaactatagagttcccgattttgaaatgctgggctcactcagaagtggcagccccttgtgctttggagaatgaggatatctgccaatggaacaagatgaagtataaatcagtatataagaatgtgattctacaagttccagtgggactgactgtacatacctctctagtatgttctgtgactctgctcattacaatcctgtgctctacattgatccttgtagcagttttcaaatatggccatttttccctataa

SEQ ID NO: 12171 - DNA, 441 bp, synthetic construct
  misc_feature 1..441: note = Synthetic polypeptide
  source 1..441: mol_type = other DNA
ctaatatgatgaatgatttggaaaccatgtcatgagaacccaggagaactgtgaacatttcccttgtcaggagaagacttcatggcggcggctatggttgccttctgataattgaaggatccctagtggaataaggaacgaatttattgcagacattgtaagcaagaacaactggtaaatgttatagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaaggtgagggctgcaagtgttttctaagggttgaaacatcagaataa

SEQ ID NO: 12172 - DNA, 371 bp, synthetic construct
  misc_feature 1..371: note = Synthetic polypeptide
  source 1..371: mol_type = other DNA
ctaatatgatgaatgatttggaaaccatgtcatgagaacccaggagaactgtgaacatttcccttgtcaggagaagacttcatggcggcggctatggttgccttctgataattgaaggatccctagtggaataaggaacgaatttattgcagacattgtaagcaagaacaactggtaaatgttatagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataaccc

SEQ ID NO: 12173 - DNA, 2546 bp, synthetic construct
  misc_feature 1..2546: note = Synthetic polypeptide
  source 1..2546: mol_type = other DNA
ctagaatttctgctgtaggaggtacttatgcagtaatctcgttgggaggcggagactggagttggagtcttaagagttgtgtttttgcgaacatcctaagcacgttcttggttatttcaattgtagcttattggaggtgcttgggagatggggggaggcggaaacctgagaagcttgattctttgctctcagactacgatattctctctttatctaatatccagcagcattcggtaagaaaaagagatctacagacttcaacacatgtagaaacactactaactttttcagctttgaaaaggcattttaaattatacctgacatcaagtactgaacgtttttcacaaaatttcaaggtcgtggtggtggatggtaaaaacgaaagcgagtacactgtaaaatggcaggacttcttcactggacacgtggttggtgagcctgactctagggttctagcccacataagagatgatgatgttataatcagaatcaacacagatggggccgaatataacatagagccactttggagatttgttaatgataccaaagacaaaagaatgttagtttataaatctgaagatatcaagaatgtttcacgtttgcagtctccaaaagtgtgtggttatttaaaagtggataatgaagagttgctcccaaaagggttagtagacagagaaccacctgaagagcttgttcatcgagtgaaaagaagagctgacccagatcccatgaagaacacgtgtaaattattggtggtagcagatcatcgcttctacagatacatgggcagaggggaagagagtacaactacaaattacttaatagagctaattgacagagttgatgacatctatcggaacacttcatgggataatgcaggttttaaaggctatggaatacagatagagcagattcgcattctcaagtctccacaagaggtaaaacctggtgaaaagcactacaacatggcaaaaagttacccaaatgaagaaaaggatgcttgggatgtgaagatgttgctagagcaatttagctttgatatagctgaggaagcatctaaagtttgcttggcacaccttttcacataccaagattttgatatgggaactcttggattagcttatgttggctctcccagagcaaacagccatggaggtgtttgtccaaaggcttattatagcccagttgggaagaaaaatatctatttgaatagtggtttgacgagcacaaagaattatggtaaaaccatccttacaaaggaagctgacctggttacaactcatgaattgggacataattttggagcagaacatgatccggatggtctagcagaatgtgccccgaatgaggaccagggagggaaatatgtcatgtatcccatagctgtgagtggcgatcacgagaacaataagatgttttcaaactgcagtaaacaatcaatctataagaccattgaaagtaaggcccaggagtgttttcaagaacgcagcaataaagtttgtgggaactcgagggtggatgaaggagaagagtgtgatcctggcatcatgtatctgaacaacgacacctgctgcaacagcgactgcacgttgaaggaaggtgtccagtgcagtgacaggaacagtccttgctgtaaaaactgtcagtttgagactgcccagaagaagtgccaggaggcgattaatgctacttgcaaaggcgtgtcctactgcacaggtaatagcagtgagtgcccgcctccaggaaatgctgaagatgacactgtttgcttggatcttggcaagtgtaaggatgggaaatgcatccctttctgcgagagggaacagcagctggagtcctgtgcatgtaatgaaactgacaactcctgcaaggtgtgctgcagggacctttctggccgctgtgtgccctatgtcgatgctgaacaaaagaacttatttttgaggaaaggaaagccctgtacagtaggattttgtgacatgaatggcaaatgtgagaaacgagtacaggatgtaattgaacgattttgggatttcattgaccagctgagcatcaatacttttggaaagtttttagcagacaacatcgttgggtctgtcctggttttctccttgatattttggattcctttcagcattcttgtccattgtgtggataagaaattggataaacagtatgaatctctgtctctgtttcaccccagtaacgtcgaaatgctgagcagcatggattctgcatcggttcgcattatcaaaccctttcctgcgccccagactccaggccgcctgcagcctgcccctgtgatcccttcggcgccagcagctccaaaactggaccaccagagaatggacaccatccaggaagaccccagcacagactcacatatggacgaggatgggtttgagaaggaccccttcccaaatagcagcacagctgccaagtcatttgaggatctcacggaccatccggtcaccagaagtgaaaaggctgcctcctttaaactgcagcgtcagaatcgtgttgacagcaaagaaacagagtgctaa

SEQ ID NO: 12174 - DNA, 929 bp, synthetic construct
  misc_feature 1..929: note = Synthetic polypeptide
  source 1..929: mol_type = other DNA
ctagaatttctgctgtaggaggtacttatgcagtaatctcgttgggaggcggagactggagttggagtcttaagagttgtgtttttgcgaacatcctaagcacgttcttggttatttcaattgtagcttattggaggtgcttgggagatggggggaggcggaaacctgagaagcttgattctttgctctcagactacgatattctctctttatctaatatccagcagcattcggtaagaaaaagagatctacagacttcaacacatgtagaaacactactaactttttcagctttgaaaaggcattttaaattatacctgacatcaagtactgaacgtttttcacaaaatttcaaggtcgtggtggtggatggtaaaaacgaaagcgagtacactgtaaaatggcaggacttcttcactggacacgtggttggtgagcctgactctagggttctagcccacataagagatgatgatgttataatcagaatcaacacagatggggccgaatataacatagagccactttggagatttgttaatgataccaaagacaaaagaatgttagtttataaatctgaagatatcaagaatgtttcacgtttgcagtctccaaaagtgtgtggttatttaaaagtggataatgaagagttgctcccaaaagggttagtagacagagaaccacctgaagagcttgttcatcgagtgaaaagaagagctgacccagatcccatgaagaacacgtgtaaattattggtggtagcagatcatcgcttctacagatacatgggcagaggggaagagagtacaactacaaattacttaatagagctaattgacagagttgatgacatctatcggaacacttcatgggataatgcaggttttaaaggctatggaatacagatagagcagttattatttgaatag

SEQ ID NO: 12175 - DNA, 853 bp, synthetic construct; identical to SEQ ID NO: 9052
  misc_feature 1..853: note = Synthetic polypeptide
  source 1..853: mol_type = other DNA

SEQ ID NO: 12176 - DNA, 265 bp, synthetic construct; identical to SEQ ID NO: 9053
  misc_feature 1..265: note = Synthetic polypeptide
  source 1..265: mol_type = other DNA

SEQ ID NO: 12177 - DNA, 7177 bp, synthetic construct; identical to SEQ ID NO: 574
  misc_feature 1..7177: note = Synthetic polypeptide
  source 1..7177: mol_type = other DNA

SEQ ID NO: 12178 - DNA, 7195 bp, synthetic construct; identical to SEQ ID NO: 575
  misc_feature 1..7195: note = Synthetic polypeptide
  source 1..7195: mol_type = other DNA

SEQ ID NO: 12179 - DNA, 763 bp, synthetic construct; identical to SEQ ID NO: 9627
  misc_feature 1..763: note = Synthetic polypeptide
  source 1..763: mol_type = other DNA

SEQ ID NO: 12180 - DNA, 2264 bp, synthetic construct; identical to SEQ ID NO: 9628
  misc_feature 1..2264: note = Synthetic polypeptide
  source 1..2264: mol_type = other DNA

SEQ ID NO: 12181 - DNA, 4725 bp, synthetic construct; identical to SEQ ID NO: 8344
  misc_feature 1..4725: note = Synthetic polypeptide
  source 1..4725: mol_type = other DNA

SEQ ID NO: 12182 - DNA, 4530 bp, synthetic construct; identical to SEQ ID NO: 8345
  misc_feature 1..4530: note = Synthetic polypeptide
  source 1..4530: mol_type = other DNA

SEQ ID NO: 12183 - DNA, 4557 bp, synthetic construct; identical to SEQ ID NO: 8346
  misc_feature 1..4557: note = Synthetic polypeptide
  source 1..4557: mol_type = other DNA

SEQ ID NO: 12184 - DNA, 4380 bp, synthetic construct; identical to SEQ ID NO: 8347
  misc_feature 1..4380: note = Synthetic polypeptide
  source 1..4380: mol_type = other DNA

SEQ ID NO: 12185 - DNA, 4548 bp, synthetic construct; identical to SEQ ID NO: 8348
  misc_feature 1..4548: note = Synthetic polypeptide
  source 1..4548: mol_type = other DNA

SEQ ID NO: 12186 - DNA, 4755 bp, synthetic construct; identical to SEQ ID NO: 8349
  misc_feature 1..4755: note = Synthetic polypeptide
  source 1..4755: mol_type = other DNA

SEQ ID NO: 12187 - DNA, 1490 bp, synthetic construct; identical to SEQ ID NO: 7414
  misc_feature 1..1490: note = Synthetic polypeptide
  source 1..1490: mol_type = other DNA

SEQ ID NO: 12188 - DNA, 1031 bp, synthetic construct; identical to SEQ ID NO: 7415
  misc_feature 1..1031: note = Synthetic polypeptide
  source 1..1031: mol_type = other DNA

SEQ ID NO: 12189 - DNA, 1079 bp, synthetic construct; identical to SEQ ID NO: 7416
  misc_feature 1..1079: note = Synthetic polypeptide
  source 1..1079: mol_type = other DNA

SEQ ID NO: 12190 - DNA, 974 bp, synthetic construct
  misc_feature 1..974: note = Synthetic polypeptide
  source 1..974: mol_type = other DNA
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatgctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 12191 - DNA, 896 bp, synthetic construct
  misc_feature 1..896: note = Synthetic polypeptide
  source 1..896: mol_type = other DNA
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatgctttggagcaattcccatcgaccagagttggtccgaccagccttggaaaggtcactgaaaaatcttcaattggactatgttgacctctatcttattcattttccagtgtctgtaaaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 12192 - DNA, 604 bp, synthetic construct
  misc_feature 1..604: note = Synthetic polypeptide
  source 1..604: mol_type = other DNA
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatgctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaa

SEQ ID NO: 12193 - DNA, 422 bp, synthetic construct
  misc_feature 1..422: note = Synthetic polypeptide
  source 1..422: mol_type = other DNA
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatgctttggagcaattcccatcgaccagagttggtccgaccagccttggaaaggtcactgaaaaatcttcaattggactatgttgacctctatcttattcattttccagtgtctgtaaaggaggacatagggattttaacatggaagaagagccctaaacataactcctaa

SEQ ID NO: 12194 - DNA, 380 bp, synthetic construct
  misc_feature 1..380: note = Synthetic polypeptide
  source 1..380: mol_type = other DNA
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatggtgtttgaattccagttgacttcagaggagatgaaagccatagatggcctaaacagaaatgtgcgatatttgacccttgatatttttgctggcccccctaattatccattttctgatgaatattaa

SEQ ID NO: 12195 - DNA, 347 bp, synthetic construct; identical to SEQ ID NO: 452
  misc_feature 1..347: note = Synthetic polypeptide
  source 1..347: mol_type = other DNA

SEQ ID NO: 12196 - DNA, 148 bp, synthetic construct; identical to SEQ ID NO: 454
  misc_feature 1..148: note = Synthetic polypeptide
  source 1..148: mol_type = other DNA

SEQ ID NO: 12197 - DNA, 1222 bp, synthetic construct
  misc_feature 1..1222: note = Synthetic polypeptide
  source 1..1222: mol_type = other DNA
gagtgtaagagtggttgaggcttggcacttgccacctagatttcagacaatgtgtcaggaatcctggatacccagagagaatcctgttccagggccggatccccaacataaagcttttatttaggcaatgttgagcactaatatgtggttggagctctgcagggggtctccatgggtgcactgtgtagcaaagctgtgggagaaaggccttacccctcaaaattccagaattataaatctaccaggcgctaacaacttcagcctggaaaagccatgggcattaaactccaaactgtgagagcagccatgtgggctgcaccctgcaaagccacaggttcctaaaagtaaagctttagaggccaccaaattggcaattgaagctggcttccgccatattgattctgctcatttatacaataatgaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 12198 - DNA, 862 bp, synthetic construct
  misc_feature 1..862: note = Synthetic polypeptide
  source 1..862: mol_type = other DNA
gagtgtaagagtggttgaggcttggcacttgccacctagatttcagacaatgtgtcaggaatcctggatacccagagagaatcctgttccagggccggatccccaacataaagcttttatttaggcaatgttgagcactaatatgtggttggagctctgcagggggtctccatgggtgcactgtgtagcaaagctgtgggagaaaggccttacccctcaaaattccagaattataaatctaccaggcgctaacaacttcagcctggaaaagccatgggcattaaactccaaactgtgagagcagccatgtgggctgcaccctgcaaagccacaggttcctaaaagtaaagctttagaggccaccaaattggcaattgaagctggcttccgccatattgattctgctcatttatacaataatgaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccagcctagagataattccatcttttccttgagtcctgactggtga

SEQ ID NO: 12199 - DNA, 527 bp, synthetic construct
  misc_feature 1..527: note = Synthetic polypeptide
  source 1..527: mol_type = other DNA
ggccaggtacagtggctcacacctgtaatcccagcactatggggggctgagacggtcggatcacctgaggttaggagttggagaccagcctgaccaacacggagaaaccctgtctctactaaaaatacaaaatcagctgggcatggtggcgggtgcctgtaatcccagctactcgggaggctgaggcgggagaatcacttgaacccggaaggtggaggttgcagtgagctgagattgcgccattggactccagcttggtgaaagtagagcctattcccgccattggccacgccacgctcggcactgccagccggatcattcagacggcacagaccaccccggtccagacggtgaccatagtacaacaggcacctctaggtcaacaccagctaccaataaaaactgtaacacaaaacggcactcacgtggcatcagtccccactgcggtccacggccaggtgaacaatgggccccttggcctcagaaggcccccatgtgccagctcagactggagttgcctcagttga

SEQ ID NO: 12200 - DNA, 665 bp, synthetic construct
  misc_feature 1..665: note = Synthetic polypeptide
  source 1..665: mol_type = other DNA
ggccaggtacagtggctcacacctgtaatcccagcactatggggggctgagacggtcggatcacctgaggttaggagttggagaccagcctgaccaacacggagaaaccctgtctctactaaaaatacaaaatcagctgggcatggtggcgggtgcctgtaatcccagctactcgggaggctgaggcgggagaatcacttgaacccggaaggtggaggttgcagtgagctgagattgcgccattggactccagcttggtgaaagtagagcctattcccgccattggccacgccacgctcggcactgccagccggatcattcagacggcacagaccaccccggtccagacggtgaccatagtacaacaggcacctctaggtcaacaccagctaccaataaaaactgtaacacaaaacggcactcacgtggcatcagtccccactgcggtccacggccaggtgaacaatgccgcggcgagtcctttgcacatgttggcaacacacgcatccgcatcggcctccctgcccacaaagcgccacaacggtgaccagccggagcagccggagctgaagcggatcaagacagaagacggcgagggcatcgtcattgccctgagcgtggacacgccaccggcagccgtaagggaaaagggtgtccagaactag

SEQ ID NO: 12201 - DNA, 575 bp, synthetic construct
  misc_feature 1..575: note = Synthetic polypeptide
  source 1..575: mol_type = other DNA
ggccaggtacagtggctcacacctgtaatcccagcactatggggggctgagacggtcggatcacctgaggttaggagttggagaccagcctgaccaacacggagaaaccctgtctctactaaaaatacaaaatcagctgggcatggtggcgggtgcctgtaatcccagctactcgggaggctgaggcgggagaatcacttgaacccggaaggtggaggttgcagtgagctgagattgcgccattggactccagcttggtgaaagtagagcctattcccgccattggccacgccacgctcggcactgccagccggatcattcagacggcacagaccaccccggtccagacggtgaccatagtacaacaggcacctctaggtcaacaccagctaccaataaaaactgtaacacaaaacggcactcacgtggcatcagtccccactgcggtccacggccaggtgaacaatggtaagacatgctggtcggtggctccccgtggctgtgggtactgggagcagagccccttctcactcgtggtttcggttctgactgtaacaattttagcttttgtctga

SEQ ID NO: 12202 - DNA, 1653 bp, synthetic construct
  misc_feature 1..1653: note = Synthetic polypeptide
  source 1..1653: mol_type = other DNA
tgatatggtctggctctgtgtccccacccaaatctgatcttgtaactcccataattcccatgtgttgtgggaggaacccagtgggagatgattgagtcatgggggtgggtctttaccctgctgttctcatgatagtgcatgagtctcatgagatctgatggttttaaaaaacaggagttgccctgaacaagctctcttttttcctgccgtcatccatttaagatgtgacttactcctccttaccgtccgccatgactgtgaggtctccccagccacatggaactaaaagctcaagaggagaacaagaaaatcgtactggctggatgcgttcctcaagcccagcctcgccaggactaccttaagggactgagtatcattggggttcagcagatagatcgtgtggtagaagttgtggaggagacaattaaaggtcactctgtgagactgctgggtcagaaaaaggataatggaaggcggcttgggggagcacgattggatttgccgaagattaggaagaatccactgatagaaatcatttccatcaataccgggtgtctcaatgcttgtacctactgcaaaactaaacacgccagaggaaatttggccagttatccaattgatgaactagtagatagagccaaacaatcttttcaagagggtgtttgtgagatatggttgaccagtgaagacacgggggcttatggcagagatattggcaccaatctccccacactcctgtggaaactggttgaagtgattcctgagggagcaatgctgaggcttggcatgacaaatccgccctatattttagagcatctggaggaaatggcaaaaatccttaatcaccccagagtctacgcttttctgcacataccagtccagtctgcctccgacagcgtactcatggaaatgaaaagagaatactgtgtggctgacttcaaaagagtagtggattttctgaaagagaaagttcctggaataactattgctacagatattatctgtggttttcctggagaaacagatcaggattttcaagaaacagtgaaacttgttgaagagtacaaattcccaagcctgtttattaaccaattttacccaagaccaggaactcctgctgcaaaaatggaacaagttccagcacaagtgaaaaagcaaaggacaaaagatctttctcgggtgtttcattcttacagtccatatgatcacaagattggtgaaagacaacaagtgttagtaacagaagaatcttttgattccaagttttatgttgcacacaatcaattctatgagcaggttttagtgccaaagaaccctgcgttcatggggaagatggttgaagtggacatctatgaatcaggcaaacattttatgaaagggcagccagtatctgatgccaaagtgtacacgccctccatcagcaaaccgctagcaaagggagaagtctcgggtttgacaaaggacttcagaaatgggcttgggaaccagctgagttcaggatcccacacctctgctgcatctcagtgtgactcagcgagttccagaatggtgctgcccatgccaaggctacatcaagactgtgcgctgaggatgtccgtgggcttggctctgctgggtcttctttttgctttttttgtcaaggtctataattag

SEQ ID NO: 12203 - DNA, 1590 bp, synthetic construct
  misc_feature 1..1590: note = Synthetic polypeptide
  source 1..1590: mol_type = other DNA
tgatatggtctggctctgtgtccccacccaaatctgatcttgtaactcccataattcccatgtgttgtgggaggaacccagtgggagatgattgagtcatgggggtgggtctttaccctgctgttctcatgatagtgcatgagtctcatgagatctgatggttttaaaaaacaggagttgccctgaacaagctctcttttttcctgccgtcatccatttaagatgtgacttactcctccttaccgtccgccatgactgtgaggtctccccagccacatggaactaaaagctcaagaggagaacaagaaaatcgtactggctggatgcgttcctcaagcccagcctcgccaggactaccttaagggactgagtatcattggggttcagcagatagatcgtgtggtagaagttgtggaggagacaattaaaggtcactctgtgagactgctgggtcagaaaaaggataatggaaggcggcttgggggagcacgattggatttgccgaagattaggaagaatccactgatagaaatcatttccatcaataccgggtgtctcaatgcttgtacctactgcaaaactaaacacgccagaggaaatttggccagttatccaattgatgaactagtagatagagccaaacaatcttttcaagagggtgtttgtgagatatggttgaccagtgaagacacgggggcttatggcagagatattggcaccaatctccccacactcctgtggaaactggttgaagtgattcctgagggagcaatgctgaggcttggcatgacaaatccgccctatattttagagcatctggaggaaatggcaaaaatccttaatcaccccagagtctacgcttttctgcacataccagtccagtctgcctccgacagcgtactcatggaaatgaaaagagaatactgtgtggctgacttcaaaagagtagtggattttctgaaagagaaagttcctggaataactattgctacagatattatctgtggttttcctggagaaacagatcaggattttcaagaaacagtgaaacttgttgaagagtacaaattcccaagcctgtttattaaccaattttacccaagaccaggaactcctgctgcaaaaatggaacaagttccagcacaagtgattggtgaaagacaacaagtgttagtaacagaagaatcttttgattccaagttttatgttgcacacaatcaattctatgagcaggttttagtgccaaagaaccctgcgttcatggggaagatggttgaagtggacatctatgaatcaggcaaacattttatgaaagggcagccagtatctgatgccaaagtgtacacgccctccatcagcaaaccgctagcaaagggagaagtctcgggtttgacaaaggacttcagaaatgggcttgggaaccagctgagttcaggatcccacacctctgctgcatctcagtgtgactcagcgagttccagaatggtgctgcccatgccaaggctacatcaagactgtgcgctgaggatgtccgtgggcttggctctgctgggtcttctttttgctttttttgtcaaggtctataattag

SEQ ID NO: 12204 - DNA, 1503 bp, synthetic construct; identical to SEQ ID NO: 8103
  misc_feature 1..1503: note = Synthetic polypeptide
  source 1..1503: mol_type = other DNA

SEQ ID NO: 12205 - DNA, 645 bp, synthetic construct; identical to SEQ ID NO: 8104
  misc_feature 1..645: note = Synthetic polypeptide
  source 1..645: mol_type = other DNA

SEQ ID NO: 12206 - DNA, 343 bp, synthetic construct; identical to SEQ ID NO: 8105
  misc_feature 1..343: note = Synthetic polypeptide
  source 1..343: mol_type = other DNA

SEQ ID NO: 12207 - DNA, 489 bp, synthetic construct
  misc_feature 1..489: note = Synthetic polypeptide
  source 1..489: mol_type = other DNA
ccaagatggccaaataggaacagctccagtctacagctcccagcgtgagtgacgcagaagatgggtgatttctgcatttccaactgaggttcttgggccaattttatgctgactcagccccactctgtgtcggagtctccggggaagacggtaaccatctcctgcacccgcagcagtggcagcattgccagcaactatgtgcagtggtaccagcagcgcccgggcagttcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaatcacacagtgctccagacccatggggaagtgagacagaaactccccagagcatctctacctgggccagtctcagcctgtctccaccagagagggtag

SEQ ID NO: 12208 - DNA, 74 bp, synthetic construct; identical to SEQ ID NO: 7010
  misc_feature 1..74: note = Synthetic polypeptide
  source 1..74: mol_type = other DNA

SEQ ID NO: 12209 - DNA, 826 bp, synthetic construct
  misc_feature 1..826: note = Synthetic polypeptide
  source 1..826: mol_type = other DNA
cctggttctctggggcacgaggcttctcctcagcactctggcgcccccaacaggttcccagtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaaggtcaggacttcaggactggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 12210 - DNA, 373 bp, synthetic construct; identical to SEQ ID NO: 896
  misc_feature 1..373: note = Synthetic polypeptide
  source 1..373: mol_type = other DNA

SEQ ID NO: 12211 - DNA, 335 bp, synthetic construct
  misc_feature 1..335: note = Synthetic polypeptide
  source 1..335: mol_type = other DNA
tgttatggattgaatgcgtgttcctccaaaatttcatatgttacaatcctaaccccaatggtgatgacattagaaggtagagtttggaggaggtaattaggtcatgagggtggacccctcatgaatgggttgaatacccttagaaaagcgacttcagagagctctctctctttctaccaggtgaggatacagtgagaagacagccgtctgcaatcaggaaggggactctcaccagacaacaagtcttccagcacctttatcttggacttccagcctccagaattatgacaaaagcggttattgagcattcgctgtgtaccaagtgctgtccttga

SEQ ID NO: 12212 - DNA, 1217 bp, synthetic construct; identical to SEQ ID NO: 765
  misc_feature 1..1217: note = Synthetic polypeptide
  source 1..1217: mol_type = other DNA

SEQ ID NO: 12213 - DNA, 1139 bp, synthetic construct; identical to SEQ ID NO: 766
  misc_feature 1..1139: note = Synthetic polypeptide
  source 1..1139: mol_type = other DNA

SEQ ID NO: 12214 - DNA, 847 bp, synthetic construct; identical to SEQ ID NO: 768
  misc_feature 1..847: note = Synthetic polypeptide
  source 1..847: mol_type = other DNA

SEQ ID NO: 12215 - DNA, 665 bp, synthetic construct; identical to SEQ ID NO: 769
  misc_feature 1..665: note = Synthetic polypeptide
  source 1..665: mol_type = other DNA

SEQ ID NO: 12216 - DNA, 826 bp, synthetic construct
  misc_feature 1..826: note = Synthetic polypeptide
  source 1..826: mol_type = other DNA
cctggttctctggggcacgaggcttctcctcagcactctggcgcccccaacaggttcccagtgttcggctgggacaggcacgctgtggctggctacttcccttccttccatcccccttgggccaaacaggatcggtgcttctggtgagacgtctccccatgcacatcactcccagatgccctagggggcacatttcccacaactcccagagggcaggtttctagaaagtgccaccagtggggaggcgccacaacttcactgccattttgtgaggtgccgccgtctctcctccagcaaggtcaggacttcaggactggaatgtgacagtccttcgtatcagaaaaggcagaggatggccctgttggcaaggaaacaaggagcaggagacagccttattgcaggctctgccatgtccaaagcaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 12217 - DNA, 826 bp, synthetic construct; identical to SEQ ID NO: 12209
  misc_feature 1..826: note = Synthetic polypeptide
  source 1..826: mol_type = other DNA

SEQ ID NO: 12218 - DNA, 826 bp, synthetic construct
  misc_feature 1..826: note = Synthetic polypeptide
  source 1..826: mol_type = other DNA
cctggttctctggggcacgaggcttctcctcagcactctggcgcccccaacaggttcccagtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaaggtcaggacttcaggactggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagatgggatgatgcagaaacctggtagcaatgcacctgtgggaggaaatgttaccagcaatttctctggagatgacctagaatgcagaggaatagcctcctctcccaaaagccaacaagaaattaatgctgatataaaatgtcaagtagtgaaggaaatccgatgccttggacgaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 12219 - DNA, 119 bp, synthetic construct; identical to SEQ ID NO: 6582
  misc_feature 1..119: note = Synthetic polypeptide
  source 1..119: mol_type = other DNA

SEQ ID NO: 12220 - DNA, 826 bp, synthetic construct
  misc_feature 1..826: note = Synthetic polypeptide
  source 1..826: mol_type = other DNA
cctggttctctggggcacgaggcttctcctcagcactctggcgcccccaacaggttcccagtgttcggctgggacaggcacgctgtggctggctacttcccttccttccatcccccttgggccaaacaggatcggtgcttctggtgagacgtctccccatgcacatcactcccagatgccctagggggcacatttcccacaactcccagagggcaggtttctagaaagtgccaccagtggggaggcgccacaacttcactgccattttgtgaggtgccgccgtctctcctccagcaaggtcaggacttcaggactggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 12221 - DNA, 826 bp, synthetic construct
  misc_feature 1..826: note = Synthetic polypeptide
  source 1..826: mol_type = other DNA
cctggttctctggggcacgaggcttctcctcagcactctggcgcccccaacaggttcccagtgttcggctgggacaggcacgctgtggctggctacttcccttccttccatcccccttgggccaaacaggatcggtgcttctggtgagacgtctccccatgcacatcactcccagatgccctagggggcacatttcccacaactcccagagggcaggtttctagaaagtgccaccagtggggaggcgccacaacttcactgccattttgtgaggtgccgccgtctctcctccagcaaggtcaggacttcaggactggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagatgggatgatgcagaaacctggtagcaatgcacctgtgggaggaaatgttaccagcaatttctctggagatgacctagaatgcagaggaatagcctcctctcccaaaagccaacaagaaattaatgctgatataaaatgtcaagtagtgaaggaaatccgatgccttggacgaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 12222 - DNA, 1002 bp, synthetic construct; identical to SEQ ID NO: 872
  misc_feature 1..1002: note = Synthetic polypeptide
  source 1..1002: mol_type = other DNA

SEQ ID NO: 12223 - DNA, 897 bp, synthetic construct; identical to SEQ ID NO: 873
  misc_feature 1..897: note = Synthetic polypeptide
  source 1..897: mol_type = other DNA

SEQ ID NO: 12224 - DNA, 836 bp, synthetic construct; identical to SEQ ID NO: 874
  misc_feature 1..836: note = Synthetic polypeptide
  source 1..836: mol_type = other DNA

SEQ ID NO: 12225 - DNA, 528 bp, synthetic construct; identical to SEQ ID NO: 875
  misc_feature 1..528: note = Synthetic polypeptide
  source 1..528: mol_type = other DNA

SEQ ID NO: 12226 - DNA, 2003 bp, synthetic construct; identical to SEQ ID NO: 8385
  misc_feature 1..2003: note = Synthetic polypeptide
  source 1..2003: mol_type = other DNA

SEQ ID NO: 12227 - DNA, 807 bp, synthetic construct; identical to SEQ ID NO: 7401
  misc_feature 1..807: note = Synthetic polypeptide
  source 1..807: mol_type = other DNA

SEQ ID NO: 12228 - DNA, 453 bp, synthetic construct; identical to SEQ ID NO: 7402
  misc_feature 1..453: note = Synthetic polypeptide
  source 1..453: mol_type = other DNA

SEQ ID NO: 12229 - DNA, 2725 bp, synthetic construct; identical to SEQ ID NO: 6753
  misc_feature 1..2725: note = Synthetic polypeptide
  source 1..2725: mol_type = other DNA

SEQ ID NO: 12230 - DNA, 1164 bp, synthetic construct; identical to SEQ ID NO: 7133
  misc_feature 1..1164: note = Synthetic polypeptide
  source 1..1164: mol_type = other DNA

SEQ ID NO: 12231 - DNA, 376 bp, synthetic construct; identical to SEQ ID NO: 7134
  misc_feature 1..376: note = Synthetic polypeptide
  source 1..376: mol_type = other DNA

SEQ ID NO: 12232 - DNA, 745 bp, synthetic construct; identical to SEQ ID NO: 804
  misc_feature 1..745: note = Synthetic polypeptide
  source 1..745: mol_type = other DNA

SEQ ID NO: 12233 - DNA, 1737 bp, synthetic construct; identical to SEQ ID NO: 905
  misc_feature 1..1737: note = Synthetic polypeptide
  source 1..1737: mol_type = other DNA

SEQ ID NO: 12234 - DNA, 284 bp, synthetic construct; identical to SEQ ID NO: 906
  misc_feature 1..284: note = Synthetic polypeptide
  source 1..284: mol_type = other DNA

SEQ ID NO: 12235 - DNA, 856 bp, synthetic construct; identical to SEQ ID NO: 907
  misc_feature 1..856: note = Synthetic polypeptide
  source 1..856: mol_type = other DNA

SEQ ID NO: 12236 - DNA, 802 bp, synthetic construct; identical to SEQ ID NO: 908
  misc_feature 1..802: note = Synthetic polypeptide
  source 1..802: mol_type = other DNA

SEQ ID NO: 12237 - DNA, 561 bp, synthetic construct; identical to SEQ ID NO: 909
  misc_feature 1..561: note = Synthetic polypeptide
  source 1..561: mol_type = other DNA

SEQ ID NO: 12238 - DNA, 582 bp, synthetic construct; identical to SEQ ID NO: 910
  misc_feature 1..582: note = Synthetic polypeptide
  source 1..582: mol_type = other DNA

SEQ ID NO: 12239 - DNA, 2025 bp, synthetic construct
  misc_feature 1..2025: note = Synthetic polypeptide
  source 1..2025: mol_type = other DNA
ggtttggctgtgtccccacacaagtctcaacttgaattataactctcagaattcccatgtgttgtgggagggacccagtggggaggtaatttagtcatgagggccggtctttcccgtgctattctcatgatagtgaacaagtctcacgagatctgatgggtttatcaggggtttctgcttttgcatctttctctttttctcttgctactgccacataagaagtgcctttctcctcctgccatgattctgaggcctccccagccatgtggaactcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtagtaaccagtctgttcggcacttgaagtactccttgtttaagaaatcactactgggcagtgtttcggataatggaatagtaactctctgggatgtaaatagtcagagtccataccataactttgacagtgtacacaaagctccagcgtcaggcatctgtttttctcctgtcaatgaattgctctttgtaaccataggcttggataaaagaatcatcctctatgacacttcaagtaagaagctagtgaaaactttagtggctgacactcctctaactgcggtagatttcatgcctgatggagccactttggctattggatcttcccgggggaaaatatatcaatatgatttaagaatgttgaaatcaccagttaagaccatcagtgctcacaagacatctgtgcagtgtatagcatttcagtactccactgttcttactaagtcaagtttaaataaaggctgttcaaataagcccacaacagtgaacaaacgaagtgttaatgtgaatgctgctagtggaggagttcagaattccggaattgtcagagaagcacctgccacgtccattgccacagttctaccacaacctatgacatcagctatggggaaaggaacagttgctgttcaagaaaaagcaggtttgcctcgaagcataaacacagacactttatctaaggaaacagacagtggaaaaaatcaggatttctccagctttgatgatactgggaaaagtagtttaggtgacatgttctcacctatcagagatgatgctgtagttaacaagggaagtgatgagtccataggcaaaggagatggctttgactttctaccgcagttgaactcagtgtttcctccaagaaaaaatccagtaacttcaagtacttcagtattgcattctagtcctcttaatgtttttatgggatctccagggaaagaggaaaatgaaaaccgtgatctaacagctgagtctaagaaaatatatatgggaaaacaggaatctaaagactccttcaaacagttagcaaagttggtcacatctggtgctgaaagtggaaatctaaatacctctccatcatctaaccaaacaagaaattctgagaaatttgaaaagccagagaatgaaattgaagcccagttgatatgtgaacccccaatcaatggatcctcaactccaaatccaaagatagcatcttctgtcactgctggagttgccagttcactctcagaaaaaatagccgacagcattggaaataaccggcaaaatgcaccattgacttccattcaaattcgttttattcagaacatgatacaggaaacgttggatgactttagagaagcatgccatagggacattgtgaatttgcaagtggagatgattaaacagtttcatatgcaactgaatgaaatgcattctttgctggaaagatactcagtgaatgaaggtttagtggctgaaattgaaagactacgagaagaaaacaaaagattacgggcccacttttga

SEQ ID NO: 12240 - DNA, 524 bp, synthetic construct
  misc_feature 1..524: note = Synthetic polypeptide
  source 1..524: mol_type = other DNA
ggtttggctgtgtccccacacaagtctcaacttgaattataactctcagaattcccatgtgttgtgggagggacccagtggggaggtaatttagtcatgagggccggtctttcccgtgctattctcatgatagtgaacaagtctcacgagatctgatgggtttatcaggggtttctgcttttgcatctttctctttttctcttgctactgccacataagaagtgcctttctcctcctgccatgattctgaggcctccccagccatgtggaactcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtag

SEQ ID NO: 12241 - DNA, 536 bp, synthetic construct
  misc_feature 1..536: note = Synthetic polypeptide
  source 1..536: mol_type = other DNA
ggtttggctgtgtccccacacaagtctcaacttgaattataactctcagaattcccatgtgttgtgggagggacccagtggggaggtaatttagtcatgagggccggtctttcccgtgctattctcatgatagtgaacaagtctcacgagatctgatgggtttatcaggggtttctgcttttgcatctttctctttttctcttgctactgccacataagaagtgcctttctcctcctgccatgattctgaggcctccccagccatgtggaactcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtagtaaccagtctgt

SEQ ID NO: 12242 - DNA, 344 bp, synthetic construct
  misc_feature 1..344: note = Synthetic polypeptide
  source 1..344: mol_type = other DNA
ggtttggctgtgtccccacacaagtctcaacttgaattataactctcagaattcccatgtgttgtgggagggacccagtggggaggtaatttagtcatgagggccggtctttcccgtgctattctcatgatagtgaacaagtctcacgagatctgatgggtttatcaggggtttctgcttttgcatctttctctttttctcttgctactgccacataagaagtgcctttctcctcctgccatgattctgaggcctccccagccatgtggaactcaaaagcagacatgtgtcaatttaaattctacatctatgtatttggtaagcggaggcctaaataacactgt

SEQ ID NO: 12243 - DNA, 833 bp, synthetic construct
  misc_feature 1..833: note = Synthetic polypeptide
  source 1..833: mol_type = other DNA
tgatatagttaggctttgtgtcgccacccaaatgtcatcttgaattgtaatccccataatccccaggtgttgatggagagatcaggtggaggtaactgaatcatgggggtgggtcccccatgttgttctcgtgatagcgagtgagttctcctgagatctgatggttttataaggagctcttccccgcttcacctggcacttcttcctgccaccttgtgaagaaggtgccttgcttcccggacctttggcttctaccacgattgtgagtttcctgaggcctccccgccatgctgaactacaatggcgatgaccactcagaaggaggcctggtggagaaccacgtggacagcaccatgaacatgttgggcgggggaggcagtgctggccggaagcccctcaagtcgggtatgaaggagctggccgtgttccgggagaaggtcactgagcagcaccggcagatgggcaagggtggcaagcatcaccttggcctggaggagcccaagaagctgcgaccaccccctgccaggactccctgccaacaggaactggaccaggtcctggagcggatctccaccatgcgccttccggatgagcggggccctctggagcacctctactccctgcacatccccaactgtgacaagcatggcctgtacaacctcaaacagtgcaagatgtctctgaacgggcagcgtggggagtgctggtgtgtgaaccccaacaccgggaagctgatccagggagcccccaccatccggggggaccccgagtgtcatctcttctacaatgagcagcaggaggctcgcggggtgcacacccagcggatgcagtag

SEQ ID NO: 12244 - DNA, 3551 bp, synthetic construct; identical to SEQ ID NO: 9289
  misc_feature 1..3551: note = Synthetic polypeptide
  source 1..3551: mol_type = other DNA

SEQ ID NO: 12245 - DNA, 3464 bp, synthetic construct; identical to SEQ ID NO: 9290
  misc_feature 1..3464: note = Synthetic polypeptide
  source 1..3464: mol_type = other DNA

SEQ ID NO: 12246 - DNA, 3491 bp, synthetic construct; identical to SEQ ID NO: 9291
  misc_feature 1..3491: note = Synthetic polypeptide
  source 1..3491: mol_type = other DNA

SEQ ID NO: 12247 - DNA, 1092 bp, synthetic construct; identical to SEQ ID NO: 9292
  misc_feature 1..1092: note = Synthetic polypeptide
  source 1..1092: mol_type = other DNA

SEQ ID NO: 12248 - DNA, 1038 bp, synthetic construct; identical to SEQ ID NO: 9293
  misc_feature 1..1038: note = Synthetic polypeptide
  source 1..1038: mol_type = other DNA

SEQ ID NO: 12249 - DNA, 3398 bp, synthetic construct; identical to SEQ ID NO: 9294
  misc_feature 1..3398: note = Synthetic polypeptide
  source 1..3398: mol_type = other DNA

SEQ ID NO: 12250 - DNA, 3581 bp, synthetic construct; identical to SEQ ID NO: 9295
  misc_feature 1..3581: note = Synthetic polypeptide
  source 1..3581: mol_type = other DNA

SEQ ID NO: 12251 - DNA, 2471 bp, synthetic construct; identical to SEQ ID NO: 576
  misc_feature 1..2471: note = Synthetic polypeptide
  source 1..2471: mol_type = other DNA

SEQ ID NO: 12252 - DNA, 1072 bp, synthetic construct; identical to SEQ ID NO: 9520
  misc_feature 1..1072: note = Synthetic polypeptide
  source 1..1072: mol_type = other DNA

SEQ ID NO: 12253 - DNA, 375 bp, synthetic construct; identical to SEQ ID NO: 7510
  misc_feature 1..375: note = Synthetic polypeptide
  source 1..375: mol_type = other DNA

SEQ ID NO: 12254 - DNA, 683 bp, synthetic construct
  misc_feature 1..683: note = Synthetic polypeptide
  source 1..683: mol_type = other DNA
aggttgtacatcctggagacctgaagaattctgttgaagtcgcactgaacaagttgctggatccaatccgggaaaagtttaatacccctgccctgaaaaaactggccagcgctgcctacccagatccctcaaagcagaagccaatggccaaaggccctgccaagaattcagaaccagaggaggtcatcccatcccggctggatatccgtgtggggaaaatcatcactgtggagaagcacccagatgcagacagcctgtatgtagagaagattgacgtgggggaagctgaaccacggactgtggtgagcggcctggtacagttcgtgcccaaggaggaactgcaggacaggctggtagtggtgctgtgcaacctgaaaccccagaagatgagaggagtcgagtcccaaggcatgcttctgtgtgcttctatagaagggataaaccgccaggttgaacctctggaccctccggcaggctctgctcctggtgagcacgtgtttgtgaagggctatgaaaagggccaaccagatgaggagctcaagcccaagaagaaagtcttcgagaagttgcaggctgacttcaaaatttctgaggagtgcatcgcacagtggaagcaaaccaacttcatgaccaagctgggctccatttcctgtaaatcgctgaaaggggggaacattagctag

SEQ ID NO: 12255 - DNA, 1795 bp, synthetic construct; identical to SEQ ID NO: 879
  misc_feature 1..1795: note = Synthetic polypeptide
  source 1..1795: mol_type = other DNA

SEQ ID NO: 12256 - DNA, 1171 bp, synthetic construct; identical to SEQ ID NO: 880
  misc_feature 1..1171: note = Synthetic polypeptide
  source 1..1171: mol_type = other DNA

SEQ ID NO: 12257 - DNA, 570 bp, synthetic construct; identical to SEQ ID NO: 9493
  misc_feature 1..570: note = Synthetic polypeptide
  source 1..570: mol_type = other DNA

SEQ ID NO: 12258 - DNA, 513 bp, synthetic construct; identical to SEQ ID NO: 9494
  misc_feature 1..513: note = Synthetic polypeptide
  source 1..513: mol_type = other DNA

SEQ ID NO: 12259 - DNA, 539 bp, synthetic construct; identical to SEQ ID NO: 9495
  misc_feature 1..539: note = Synthetic polypeptide
  source 1..539: mol_type = other DNA

SEQ ID NO: 12260 - DNA, 144 bp, synthetic construct; identical to SEQ ID NO: 9496
  misc_feature 1..144: note = Synthetic polypeptide
  source 1..144: mol_type = other DNA

SEQ ID NO: 12261 - DNA, 335 bp, synthetic construct
  misc_feature 1..335: note = Synthetic polypeptide
  source 1..335: mol_type = other DNA
tcttctagagagatctagtaaaatattttatagatgatacaattggattctaaggttggtttcagaatcatcttggggagaagatgggcaggaatgtagtagagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctga

SEQ ID NO: 12262 - DNA, 2317 bp, synthetic construct; identical to SEQ ID NO: 8404
  misc_feature 1..2317: note = Synthetic polypeptide
  source 1..2317: mol_type = other DNA

SEQ ID NO: 12263 - DNA, 826 bp, synthetic construct
  misc_feature 1..826: note = Synthetic polypeptide
  source 1..826: mol_type = other DNA
cctggttctctggggcacgaggcttctcctcagcactctggcgcccccaacaggttcccagtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaaggtcaggacttcaggactggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacgagaaattaatgctgatataaaacgtaaattagtgaaggaactccgatgcgttggacaaaaatatgaaaaaatcttcgaaatgcttgaaggagtgcaaggacctactgcagtcaggaagcgattttttgaatccatcatcaaggaagcagcaagatgtatgagacgagactttgttaagcaccttaagaagaaactgaaacgtatgatttga

SEQ ID NO: 12264 - DNA, 826 bp, synthetic construct; identical to SEQ ID NO: 12263
  misc_feature 1..826: note = Synthetic polypeptide
  source 1..826: mol_type = other DNA

SEQ ID NO: 12265 - DNA, 1093 bp, synthetic construct; identical to SEQ ID NO: 7796
  misc_feature 1..1093: note = Synthetic polypeptide
  source 1..1093: mol_type = other DNA

SEQ ID NO: 12266 - DNA, 943 bp, synthetic construct; identical to SEQ ID NO: 6540
  misc_feature 1..943: note = Synthetic polypeptide
  source 1..943: mol_type = other DNA

SEQ ID NO: 12267 - DNA, 625 bp, synthetic construct; identical to SEQ ID NO: 6804
  misc_feature 1..625: note = Synthetic polypeptide
  source 1..625: mol_type = other DNA

SEQ ID NO: 12268 - DNA, 598 bp, synthetic construct; identical to SEQ ID NO: 6805
  misc_feature 1..598: note = Synthetic polypeptide
  source 1..598: mol_type = other DNA

SEQ ID NO: 12269 - DNA, 1582 bp, synthetic construct; identical to SEQ ID NO: 7488
  misc_feature 1..1582: note = Synthetic polypeptide
  source 1..1582: mol_type = other DNA

SEQ ID NO: 12270 - DNA, 1901 bp, synthetic construct; identical to SEQ ID NO: 7113
  misc_feature 1..1901: note = Synthetic polypeptide
  source 1..1901: mol_type = other DNA

SEQ ID NO: 12271 - DNA, 1739 bp, synthetic construct; identical to SEQ ID NO: 7114
  misc_feature 1..1739: note = Synthetic polypeptide
  source 1..1739: mol_type = other DNA

SEQ ID NO: 12272 - DNA, 1859 bp, synthetic construct; identical to SEQ ID NO: 7115
  misc_feature 1..1859: note = Synthetic polypeptide
  source 1..1859: mol_type = other DNA

SEQ ID NO: 12273 - DNA, 1616 bp, synthetic construct; identical to SEQ ID NO: 7116
  misc_feature 1..1616: note = Synthetic polypeptide
  source 1..1616: mol_type = other DNA

SEQ ID NO: 12274 - DNA, 501 bp, synthetic construct; identical to SEQ ID NO: 7117
  misc_feature 1..501: note = Synthetic polypeptide
  source 1..501: mol_type = other DNA

SEQ ID NO: 12275 - DNA, 369 bp, synthetic construct; identical to SEQ ID NO: 7118
  misc_feature 1..369: note = Synthetic polypeptide
  source 1..369: mol_type = other DNA

SEQ ID NO: 12276 - DNA, 2297 bp, synthetic construct; identical to SEQ ID NO: 7386
  misc_feature 1..2297: note = Synthetic polypeptide
  source 1..2297: mol_type = other DNA

SEQ ID NO: 12277 - DNA, 2447 bp, synthetic construct; identical to SEQ ID NO: 7387
  misc_feature 1..2447: note = Synthetic polypeptide
  source 1..2447: mol_type = other DNA

SEQ ID NO: 12278 - DNA, 2312 bp, synthetic construct; identical to SEQ ID NO: 7388
  misc_feature 1..2312: note = Synthetic polypeptide
  source 1..2312: mol_type = other DNA

SEQ ID NO: 12279 - DNA, 2375 bp, synthetic construct; identical to SEQ ID NO: 7389
  misc_feature 1..2375: note = Synthetic polypeptide
  source 1..2375: mol_type = other DNA

SEQ ID NO: 12280 - DNA, 2093 bp, synthetic construct; identical to SEQ ID NO: 7390
  misc_feature 1..2093: note = Synthetic polypeptide
  source 1..2093: mol_type = other DNA

SEQ ID NO: 12281 - DNA, 2090 bp, synthetic construct; identical to SEQ ID NO: 7391
  misc_feature 1..2090: note = Synthetic polypeptide
  source 1..2090: mol_type = other DNA

SEQ ID NO: 12282 - DNA, 1188 bp, synthetic construct
  misc_feature 1..1188: note = Synthetic polypeptide
  source 1..1188: mol_type = other DNA
ggccgagcacagtagctcatgcctgtaatcccagcactttgggaggccgaggaggacggatcacctgaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctga

SEQ ID NO: 12283 - DNA, 1131 bp, synthetic construct
  misc_feature 1..1131: note = Synthetic polypeptide
  source 1..1131: mol_type = other DNA
ggccgagcacagtagctcatgcctgtaatcccagcactttgggaggccgaggaggacggatcacctgaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataa

SEQ ID NO: 12284 - DNA, 1263 bp, synthetic construct
  misc_feature 1..1263: note = Synthetic polypeptide
  source 1..1263: mol_type = other DNA
ggccgagcacagtagctcatgcctgtaatcccagcactttgggaggccgaggaggacggatcacctgaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtaggctcctgggcccccagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataa

SEQ ID NO: 12285 - DNA, 894 bp, synthetic construct
  misc_feature 1..894: note = Synthetic polypeptide
  source 1..894: mol_type = other DNA
ggccgagcacagtagctcatgcctgtaatcccagcactttgggaggccgaggaggacggatcacctgaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtaggtgagtga

SEQ ID NO: 12286 - DNA, 807 bp, synthetic construct
  misc_feature 1..807: note = Synthetic polypeptide
  source 1..807: mol_type = other DNA
ggccgagcacagtagctcatgcctgtaatcccagcactttgggaggccgaggaggacggatcacctgaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctga

SEQ ID NO: 12287 - DNA, 697 bp, synthetic construct
  misc_feature 1..697: note = Synthetic polypeptide
  source 1..697: mol_type = other DNA
ggccgagcacagtagctcatgcctgtaatcccagcactttgggaggccgaggaggacggatcacctgaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtgg

SEQ ID NO: 12288 - DNA, 765 bp, synthetic construct
  misc_feature 1..765: note = Synthetic polypeptide
  source 1..765: mol_type = other DNA
ggccgagcacagtagctcatgcctgtaatcccagcactttgggaggccgaggaggacggatcacctgaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctgggg

SEQ ID NO: 12289 - DNA, 365 bp, synthetic construct
  misc_feature 1..365: note = Synthetic polypeptide
  source 1..365: mol_type = other DNA
ggccgagcacagtagctcatgcctgtaatcccagcactttgggaggccgaggaggacggatcacctgaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactggagtgggagttcgaggtgacagccttcta

SEQ ID NO: 12290 - DNA, 476 bp, synthetic construct
  misc_feature 1..476: note = Synthetic polypeptide
  source 1..476: mol_type = other DNA
ggccgagcacagtagctcatgcctgtaatcccagcactttgggaggccgaggaggacggatcacctgaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaaccc

SEQ ID NO: 12291 - DNA, 113 bp, synthetic construct
  misc_feature 1..113: note = Synthetic polypeptide
  source 1..113: mol_type = other DNA
ggccgagcacagtagctcatgcctgtaatcccagcactttgggaggccgaggaggacggatcacctgaggcctgggccgaggccactggtgcatatgttcccgggagggataa

SEQ ID NO: 12292 - DNA, 211 bp, synthetic construct
  misc_feature 1..211: note = Synthetic polypeptide
  source 1..211: mol_type = other DNA
ggccgagcacagtagctcatgcctgtaatcccagcactttgggaggccgaggaggacggatcacctgaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacc

SEQ ID NO: 12293 - DNA, 308 bp, synthetic construct; identical to SEQ ID NO: 6645
  misc_feature 1..308: note = Synthetic polypeptide
  source 1..308: mol_type = other DNA

SEQ ID NO: 12294 - DNA, 281 bp, synthetic construct; identical to SEQ ID NO: 6646
  misc_feature 1..281: note = Synthetic polypeptide
  source 1..281: mol_type = other DNA

SEQ ID NO: 12295 - DNA, 359 bp, synthetic construct; identical to SEQ ID NO: 6647
  misc_feature 1..359: note = Synthetic polypeptide
  source 1..359: mol_type = other DNA

SEQ ID NO: 12296 - DNA, 230 bp, synthetic construct; identical to SEQ ID NO: 6648
  misc_feature 1..230: note = Synthetic polypeptide
  source 1..230: mol_type = other DNA

SEQ ID NO: 12297 - DNA, 112 bp, synthetic construct; identical to SEQ ID NO: 7120
  misc_feature 1..112: note = Synthetic polypeptide
  source 1..112: mol_type = other DNA

SEQ ID NO: 12298 - DNA, 1213 bp, synthetic construct
  misc_feature 1..1213: note = Synthetic polypeptide
  source 1..1213: mol_type = other DNA
cctcccctgcaagcctggcctgcatgatatacttaacaatctgagatcaaaatatgccaagcaaataaagcagtttcaggaggagaaccagtctctaacctcggactacaaacgtcttgtgatgcaattcaaggagctacagaaagccatgaggcattttgctcttattgatgatgagaagttttgggagatttggctgatgaatgaagaggaggcgaaggacctaatagccagagcctttgatgtggacaggatcatccacacccatcatctggggcttccctgggcagcacctgatttctggttcctgaacaatgttgggcctatttctcagcagccccagaagtccgccacacagatagtagaagaaatgcttatgcgctcagaagaggaggaggcagaagaggccgccgcggaaccagagtcctacctggatttgccgaagcaaatttctgaaaaaactaccaagaggatcctgatgctcctgtgtgacgagtcggggttcctcatagagagcaagctgctgagccttctcctgcccctggagcagaatgaatgctatctgctgaggctggatgccatcttctccgcccttggaattgaaagtgaggatgacttgtataaactggtgaacttcttccttaaatatcgagctcaccgtttatcttccagcctccagatcaagccctgcagtcaggcgagcatggagaaggcgagcatggaggagacaagcacgaggtcagaattggagctggcagagcagacggagatggagggagaaaaggaagaaagcctggtggaaggggagaaggaagaagaggaggagaccccaccctccccctgggtcatccaccccaatgatgtcctcaagattctggaggccttcgtcatgggtctgaagaagcctagggactcgcgggccccgctgagggtacagaagaatgtgcgtgacaactccaaggactcggagtactggcaggccctgaccacagtgatcccttcctccaagcagaacctctgggatgccctctacacagccttggagaagtaccaccttgtcctgacccagagggccaagctgctgctggaaaacagttctctggagcagcagaacacagagctgcaggcgctactgcagcagtatctgaactccaagatcaactctgaactgcaagttcctcccactcaggtgttgcgggtacccacaaaatga

SEQ ID NO: 12299 - DNA, 55 bp, synthetic construct
  misc_feature 1..55: note = Synthetic polypeptide
  source 1..55: mol_type = other DNA
cctcccctgcaagcctggcctgcatgatatacttaacaatctgagatcaaaatat

SEQ ID NO: 12300 - DNA, 772 bp, synthetic construct; identical to SEQ ID NO: 7475
  misc_feature 1..772: note = Synthetic polypeptide
  source 1..772: mol_type = other DNA

SEQ ID NO: 12301 - DNA, 832 bp, synthetic construct; identical to SEQ ID NO: 7476
  misc_feature 1..832: note = Synthetic polypeptide
  source 1..832: mol_type = other DNA

SEQ ID NO: 12302 - DNA, 763 bp, synthetic construct; identical to SEQ ID NO: 7477
  misc_feature 1..763: note = Synthetic polypeptide
  source 1..763: mol_type = other DNA

SEQ ID NO: 12303 - DNA, 1043 bp, synthetic construct; identical to SEQ ID NO: 8639
  misc_feature 1..1043: note = Synthetic polypeptide
  source 1..1043: mol_type = other DNA

SEQ ID NO: 12304 - DNA, 366 bp, synthetic construct; identical to SEQ ID NO: 8640
  misc_feature 1..366: note = Synthetic polypeptide
  source 1..366: mol_type = other DNA

SEQ ID NO: 12305 - DNA, 913 bp, synthetic construct; identical to SEQ ID NO: 8351
  misc_feature 1..913: note = Synthetic polypeptide
  source 1..913: mol_type = other DNA

SEQ ID NO: 12306 - DNA, 718 bp, synthetic construct; identical to SEQ ID NO: 8352
  misc_feature 1..718: note = Synthetic polypeptide
  source 1..718: mol_type = other DNA

SEQ ID NO: 12307 - DNA, 835 bp, synthetic construct; identical to SEQ ID NO: 6764
  misc_feature 1..835: note = Synthetic polypeptide
  source 1..835: mol_type = other DNA

SEQ ID NO: 12308 - DNA, 3882 bp, synthetic construct; identical to SEQ ID NO: 8381
  misc_feature 1..3882: note = Synthetic polypeptide
  source 1..3882: mol_type = other DNA

SEQ ID NO: 12309 - DNA, 4011 bp, synthetic construct; identical to SEQ ID NO: 8382
  misc_feature 1..4011: note = Synthetic polypeptide
  source 1..4011: mol_type = other DNA

SEQ ID NO: 12310 - DNA, 1060 bp, synthetic construct; identical to SEQ ID NO: 8383
  misc_feature 1..1060: note = Synthetic polypeptide
  source 1..1060: mol_type = other DNA

SEQ ID NO: 12311 - DNA, 2346 bp, synthetic construct; identical to SEQ ID NO: 9066
  misc_feature 1..2346: note = Synthetic polypeptide
  source 1..2346: mol_type = other DNA

SEQ ID NO: 12312 - DNA, 739 bp, synthetic construct; identical to SEQ ID NO: 8416
  misc_feature 1..739: note = Synthetic polypeptide
  source 1..739: mol_type = other DNA

SEQ ID NO: 12313 - DNA, 2774 bp, synthetic construct
  misc_feature 1..2774: note = Synthetic polypeptide
  source 1..2774: mol_type = other DNA
ggccaagcattgtggcacacgcctgtaatctcattacactgggaggctgtggcagaaggatcgcttgaggccaggagtttgagactagcctacgtaacatgagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtga

SEQ ID NO: 12314 - DNA, 654 bp, synthetic construct
  misc_feature 1..654: note = Synthetic polypeptide
  source 1..654: mol_type = other DNA
ggccaagcattgtggcacacgcctgtaatctcattacactgggaggctgtggcagaaggatcgcttgaggccaggagtttgagactagcctacgtaacatgagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctg

SEQ ID NO: 12315 - DNA, 2293 bp, synthetic construct; identical to SEQ ID NO: 9491
  misc_feature 1..2293: note = Synthetic polypeptide
  source 1..2293: mol_type = other DNA

SEQ ID NO: 12316 - DNA, 2148 bp, synthetic construct; identical to SEQ ID NO: 8357
  misc_feature 1..2148: note = Synthetic polypeptide
  source 1..2148: mol_type = other DNA

SEQ ID NO: 12317 - DNA, 2019 bp, synthetic construct; identical to SEQ ID NO: 8358
  misc_feature 1..2019: note = Synthetic polypeptide
  source 1..2019: mol_type = other DNA

SEQ ID NO: 12318 - DNA, 2825 bp, synthetic construct; identical to SEQ ID NO: 6727
  misc_feature 1..2825: note = Synthetic polypeptide
  source 1..2825: mol_type = other DNA

SEQ ID NO: 12319 - DNA, 316 bp, synthetic construct; identical to SEQ ID NO: 6961
  misc_feature 1..316: note = Synthetic polypeptide
  source 1..316: mol_type = other DNA

SEQ ID NO: 12320 - DNA, 476 bp, synthetic construct; identical to SEQ ID NO: 6601
  misc_feature 1..476: note = Synthetic polypeptide
  source 1..476: mol_type = other DNA

SEQ ID NO: 12321 - DNA, 461 bp, synthetic construct; identical to SEQ ID NO: 6602
  misc_feature 1..461: note = Synthetic polypeptide
  source 1..461: mol_type = other DNA

SEQ ID NO: 12322 - DNA, 361 bp, synthetic construct; identical to SEQ ID NO: 6603
  misc_feature 1..361: note = Synthetic polypeptide
  source 1..361: mol_type = other DNA

SEQ ID NO: 12323 - DNA, 701 bp, synthetic construct; identical to SEQ ID NO: 658
  misc_feature 1..701: note = Synthetic polypeptide
  source 1..701: mol_type = other DNA

SEQ ID NO: 12324 - DNA, 656 bp, synthetic construct
  misc_feature 1..656: note = Synthetic polypeptide
  source 1..656: mol_type = other DNA
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 12325 - DNA, 286 bp, synthetic construct
  misc_feature 1..286: note = Synthetic polypeptide
  source 1..286: mol_type = other DNA
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatggtggaatgtcatccttacttcaaccagagaaa

SEQ ID NO: 12326 - DNA, 964 bp, synthetic construct
  misc_feature 1..964: note = Synthetic polypeptide
  source 1..964: mol_type = other DNA
tgatatggtttggctgtgtgcccatcgaaatctcatcttgaattgtagctgccattattcccacgtgttgtgggagggacccagtgggagacaattgaatcatgggggcagtttccctcatactgttctggtggtagtgaataagtctcacgagatctgatggttttataaggggaaacccctttcacttggttcctattctctcttgcctgccgctgcataagacatgatatttgccttctgccatgattgtgaggcctccccagccacataaaaccgagatgatggtgaaaaaggagatccaggagaagagggaaagcatggcaaagtgggacgcatggggccgaaaggaattaaaggagaactgggtgatatgggagatcagggcaatattggcaagactgggcccattgggaagaagggtgacaaaggggaaaaaggtttgcttggaatacctggagaaaaaggcaaagcaggtactgtctgtgattgtggaagataccggaaatttgttggacaactggatattagtattgctcggctcaagacatctatgaagtttgtcaagaatgtgatagcagggattagggaaactgaagagaaattctactacatcgtgcaggaagagaagaactacagggaatccctaacccactgcaggattcggggtggaatgctagccatgcccaaggatgaagctgccaacacactcatcgctgactatgttgccaagagtggcttctttcgggtgttcattggcgtgaatgaccttgaaagggagggacagtacatgttcacagacaacactccactgcagaactatagcaactggaatgagggggaacccagcgacccctatggtcatgaggactgtgtggagatgctgagctctggcagatggaatgacacagagtgccatcttaccatgtactttgtctgtgagttcatcaagaagaaaaagtaa

SEQ ID NO: 12327 - DNA, 428 bp, synthetic construct; identical to SEQ ID NO: 7041
  misc_feature 1..428: note = Synthetic polypeptide
  source 1..428: mol_type = other DNA

SEQ ID NO: 12328 - DNA, 435 bp, synthetic construct; identical to SEQ ID NO: 7042
  misc_feature 1..435: note = Synthetic polypeptide
  source 1..435: mol_type = other DNA

SEQ ID NO: 12329 - DNA, 3591 bp, synthetic construct; identical to SEQ ID NO: 8632
  misc_feature 1..3591: note = Synthetic polypeptide
  source 1..3591: mol_type = other DNA

SEQ ID NO: 12330 - DNA, 3504 bp, synthetic construct; identical to SEQ ID NO: 8633
  misc_feature 1..3504: note = Synthetic polypeptide
  source 1..3504: mol_type = other DNA

SEQ ID NO: 12331 - DNA, 3531 bp, synthetic construct; identical to SEQ ID NO: 8634
  misc_feature 1..3531: note = Synthetic polypeptide
  source 1..3531: mol_type = other DNA

SEQ ID NO: 12332 - DNA, 1132 bp, synthetic construct; identical to SEQ ID NO: 8635
  misc_feature 1..1132: note = Synthetic polypeptide
  source 1..1132: mol_type = other DNA

SEQ ID NO: 12333 - DNA, 1078 bp, synthetic construct; identical to SEQ ID NO: 8636
  misc_feature 1..1078: note = Synthetic polypeptide
  source 1..1078: mol_type = other DNA

SEQ ID NO: 12334 - DNA, 3438 bp, synthetic construct; identical to SEQ ID NO: 8637
  misc_feature 1..3438: note = Synthetic polypeptide
  source 1..3438: mol_type = other DNA

SEQ ID NO: 12335 - DNA, 3621 bp, synthetic construct; identical to SEQ ID NO: 8638
  misc_feature 1..3621: note = Synthetic polypeptide
  source 1..3621: mol_type = other DNA

SEQ ID NO: 12336 - DNA, 224 bp, synthetic construct
  misc_feature 1..224: note = Synthetic polypeptide
  source 1..224: mol_type = other DNA
gccgggcatggtggctcacacctgtaatcccagcactttgggaggccgaggccgacggatcgcttgagacaatgactgatgtggtgggtaacccagaggaggagcgccgagctgagttctacttccagccctgggctcaggaggctgtgtgccgatacttctactccaaggtgcagcagagacgacaagaattagagcaagccctgggaatccggaatacatag

SEQ ID NO: 12337 - DNA, 1224 bp, synthetic construct; identical to SEQ ID NO: 6690
  misc_feature 1..1224: note = Synthetic polypeptide
  source 1..1224: mol_type = other DNA

SEQ ID NO: 12338 - DNA, 370 bp, synthetic construct; identical to SEQ ID NO: 6522
  misc_feature 1..370: note = Synthetic polypeptide
  source 1..370: mol_type = other DNA

SEQ ID NO: 12339 - DNA, 181 bp, synthetic construct
  misc_feature 1..181: note = Synthetic polypeptide
  source 1..181: mol_type = other DNA
ggccaggcacagtggctcacgcctgtaaccccagcgctttgggatgccatggcaggatcatttgaggccaggttctgaagacagcccacccaagcatgcaggcaacaacgaaagccattcttccaggagaaggaatcggcattccaagtcaaaagtcaccaatggcgttggaaagaaatga

SEQ ID NO: 12340 - DNA, 274 bp, synthetic construct
  misc_feature 1..274: note = Synthetic polypeptide
  source 1..274: mol_type = other DNA
ggccaggcacagtggctcacgcctgtaaccccagcgctttgggatgccatggcaggatcatttgaggccaggttctgaagacagcccacccaagcatgcaggcgagggcacttgggggtcattatttgagatcgtaagtcttgtttcccacagacctggccgcgtcaggcagatcatcgcctggggggcctttgccaacgtggggtctcttctaacttcagcacttgacatgcggtcaccggtggcagcgcggtgtgttgaagggaaacggtag

SEQ ID NO: 12341 - DNA, 400 bp, synthetic construct; identical to SEQ ID NO: 749
  misc_feature 1..400: note = Synthetic polypeptide
  source 1..400: mol_type = other DNA

SEQ ID NO: 12342 - DNA, 2301 bp, synthetic construct; identical to SEQ ID NO: 750
  misc_feature 1..2301: note = Synthetic polypeptide
  source 1..2301: mol_type = other DNA

SEQ ID NO: 12343 - DNA, 2381 bp, synthetic construct; identical to SEQ ID NO: 751
  misc_feature 1..2381: note = Synthetic polypeptide
  source 1..2381: mol_type = other DNA

SEQ ID NO: 12344 - DNA, 692 bp, synthetic construct; identical to SEQ ID NO: 752
  misc_feature 1..692: note = Synthetic polypeptide
  source 1..692: mol_type = other DNA

SEQ ID NO: 12345 - DNA, 210 bp, synthetic construct
  misc_feature 1..210: note = Synthetic polypeptide
  source 1..210: mol_type = other DNA
ggccaggtgcggtggctcacggctgtaatcccagcactttgggaggccgaggcaggcagatcacctgaggtcgatagtttgagaccagcttggccaacacgggtgatcgtcttggacaaaggagaaatccaggagtacggcgccccatcggacctcctgcagcagagaggtcttttctacagcatggccaaagacgccggcttggtgtga

SEQ ID NO: 12346 - DNA, 693 bp, synthetic construct
  misc_feature 1..693: note = Synthetic polypeptide
  source 1..693: mol_type = other DNA
caacatagagatgatggtgaaaaaggagatccaggagaagagggaaagcatggcaaagtgggacgcatggggccgaaaggaattaaaggagaactgggtgatatgggagatcagggcaatattggcaagactgggcccattgggaagaagggtgacaaaggggaaaaaggtttgcttggaatacctggagaaaaaggcaaagcaggtactgtctgtgattgtggaagataccggaaatttgttggacaactggatattagtattgctcggctcaagacatctatgaagtttgtcaagaatgtgatagcagggattagggaaactgaagagaaattctactacatcgtgcaggaagagaagaactacagggaatccctaacccactgcaggattcggggtggaatgctagccatgcccaaggatgaagctgccaacacactcatcgctgactatgttgccaagagtggcttctttcgggtgttcattggcgtgaatgaccttgaaagggagggacagtacatgttcacagacaacactccactgcagaactatagcaactggaatgagggggaacccagcgacccctatggtcatgaggactgtgtggagatgctgagctctggcagatggaatgacacagagtgccatcttaccatgtactttgtctgtgagttcatcaagaagaaaaagtaa

SEQ ID NO: 12347 - DNA, 504 bp, synthetic construct; identical to SEQ ID NO: 7011
  misc_feature 1..504: note = Synthetic polypeptide
  source 1..504: mol_type = other DNA

SEQ ID NO: 12348 - DNA, 2153 bp, synthetic construct; identical to SEQ ID NO: 7012
  misc_feature 1..2153: note = Synthetic polypeptide
  source 1..2153: mol_type = other DNA

SEQ ID NO: 12349 - DNA, 818 bp, synthetic construct; identical to SEQ ID NO: 7013
  misc_feature 1..818: note = Synthetic polypeptide
  source 1..818: mol_type = other DNA

SEQ ID NO: 12350 - DNA, 750 bp, synthetic construct; identical to SEQ ID NO: 489
  misc_feature 1..750: note = Synthetic polypeptide
  source 1..750: mol_type = other DNA

SEQ ID NO: 12351 - DNA, 1007 bp, synthetic construct; identical to SEQ ID NO: 7489
  misc_feature 1..1007: note = Synthetic polypeptide
  source 1..1007: mol_type = other DNA

SEQ ID NO: 12352 - DNA, 586 bp, synthetic construct; identical to SEQ ID NO: 6809
  misc_feature 1..586: note = Synthetic polypeptide
  source 1..586: mol_type = other DNA

SEQ ID NO: 12353 - DNA, 1072 bp, synthetic construct; identical to SEQ ID NO: 9526
  misc_feature 1..1072: note = Synthetic polypeptide
  source 1..1072: mol_type = other DNA

SEQ ID NO: 12354 - DNA, 847 bp, synthetic construct
  misc_feature 1..847: note = Synthetic polypeptide
  source 1..847: mol_type = other DNA
ccttgctcctcaaagtacagcatgtggactcgcagccctcattaaaaccaggaacctggattttgtcaaccttatggcctacgacttccatggctcttgggagaaggtcacgggacataacagccccctctacaagaggcaagaagagagtggtgcagcagccagcctcaacgtggatgctgctgtgcaacagtggctgcagaaggggacccctgccagcaagctgatccttggcatgcctacctacggacgctccttcacactggcctcctcatcagacaccagagtgggggccccagccacagggtctggcactccaggccccttcaccaaggaaggagggatgctggcctactatgaagtctgctcctggaagggggccaccaaacagagaatccaggatcagaaggtgccctacatcttccgggacaaccagtgggtgggctttgatgatgtggagagcttcaaaaccaaggtcagctatctgaagcagaagggactgggcggggccatggtctgggcactggacttagatgactttgccggcttctcctgcaaccagggccgataccccctcatccagacgctacggcaggaactgagtcttccatacttgccttcaggcaccccagagcttgaagttccaaaaccaggtcagccctctgaacctgagcatggccccagccctggacaagacacgttctgccagggcaaagctgatgggctctatcccaatcctcgggaacggtccagcttctacagctgtgcagcggggcggctgttccagcaaagctgcccgacaggcctggtgttcagcaactcctgcaaatgctgcacctggaattga

SEQ ID NO: 12355 - DNA, 610 bp, synthetic construct
  misc_feature 1..610: note = Synthetic polypeptide
  source 1..610: mol_type = other DNA
ccttgctcctcaaagtacagcatgtggactcgcagccctcattaaaaccaggaacctggattttgtcaaccttatggcctacgacttccatggctcttgggagaaggtcacgggacataacagccccctctacaagaggcaagaagagagtggtgcagcagccagcctcaacgtggatgctgctgtgcaacagtggctgcagaaggggacccctgccagcaagctgatccttggcatgcctacctacggacgctccttcacactggcctcctcatcagacaccagagtgggggccccagccacagggtctggcactccaggccccttcaccaaggaaggagggatgctggcctactatgaagtctgctcctggaagggggccaccaaacagagaatccaggatcagaaggtgccctacatcttccgggacaaccagtgggtgggctttgatgatgtggagagcttcaaaaccaaggtcagctatctgaagcagaagggactgggcggggccatggtctgggcactggacttagatgactttgccggcttctcctgcaaccagggccgataccccctcatccagacgctacggcaggaactgaatgggtaa

SEQ ID NO: 12356 - DNA, 532 bp, synthetic construct
  misc_feature 1..532: note = Synthetic polypeptide
  source 1..532: mol_type = other DNA
ccttgctcctcaaagtacagcatgtggactcgcagccctcattaaaaccaggaacctggattttgtcaaccttatggcctacgacttccatggctcttgggagaaggtcacgggacataacagccccctctacaagaggcaagaagagagtggtgcagcagccagcctcaacgtggatgctgctgtgcaacagtggctgcagaaggggacccctgccagcaagctgatccttggcatgcctacctacggacgctccttcacactggcctcctcatcagacaccagagtgggggccccagccacagggtctggcactccaggccccttcaccaaggaaggagggatgctggcctactatgaagtctgctcctggaagggggccaccaaacagagaatccaggatcagaaggtgccctacatcttccgggacaaccagtgggtgggctttgatgatgtggagagcttcaaaaccaaggtcatgcttacgttaagacaaggagactgcaaaatgactgatgtccaagcagcatga

SEQ ID NO: 12357 - DNA, 455 bp, synthetic construct
  misc_feature 1..455: note = Synthetic polypeptide
  source 1..455: mol_type = other DNA
tgttatggtttggatttgtgtccctgcccaaatctcatgtcgaattgtaatccccagtgtgggaggaggggcctggtgggaggtgattggatcatggagacagatttcttctttgctgttctcatgatagtgagtaagttctcatgagatctgggtttctaaaaagtgtgtggcaccttccccttctctttctcctgctctggccatgtaagacatacctccttcctctttgccttccaccatgattgtatatttcctgagacctctccagccatgcttcccgtacagccttggccttgctaacaagtttacctccaaactatgagatttcagaaggaaaaccaagagccatctctgcatatgtgagagcgggcaaaggaaatgtgacaaggagaagaaagaagacacacttgggcaatgatgatgggaagaaggaagcacaggagaaaatgtaa

SEQ ID NO: 12358 - DNA, 970 bp, synthetic construct; identical to SEQ ID NO: 711
  misc_feature 1..970: note = Synthetic polypeptide
  source 1..970: mol_type = other DNA

SEQ ID NO: 12359 - DNA, 1181 bp, synthetic construct; identical to SEQ ID NO: 9640
  misc_feature 1..1181: note = Synthetic polypeptide
  source 1..1181: mol_type = other DNA

SEQ ID NO: 12360 - DNA, 1061 bp, synthetic construct; identical to SEQ ID NO: 9641
  misc_feature 1..1061: note = Synthetic polypeptide
  source 1..1061: mol_type = other DNA

SEQ ID NO: 12361 - DNA, 851 bp, synthetic construct; identical to SEQ ID NO: 9642
  misc_feature 1..851: note = Synthetic polypeptide
  source 1..851: mol_type = other DNA

SEQ ID NO: 12362 - DNA, 818 bp, synthetic construct; identical to SEQ ID NO: 9643
  misc_feature 1..818: note = Synthetic polypeptide
  source 1..818: mol_type = other DNA

SEQ ID NO: 12363 - DNA, 847 bp, synthetic construct; identical to SEQ ID NO: 9644
  misc_feature 1..847: note = Synthetic polypeptide
  source 1..847: mol_type = other DNA

SEQ ID NO: 12364 - DNA, 2165 bp, synthetic construct; identical to SEQ ID NO: 9527
  misc_feature 1..2165: note = Synthetic polypeptide
  source 1..2165: mol_type = other DNA

SEQ ID NO: 12365 - DNA, 247 bp, synthetic construct
  misc_feature 1..247: note = Synthetic polypeptide
  source 1..247: mol_type = other DNA
ggcctcagggacccaggccccatgtggcaagctggccagtgttccctgcaatgcatctacggagtcttccccacccctggccaagggctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 12366 - DNA, 119 bp, synthetic construct
  misc_feature 1..119: note = Synthetic polypeptide
  source 1..119: mol_type = other DNA
ggcctcagggacccaggccccatgtggcaagctggccagtgttccctgcaatgcatctacggagtcttccccacccctggccaagggctacaatgagcagcgcatcagacagaacgtgc

SEQ ID NO: 12367 - DNA, 597 bp, synthetic construct; identical to SEQ ID NO: 759
  misc_feature 1..597: note = Synthetic polypeptide
  source 1..597: mol_type = other DNA

SEQ ID NO: 12368 - DNA, 654 bp, synthetic construct; identical to SEQ ID NO: 760
  misc_feature 1..654: note = Synthetic polypeptide
  source 1..654: mol_type = other DNA

SEQ ID NO: 12369 - DNA, 1358 bp, synthetic construct
  misc_feature 1..1358: note = Synthetic polypeptide
  source 1..1358: mol_type = other DNA
ggctgggtgtggtggcttatgcactaatcccagcactttgggaggctaaagcaggagggttacttgagaccaggagtttaacaccagcctaggcaacataaggagaccctgtatctatgaaacataatgtaccattgagcatggtggtgcatgtctgtgctactcgggaggctgaggatgccgaggaatgtgacagggctgggagtgtggccacctgccaggccgtcatgcgtgccgtgattgggattgggattgaggaggaagatcggaagcatacctggatggaggatgctgacagttgtgtagcccacaatgccctggagtgtgcacgagccatctacgcctacgccctgcaggtgttccccagcaagaagagtgtgtggctgcgcgccgcgtacttcgagaagaaccatggcactcgggagtccctggaagcactcctgcagagggctgtggcccactgccccaaagcagaggtgctgtggctcatgggcgccaagtccaagtggctggcaggggatgtgcctgcagcaaggagcatcctggccctggccttccaggtgttcatgaagtctgtgaagctggagtgggtgcaagacaacatcagggcagcccaagatctgtgcgaggaggccctgcggcactatgaggacttccccaagctgtggatgatgaaggggcagatcgaggagcagaaggagatgatggagaaggcgcgggaagcctataaccaggggttgaagaagtgtccccactccacacccctgtggcttttgctctctcggctggaggagaagattgggcagcttactcgagcacgggccattttggaaaagtctcgtctgaagaacccaaagaaccctgggctgtggttggagtccgtgcggctggagtaccgtgcggggctgaagaacatcgcaaatacactcatggccaaggcgctgcaggagtgccccaactccggtatcctgtggtctgaggccatcttcctcgaggcaaggccccagaggaggaccaagagcgtggatgccctgaagaagtgtgagcatgacccccatgtgctcctggccgtggccaagctgttttggagtcagcggaagatcaccaaggccagggagtggttccaccgcactgtgaagattgactcggacctgggggatgcctgggccttcttctacaagtttgagctgcagcatggcactgaggagcagcaggaggaggtgaggaagcgctgtgagagtgcagagcctcggcatggggagctgtggtgcgccgtgtccaaggacatcgccaactggcagaagaagatcggggacatccttaggctggtggccggccgcatcaagaacaccttctga

SEQ ID NO: 12370 - DNA, 1478 bp, synthetic construct
  misc_feature 1..1478: note = Synthetic polypeptide
  source 1..1478: mol_type = other DNA
ggctgggtgtggtggcttatgcactaatcccagcactttgggaggctaaagcaggagggttacttgagaccaggagtttaacaccagcctaggcaacataaggagaccctgtatctatgaaacataatgtaccattgagcatggtggtgcatgtctgtgctactcgggaggctgaggatgccgaggaatgtgacagggctgggagtgtggccacctgccaggccgtcatgcgtgccgtgattgggattgggattgaggaggaagatcggaagcatacctggatggaggatgctgacagttgtgtagcccacaatgccctggagtgtgcacgagccatctacgcctacgccctgcaggtgttccccagcaagaagagtgtgtggctgcgcgccgcgtacttcgagaagaaccatggcactcgggagtccctggaagcactcctgcagagggctgtggcccactgccccaaagcagaggtgctgtggctcatgggcgccaagtccaagtggctggcaggggatgtgcctgcagcaaggagcatcctggccctggccttccaggccaaccccaacagtgaggagatctggctggcagccgtgaagctggagtccgagaatgatgagtacgagcgggcccggaggctgctggccaaggcgcggagcagtgcccccaccgcccgggtgttcatgaagtctgtgaagctggagtgggtgcaagacaacatcagggcagcccaagatctgtgcgaggaggccctgcggcactatgaggacttccccaagctgtggatgatgaaggggcagatcgaggagcagaaggagatgatggagaaggcgcgggaagcctataaccaggggttgaagaagtgtccccactccacacccctgtggcttttgctctctcggctggaggagaagattgggcagcttactcgagcacgggccattttggaaaagtctcgtctgaagaacccaaagaaccctgggctgtggttggagtccgtgcggctggagtaccgtgcggggctgaagaacatcgcaaatacactcatggccaaggcgctgcaggagtgccccaactccggtatcctgtggtctgaggccatcttcctcgaggcaaggccccagaggaggaccaagagcgtggatgccctgaagaagtgtgagcatgacccccatgtgctcctggccgtggccaagctgttttggagtcagcggaagatcaccaaggccagggagtggttccaccgcactgtgaagattgactcggacctgggggatgcctgggccttcttctacaagtttgagctgcagcatggcactgaggagcagcaggaggaggtgaggaagcgctgtgagagtgcagagcctcggcatggggagctgtggtgcgccgtgtccaaggacatcgccaactggcagaagaagatcggggacatccttaggctggtggccggccgcatcaagaacaccttctga

SEQ ID NO: 12371 - DNA, 696 bp, synthetic construct; identical to SEQ ID NO: 6897
  misc_feature 1..696: note = Synthetic polypeptide
  source 1..696: mol_type = other DNA

SEQ ID NO: 12372 - DNA, 801 bp, synthetic construct; identical to SEQ ID NO: 6898
  misc_feature 1..801: note = Synthetic polypeptide
  source 1..801: mol_type = other DNA

SEQ ID NO: 12373 - DNA, 594 bp, synthetic construct; identical to SEQ ID NO: 9569
  misc_feature 1..594: note = Synthetic polypeptide
  source 1..594: mol_type = other DNA

SEQ ID NO: 12374 - DNA, 1757 bp, synthetic construct; identical to SEQ ID NO: 9401
  misc_feature 1..1757: note = Synthetic polypeptide
  source 1..1757: mol_type = other DNA

SEQ ID NO: 12375 - DNA, 950 bp, synthetic construct; identical to SEQ ID NO: 9402
  misc_feature 1..950: note = Synthetic polypeptide
  source 1..950: mol_type = other DNA

SEQ ID NO: 12376 - DNA, 1259 bp, synthetic construct; identical to SEQ ID NO: 9403
  misc_feature 1..1259: note = Synthetic polypeptide
  source 1..1259: mol_type = other DNA

SEQ ID NO: 12377 - DNA, 677 bp, synthetic construct; identical to SEQ ID NO: 747
  misc_feature 1..677: note = Synthetic polypeptide
  source 1..677: mol_type = other DNA

SEQ ID NO: 12378 - DNA, 674 bp, synthetic construct; identical to SEQ ID NO: 748
  misc_feature 1..674: note = Synthetic polypeptide
  source 1..674: mol_type = other DNA

SEQ ID NO: 12379 - DNA, 394 bp, synthetic construct; identical to SEQ ID NO: 701
  misc_feature 1..394: note = Synthetic polypeptide
  source 1..394: mol_type = other DNA

SEQ ID NO: 12380 - DNA, 700 bp, synthetic construct; identical to SEQ ID NO: 702
  misc_feature 1..700: note = Synthetic polypeptide
  source 1..700: mol_type = other DNA

SEQ ID NO: 12381 - DNA, 568 bp, synthetic construct; identical to SEQ ID NO: 703
  misc_feature 1..568: note = Synthetic polypeptide
  source 1..568: mol_type = other DNA

SEQ ID NO: 12382 - DNA, 535 bp, synthetic construct; identical to SEQ ID NO: 704
  misc_feature 1..535: note = Synthetic polypeptide
  source 1..535: mol_type = other DNA

SEQ ID NO: 12383 - DNA, 129 bp, synthetic construct; identical to SEQ ID NO: 705
  misc_feature 1..129: note = Synthetic polypeptide
  source 1..129: mol_type = other DNA

SEQ ID NO: 12384 - DNA, 435 bp, synthetic construct; identical to SEQ ID NO: 706
  misc_feature 1..435: note = Synthetic polypeptide
  source 1..435: mol_type = other DNA

SEQ ID NO: 12385 - DNA, 303 bp, synthetic construct; identical to SEQ ID NO: 707
  misc_feature 1..303: note = Synthetic polypeptide
  source 1..303: mol_type = other DNA

SEQ ID NO: 12386 - DNA, 270 bp, synthetic construct; identical to SEQ ID NO: 708
  misc_feature 1..270: note = Synthetic polypeptide
  source 1..270: mol_type = other DNA

SEQ ID NO: 12387 - DNA, 2201 bp, synthetic construct
  misc_feature 1..2201: note = Synthetic polypeptide
  source 1..2201: mol_type = other DNA
agagcactgtcgtgggcagcaggcagacctgagtccaagtgtggctccaccactcactagctgtgtgaccttgggcaagccccttacctctctgagcgtgtacctgctcatcagctaaagcaggggtcataccaaatccttctgccttacagggctgttgtgaggattaccgagtgcctagcacagtgcctggcctgcacttcggggtgctgctgtgggagctgctgacgggggaggtcccctaccgtgagatcgacgccttggccgtggcgtatggcgtggctatgaataagctgacgctgcccattccctccacgtgccccgagccctttgcccgcctcctggaggaatgctgggacccagacccccacgggcggccagatttcggtagcatcttgaagcggcttgaagtcatcgaacagtcagccctgttccagatgccactggagtccttccactcgctgcaggaagactggaagctggagattcagcacatgtttgatgaccttcggaccaaggagaaggagcttcggagccgtgaggaggagctgctgcgggcggcacaggagcagcgcttccaggaggagcagctgcggcggcgggagcaggagctggcagaacgtgagatggacatcgtggaacgggagctgcacctgctcatgtgccagctgagccaggagaagccccgggtccgcaagcgcaagggcaacttcaagcgcagccgcctgctcaagctgcgggaaggcggcagccacatcagcctgccctctggctttgagcataagatcacagtccaggcctctccaactctggataagcggaaaggatccgatggggccagcccccctgcaagccccagcatcatcccccggctgagggccattcgcctgactcccgtggactgtggtggcagcagcagtggcagcagcagtggaggaagtgggacatggagccgcggtgggcccccaaagaaggaagaactggtcgggggcaagaagaagggacgaacgtgggggcccagctccaccctgcagaaggagcgggtgggaggagaggagaggctgaaggggctgggggaaggaagcaaacagtggtcatcaagtgcccccaacctgggcaagtcccccaaacacacacccatcgcccctggctttgccagcctcaatgagatggaggagttcgcggaggcagaggatggaggcagcagcgtgcccccttccccctactcgaccccgtcctacctctcagtgccactgcctgccgagccctccccgggggcgcgggcgccgtgggagccgacgccgtccgcgccccccgctcggtggggacacggcgcccggcggcgctgcgacctggcgctgctaggctgcgccacgctgctgggggctgtgggcctgggcgccgacgtggccgaggcgcgcgcggccgacggtgaggagcagcggcgctggctcgacggcctcttctttccccgcgccggccgcttcccgcggggcctcagcccacccgcgcgtccccacggccgccgcgaagacgtgggccccggcctgggcctggcgccctcggccaccctcgtgtcgctgtcgtccgtgtccgactgcaactccacgcgttcactgctgcgctctgacagtgacgaggccgcaccggccgcgccctccccaccaccctccccgcccgcgcccacacccacgccctcgcccagcaccaaccccctggtggacctggagctggagagcttcaagaaggacccccgccagtcgctcacgcccacccacgtcacggctgcatgcgctgtgagccgcgggcaccggcggacgccatcggacggggcgctggggcagcgggggccgcccgagcccgcgggccatggccctggccctcgtgaccttctggacttcccccgcctgcccgacccccaggccctgttcccagcccgccgccggccccctgagttcccaggccgccccaccaccctgacctttgccccgagacctcggccggctgccagtcgcccccgcttggacccctggaaactggtctccttcggccggacactcaccatctcgcctcccagcaggccagacactccggagagccctgggccccccagcgtgcagcccacactgctggacatggacatggaggggcagaaccaagacagcacagtgcccctgtgcggggcccacggctcccactaa

SEQ ID NO: 12388 - DNA, 629 bp, synthetic construct
  misc_feature 1..629: note = Synthetic polypeptide
  source 1..629: mol_type = other DNA
agagcactgtcgtgggcagcaggcagacctgagtccaagtgtggctccaccactcactagctgtgtgaccttgggcaagccccttacctctctgagcgtgtacctgctcatcagctaaagcaggggtcataccaaatccttctgccttacagggctgttgtgaggattaccgagtgcctagcacagtgcctggcctgcacttcggggtgctgctgtgggagctgctgacgggggaggtcccctaccgtgagatcgacgccttggccgtggcgtatggcgtggctatgaataagctgacgctgcccattccctccacgtgccccgagccctttgcccgcctcctggaggaatgctgggacccagacccccacgggcggccagatttcggtagcatcttgaagcggcttgaagtcatcgaacagtcagccctgttccagatgccactggagtccttccactcgctgcaggaagactggaagctggagattcagcacatgtttgatgaccttcggaccaaggagaaggctttgagcataagatcacagtccaggcctctccaactctggataagcggaaaggatccgatggggccagcccccctgcaagccccagcatcatcccccggctga

SEQ ID NO: 12389 - DNA, 578 bp, synthetic construct
  misc_feature 1..578: note = Synthetic polypeptide
  source 1..578: mol_type = other DNA
ggttcaaatcccaggtggtctaccatgtactaatcacccaagacaatggcgatgaccactcagaaggaggcctggtggagaaccacgtggacagcaccatgaacatgttgggcgggggaggcagtgctggccggaagcccctcaagtcgggtatgaaggagctggccgtgttccgggagaaggtcactgagcagcaccggcagatgggcaagggtggcaagcatcaccttggcctggaggagcccaagaagctgcgaccaccccctgccaggactccctgccaacaggaactggaccaggtcctggagcggatctccaccatgcgccttccggatgagcggggccctctggagcacctctactccctgcacatccccaactgtgacaagcatggcctgtacaacctcaaacagtgcaagatgtctctgaacgggcagcgtggggagtgctggtgtgtgaaccccaacaccgggaagctgatccagggagcccccaccatccggggggaccccgagtgtcatctcttctacaatgagcagcaggaggctcgcggggtgcacacccagcggatgcagtag

SEQ ID NO: 12390 - DNA, 1779 bp, synthetic construct
  misc_feature 1..1779: note = Synthetic polypeptide
  source 1..1779: mol_type = other DNA
aaaataaataattgggacataattaaagtaaaaagcttctgcacagcaaaaataataataataatcacagtaaacagacaacctgtagggagaaaatatttgcaaactatgcatctgacaaaggactaatacccagaatctacaaggaactcaaacaaatcagcaagaaaaaaaaatcaaataatctcatcaaaaagtgggcaaatgacctaaatagaattttctcaaaagaagatatggccaacaaacatatgaaaaaatgctcaatgtcactaatcatcagggaaatgcaaattaaaaccacaatgagataccaccttactccagccagaatggccattactaaaaagtcaaagaacaatagatgttggcatggatgtgatgaaaagggaatacttaaacactgctggtgggaatgtaatttagtacaaccactgtagaaaccactgggtatctatccaaaggaagagaagtcattatataaaaagacacctgtatatgtatgtttatcgcagcacatttcacaattgcaaagatagggaaccaacctaagtgtcagctgatgagtggataaagcaaatttgatatatatacatcatgaaatactccccagccattaaaaaaagaatgaaataatatcttttgcagcaacgtggaaggaaccagaggctgttattctaagtgaagtaactctggaatggaaaaccaagtaccaggtcgtctcgcttacaagaatgttttaaaggaagttgggctactcacaagttactacataagaaagcaaaagatgaaaaggcgaagcgagaagtgtcttcctggactgtggaaggtgatattaatactgacccatgggcaggttatcgatatactggtaaactcagaccacattatccactgatgccaacaaggccagtgccaagttatattcaaagaccagattatgctgatcatcccttaggaatgtctgaatctgaacaggctcttaaaggtacttctcagattaaattactctcatctgaagatatagaagggatgcgacttgtatgtaggcttgctagagaagttttggatgttgctgccggcatgattaaaccaggtgtaactactgaagaaatagatcacgctgtacacttagcatgtattgcaagaaattgctacccttctcccctgaattattataatttcccaaagtcttgttgtacctcagtgaatgaagtcatttgccatggaataccagacagaaggcccttacaagaaggtgacattgttaatgtggatatcactctttatcgcaatggttatcatggggacctgaatgagacattttttgttggagaagtggatgatggagcacggaaacttgttcagaccacatatgagtgcctgatgcaagccattgatgcagtgaagcctggtgttcggtacagagaattgggaaacattatccagaagcatgcccaagcaaatgggttttcagttgttcgaagctattgtgggcatggaatccacaagctttttcatacagctcccaatgtaccccactatgctaaaaataaagcagttggagtgatgaagtcgggccatgtatttacaattgagccaatgatttgtgaaggcggatggcaggatgaaacctggccagatggttggactgcggtgacaagagacggaaagcggtctgctcagtttgagcacaccctcctggtcacagacactggctgtgaaatcctaacccggcgacttgacagtgcacggcctcacttcatgtctcaattttaa

SEQ ID NO: 12391 - DNA, 810 bp, synthetic construct
  misc_feature 1..810: note = Synthetic polypeptide
  source 1..810: mol_type = other DNA
aaaataaataattgggacataattaaagtaaaaagcttctgcacagcaaaaataataataataatcacagtaaacagacaacctgtagggagaaaatatttgcaaactatgcatctgacaaaggactaatacccagaatctacaaggaactcaaacaaatcagcaagaaaaaaaaatcaaataatctcatcaaaaagtgggcaaatgacctaaatagaattttctcaaaagaagatatggccaacaaacatatgaaaaaatgctcaatgtcactaatcatcagggaaatgcaaattaaaaccacaatgagataccaccttactccagccagaatggccattactaaaaagtcaaagaacaatagatgttggcatggatgtgatgaaaagggaatacttaaacactgctggtgggaatgtaatttagtacaaccactgtagaaaccactgggtatctatccaaaggaagagaagtcattatataaaaagacacctgtatatgtatgtttatcgcagcacatttcacaattgcaaagatagggaaccaacctaagtgtcagctgatgagtggataaagcaaatttgatatatatacatcatgaaatactccccagccattaaaaaaagaatgaaataatatcttttgcagcaacgtggaaggaaccagaggctgttattctaagtgaagtaactctggaatggaaaaccaagtaccaggtcgtctcgcttacaagaatgttttaaaggaagttgggctactcacaagttactacataagaaagcaaagagaaggtgttatgtaatgtcttaa

SEQ ID NO: 12392 - DNA, 766 bp, synthetic construct
  misc_feature 1..766: note = Synthetic polypeptide
  source 1..766: mol_type = other DNA
tgatatgatttggctctgtatctctacccaaatctcatctcaaattgtaattcccatgtgtcaaggagggacctggtgggaggtgattggataatgggagtggtttcccccatgctgttcttgtgatagtgagttctcatgagatctgatagtttaaaagtggctcttcctcctttgttctctcttttctcccaccccgcgaagagggtgcttgctttccctttgctttctgccataattacaagtttcctgagtcctcgccagccatgtggaactgcgcagtcatgcaggaaaacctcagatttgcttcatcaggagatgatattaaaatatgggatgcttcatctatgacattggtggataaattcaacccacacacatcaccacatggaatcagctcaatatgttggagcagcaataataactttttagtaacagcatcttccagtggcgacaaaatagttgtctcaagttgcaaatgtaaacctgttccacttttagagcttgctgaagggcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtag

SEQ ID NO: 12393 - DNA, 2267 bp, synthetic construct
  misc_feature 1..2267: note = Synthetic polypeptide
  source 1..2267: mol_type = other DNA
tgatatgatttggctctgtatctctacccaaatctcatctcaaattgtaattcccatgtgtcaaggagggacctggtgggaggtgattggataatgggagtggtttcccccatgctgttcttgtgatagtgagttctcatgagatctgatagtttaaaagtggctcttcctcctttgttctctcttttctcccaccccgcgaagagggtgcttgctttccctttgctttctgccataattacaagtttcctgagtcctcgccagccatgtggaactgcgcagtcatgcaggaaaacctcagatttgcttcatcaggagatgatattaaaatatgggatgcttcatctatgacattggtggataaattcaacccacacacatcaccacatggaatcagctcaatatgttggagcagcaataataactttttagtaacagcatcttccagtggcgacaaaatagttgtctcaagttgcaaatgtaaacctgttccacttttagagcttgctgaagggcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtagtaaccagtctgttcggcacttgaagtactccttgtttaagaaatcactactgggcagtgtttcggataatggaatagtaactctctgggatgtaaatagtcagagtccataccataactttgacagtgtacacaaagctccagcgtcaggcatctgtttttctcctgtcaatgaattgctctttgtaaccataggcttggataaaagaatcatcctctatgacacttcaagtaagaagctagtgaaaactttagtggctgacactcctctaactgcggtagatttcatgcctgatggagccactttggctattggatcttcccgggggaaaatatatcaatatgatttaagaatgttgaaatcaccagttaagaccatcagtgctcacaagacatctgtgcagtgtatagcatttcagtactccactgttcttactaagtcaagtttaaataaaggctgttcaaataagcccacaacagtgaacaaacgaagtgttaatgtgaatgctgctagtggaggagttcagaattccggaattgtcagagaagcacctgccacgtccattgccacagttctaccacaacctatgacatcagctatggggaaaggaacagttgctgttcaagaaaaagcaggtttgcctcgaagcataaacacagacactttatctaaggaaacagacagtggaaaaaatcaggatttctccagctttgatgatactgggaaaagtagtttaggtgacatgttctcacctatcagagatgatgctgtagttaacaagggaagtgatgagtccataggcaaaggagatggctttgactttctaccgcagttgaactcagtgtttcctccaagaaaaaatccagtaacttcaagtacttcagtattgcattctagtcctcttaatgtttttatgggatctccagggaaagaggaaaatgaaaaccgtgatctaacagctgagtctaagaaaatatatatgggaaaacaggaatctaaagactccttcaaacagttagcaaagttggtcacatctggtgctgaaagtggaaatctaaatacctctccatcatctaaccaaacaagaaattctgagaaatttgaaaagccagagaatgaaattgaagcccagttgatatgtgaacccccaatcaatggatcctcaactccaaatccaaagatagcatcttctgtcactgctggagttgccagttcactctcagaaaaaatagccgacagcattggaaataaccggcaaaatgcaccattgacttccattcaaattcgttttattcagaacatgatacaggaaacgttggatgactttagagaagcatgccatagggacattgtgaatttgcaagtggagatgattaaacagtttcatatgcaactgaatgaaatgcattctttgctggaaagatactcagtgaatgaaggtttagtggctgaaattgaaagactacgagaagaaaacaaaagattacgggcccacttttga

SEQ ID NO: 12394 - DNA, 1346 bp, synthetic construct; identical to SEQ ID NO: 7758
  misc_feature 1..1346: note = Synthetic polypeptide
  source 1..1346: mol_type = other DNA

SEQ ID NO: 12395 - DNA, 243 bp, synthetic construct
  misc_feature 1..243: note = Synthetic polypeptide
  source 1..243: mol_type = other DNA
ggccaggcacggtggctcacgcctgtaatcccagcactttgggaggccgagacgggcggatcacgaggtcaagagatggagaccatcccggctaacacggaagatattcttgatactggaaatgacaaaaatggaaaggaagaagtcataaagagaaaaattccttatattctgaaacggcagctgtatgagaataaacccagaagaccctacatactcaaaagagattcttactattactga

SEQ ID NO: 12396 - DNA, 367 bp, synthetic construct
  misc_feature 1..367: note = Synthetic polypeptide
  source 1..367: mol_type = other DNA
ggctgggtgcggtggctcatgcctgtaatcccagcactttgggaggccgacggatcacttgaggtcaggagttcaagaccagcctggccagcgtgttgaaaccctgcctctactaaaaatacaaaagttagctgggcatggtggtgggcgcctgtaatcccaggtgtatgcaacagcgttattgcaacaggctaacgaaaacagacaaaattcaactggaaaagcatgttttggcaccttcctcccagaagaaaaacttaatgactttcgtgatgaacaaattggacagttgcaggagctgatgcaagaagccacaaaacccaataggcaatttagtatttctgagtctatgaaaccaaaattttag

SEQ ID NO: 12397 - DNA, 882 bp, synthetic construct; identical to SEQ ID NO: 9355
  misc_feature 1..882: note = Synthetic polypeptide
  source 1..882: mol_type = other DNA

SEQ ID NO: 12398 - DNA, 1579 bp, synthetic construct; identical to SEQ ID NO: 7461
  misc_feature 1..1579: note = Synthetic polypeptide
  source 1..1579: mol_type = other DNA

SEQ ID NO: 12399 - DNA, 1504 bp, synthetic construct; identical to SEQ ID NO: 7462
  misc_feature 1..1504: note = Synthetic polypeptide
  source 1..1504: mol_type = other DNA

SEQ ID NO: 12400 - DNA, 353 bp, synthetic construct; identical to SEQ ID NO: 7197
  misc_feature 1..353: note = Synthetic polypeptide
  source 1..353: mol_type = other DNA

SEQ ID NO: 12401 - DNA, 121 bp, synthetic construct; identical to SEQ ID NO: 7198
  misc_feature 1..121: note = Synthetic polypeptide
  source 1..121: mol_type = other DNA

SEQ ID NO: 12402 - DNA, 826 bp, synthetic construct
  misc_feature 1..826: note = Synthetic polypeptide
  source 1..826: mol_type = other DNA
cctggttctctggggcacgaggcttctcctcagcactctggcgcccccaacaggttcccagtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaaggtcaggacttcaggactggaatgtgacagtccttcgtatcagaaaaggcagaggatggccctgttggcaaggaaacaaggagcaggagacagccttattgcaggctctgccatgtccaaagcaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 12403 - DNA, 718 bp, synthetic construct
  misc_feature 1..718: note = Synthetic polypeptide
  source 1..718: mol_type = other DNA
ggctacctacaaagggctcctggtgcagcagatcatcttcttcctgggaaccacggccctggccttcctggtgctcatgcctgtgctccatggcaggaacctcctgctcttccgttccctggagtcctcgtggcccttctggctgactttggccctggctgtgatcctgcagaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctga

SEQ ID NO: 12404 - DNA, 616 bp, synthetic construct
  misc_feature 1..616: note = Synthetic polypeptide
  source 1..616: mol_type = other DNA
ggctacctacaaagggctcctggtgcagcagatcatcttcttcctgggaaccacggccctggccttcctggtgctcatgcctgtgctccatggcaggaacctcctgctcttccgttccctggagtcctcgtgaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcaca

SEQ ID NO: 12405 - DNA, 326 bp, synthetic construct
  misc_feature 1..326: note = Synthetic polypeptide
  source 1..326: mol_type = other DNA
aatgtgttgtaatggggaaagctttagttcgtgtctgggatgtccggccatttgcccccaaagagagatgtgtaaagatatttcaaggaaatgtgcacaactttgaaaagaaccttctgagatgttcttggtcacctgatggaagcaaaatagcagctggctcagccgacaggtttgtttatgtgtgggataccacaagcaggagaatattgtataagctgcccggccatgctggctccatcaatgaagtggctttccaccctgatgagcccatcattatctcagcatcgagtgacaagagactgtatatgggagagattcagtga

SEQ ID NO: 12406 - DNA, 482 bp, synthetic construct
  misc_feature 1..482: note = Synthetic polypeptide
  source 1..482: mol_type = other DNA
aatgtgttgtaatggggaaagctttagttcgtgtctgggatgtccggccatttgcccccaaagagagatgtgtaaagatatttcaaggaaatgtgcacaactttgaaaagaaccttctgagatgttcttggtcacctgatggaagcaaaatagcagctggctcagccgacaggtttgtttatgtgtgggataccacaagcaggagaatattgtataagctgcccggccatgctggctccatcaatgaagtggctttccaccctgatgagcccatcatagagacggggtttcaccgcattggtcagggtggtcacgaactcctgacgtccagtaatccacccgcctcagcctcccaaagtgctgggattacaggtgtgagccactgtgcccagctgcaaacagtctttatgtgggtatcaatgtcagtctcaccattgctcataagtggtgagagtaagagcaatgctccattttcttcttga

SEQ ID NO: 12407 - DNA, 238 bp, synthetic construct
  misc_feature 1..238: note = Synthetic polypeptide
  source 1..238: mol_type = other DNA
cttccagccaagatggagtaacagagattagatttatgcttctacttgaaacaaccaagaaaactcagttctgcttgagatttcaagaattttgaatactggcttagatatggaaactctgtctatttgtgtacggctttgtgaacaaggaattaacccagaagctttatcatcggttattaaggagcttcgcaaggctactgaagcactgaaggctgctgaaaatatgacaagctga

SEQ ID NO: 12408 - DNA, 1389 bp, synthetic construct; identical to SEQ ID NO: 863
  misc_feature 1..1389: note = Synthetic polypeptide
  source 1..1389: mol_type = other DNA

SEQ ID NO: 12409 - DNA, 205 bp, synthetic construct
  misc_feature 1..205: note = Synthetic polypeptide
  source 1..205: mol_type = other DNA
aagacggccgaataggaacagctccggtctacagctcccagcgtgagcaatgcagaagaccggtgatttctgcatttccatctgagtgtgtatgtacagagaaccatcgctacatgaaattggagaaaaacaagggcgttcaaggaaaagttctggaacaccaaccatgaatggaggcaaagttgtgaatcaagattcaacatag

SEQ ID NO: 12410 - DNA, 154 bp, synthetic construct
  misc_feature 1..154: note = Synthetic polypeptide
  source 1..154: mol_type = other DNA
aagacggccgaataggaacagctccggtctacagctcccagcgtgagcaatgcagaagaccggtgatttctgcatttccatctgagtgtgtatgtacagagaaccatcgctacatgaaattggagaaaaacaagggcgttcaaggaaaagttct

SEQ ID NO: 12411 - DNA, 826 bp, synthetic construct; identical to SEQ ID NO: 12216
  misc_feature 1..826: note = Synthetic polypeptide
  source 1..826: mol_type = other DNA

SEQ ID NO: 12412 - DNA, 960 bp, synthetic construct; identical to SEQ ID NO: 7275
  misc_feature 1..960: note = Synthetic polypeptide
  source 1..960: mol_type = other DNA

SEQ ID NO: 12413 - DNA, 826 bp, synthetic construct; identical to SEQ ID NO: 12402
  misc_feature 1..826: note = Synthetic polypeptide
  source 1..826: mol_type = other DNA

SEQ ID NO: 12414 - DNA, 3380 bp, synthetic construct
  misc_feature 1..3380: note = Synthetic polypeptide
  source 1..3380: mol_type = other DNA
tgaaatttccataaaaacccaggaggactaggttccagaagcttcaggatggctcaacacgtggaggttcttggagggtggcctgcacaggaagggcatagaagccctgtgccccttcccccatacctcactctgtgcatctctttatctgtaatatcctttacaataaaccagtaaatgtaagtgtttcccaaagttctgtgagccctccagcaaattaatcaaacccaaagaggaggtcgtgggaaccccaacttgaaagccgatacatcaaattacagaatggcttgcaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacagtctgcagcggctctttgtgttggagttgggagtttcgctgatccagatgacctgccggggctggcacactttttggagcacatggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgatagatgggcgcagttcttcatccacccactaatgatcagagatgcaattgaccgtgaagttgaagctgttgatagtgaatatcaacttgcaaggccttctgatgcaaacagaaaggaaatgttgtttggaagccttgctagacctggacatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttggccatttaacggatccatttgacacaccagcatttaacaaactttatagagttgttccaatcagaaaaattcatgctctgaccatcacatgggcacttcctcctcaacagcaacattacagggtgaagccacttcattatatatcctggctggttggacatgaaggcaaaggcagcattctttctttccttaggaaaaaatgctgggctcttgcactgtttggtggaaatggtgagacaggatttgagcaaaattctacttattcagtgttcagcatttctattacattgactgatgagggttatgaacatttttatgaggttgcttacactgtctttcagtatttaaaaatgctgcagaagctaggcccagaaaaaagaatttttgaagagattcggaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagccacggactttacgttgaaggctttcgattgcccggaaacagaatacccagttaaaattgtgaatactccacaaggttgcctgtggtataagaaagacaacaaattcaaaatccccaaagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctctactgtttcagctcattattgactacttagctgagttcaattccacaccagctgtctttacaatgataactgagcagttgaagaagacctactttaacatcctcatcaagcccgagactttggccaaagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagaatctatggatttcctgaaatatgttgttgacaaactaaacttcaagcctctggagcaggagatgcctgtgcagttccaggtggtagagctgcccagtggccaccatctatgcaaagtgaaagctctgaacaagggtgatgccaactctgaagtcactgtgtactaccagtcaggtaccaggagtctaagagaatatacgcttatggagctgcttgtgatgcacatggaagaaccttgttttgacttccttcgaaccaagcagacccttgggtaccatgtctaccctacctgtaggaacacatccgggattctaggattttctgtcactgtggggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggcccatagagggccaggaagtaaaatgctcagcgttcatgttgttggatatgggaagtatgaactggaagaggatggtaccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataa

SEQ ID NO: 12415 - DNA, 3584 bp, synthetic construct
  misc_feature 1..3584: note = Synthetic polypeptide
  source 1..3584: mol_type = other DNA
tgaaatttccataaaaacccaggaggactaggttccagaagcttcaggatggctcaacacgtggaggttcttggagggtggcctgcacaggaagggcatagaagccctgtgccccttcccccatacctcactctgtgcatctctttatctgtaatatcctttacaataaaccagtaaatgtaagtgtttcccaaagttctgtgagccctccagcaaattaatcaaacccaaagaggaggtcgtgggaaccccaacttgaaagccgatacatcaaattacagaatggcttgcaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacagcaattgcagagcctgtttttgctgtggtcaaagctgactgatagactgtggtttaagtcaacttattcaaaaatgtcttcaaccctgctggtcgagacaagaaatctttatggggtagttggagctgaaagcaggtctgcacctgttcagcatttggcaggatggcaagcggaggagcagcagggtgaaactgacacagttctgtctgcagcggctctttgtgttggagttgggagtttcgctgatccagatgacctgccggggctggcacactttttggagcacatggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgatagatgggcgcagttcttcatccacccactaatgatcagagatgcaattgaccgtgaagttgaagctgttgatagtgaatatcaacttgcaaggccttctgatgcaaacagaaaggaaatgttgtttggaagccttgctagacctggacatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttggccatttaacggatccatttgacacaccagcatttaacaaactttatagagttgttccaatcagaaaaattcatgctctgaccatcacatgggcacttcctcctcaacagcaacattacagggtgaagccacttcattatatatcctggctggttggacatgaaggcaaaggcagcattctttctttccttaggaaaaaatgctgggctcttgcactgtttggtggaaatggtgagacaggatttgagcaaaattctacttattcagtgttcagcatttctattacattgactgatgagggttatgaacatttttatgaggttgcttacactgtctttcagtatttaaaaatgctgcagaagctaggcccagaaaaaagaatttttgaagagattcggaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagccacggactttacgttgaaggctttcgattgcccggaaacagaatacccagttaaaattgtgaatactccacaaggttgcctgtggtataagaaagacaacaaattcaaaatccccaaagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctctactgtttcagctcattattgactacttagctgagttcaattccacaccagctgtctttacaatgataactgagcagttgaagaagacctactttaacatcctcatcaagcccgagactttggccaaagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagaatctatggatttcctgaaatatgttgttgacaaactaaacttcaagcctctggagcaggagatgcctgtgcagttccaggtggtagagctgcccagtggccaccatctatgcaaagtgaaagctctgaacaagggtgatgccaactctgaagtcactgtgtactaccagtcaggtaccaggagtctaagagaatatacgcttatggagctgcttgtgatgcacatggaagaaccttgttttgacttccttcgaaccaagcagacccttgggtaccatgtctaccctacctgtaggaacacatccgggattctaggattttctgtcactgtggggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggcccatagagggccaggaagtaaaatgctcagcgttcatgttgttggatatgggaagtatgaactggaagaggatggtaccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataa

SEQ ID NO: 12416 - DNA, 581 bp, synthetic construct
  misc_feature 1..581: note = Synthetic polypeptide
  source 1..581: mol_type = other DNA
acttaacacccattagaatggccactatcaaaaaaacagagaatgacacatgttggcaaggatactgaaaaattggaacccttgtgcattgttggtgtgaatgtaaaatggtacaactgctatttaaaaatagtatggaggtttctcaaaaaatgctcaaaaaagagaactacgatattatccagcaattccacctcaggatacgaaatgtggaaacgaatcagtgtctagataacatggctagaaaagagaatgaaaaagttggaatttttaattgccatggtatggggggtaatcaggttttctcttatactgccaacaaagaaattagaacagatgacctttgcttggatgtttccaaacttaatggcccagttacaatgctcaaatgccaccacctaaaaggcaaccaactctgggagtatgacccagtgaaattaaccctgcagcatgtgaacagtaatcagtgcctggataaagccacagaagaggatagccaggtgcccagcattagagactgcaatggaagtcggtcccagcagtggcttcttcgaaacgtcaccctgccagaaatattctga

SEQ ID NO: 12417 - DNA, 455 bp, synthetic construct; identical to SEQ ID NO: 7734
  misc_feature 1..455: note = Synthetic polypeptide
  source 1..455: mol_type = other DNA

SEQ ID NO: 12418 - DNA, 771 bp, synthetic construct; identical to SEQ ID NO: 8620
  misc_feature 1..771: note = Synthetic polypeptide
  source 1..771: mol_type = other DNA

SEQ ID NO: 12419 - DNA, 720 bp, synthetic construct; identical to SEQ ID NO: 8621
  misc_feature 1..720: note = Synthetic polypeptide
  source 1..720: mol_type = other DNA

SEQ ID NO: 12420 - DNA, 464 bp, synthetic construct; identical to SEQ ID NO: 8622
  misc_feature 1..464: note = Synthetic polypeptide
  source 1..464: mol_type = other DNA

SEQ ID NO: 12421 - DNA, 607 bp, synthetic construct; identical to SEQ ID NO: 9998
  misc_feature 1..607: note = Synthetic polypeptide
  source 1..607: mol_type = other DNA

SEQ ID NO: 12422 - DNA, 225 bp, synthetic construct; identical to SEQ ID NO: 7100
  misc_feature 1..225: note = Synthetic polypeptide
  source 1..225: mol_type = other DNA

SEQ ID NO: 12423 - DNA, 1731 bp, synthetic construct; identical to SEQ ID NO: 6691
  misc_feature 1..1731: note = Synthetic polypeptide
  source 1..1731: mol_type = other DNA

SEQ ID NO: 12424 - DNA, 2019 bp, synthetic construct; identical to SEQ ID NO: 6692
  misc_feature 1..2019: note = Synthetic polypeptide
  source 1..2019: mol_type = other DNA

SEQ ID NO: 12425 - DNA, 2043 bp, synthetic construct; identical to SEQ ID NO: 6693
  misc_feature 1..2043: note = Synthetic polypeptide
  source 1..2043: mol_type = other DNA

SEQ ID NO: 12426 - DNA, 554 bp, synthetic construct; identical to SEQ ID NO: 6694
  misc_feature 1..554: note = Synthetic polypeptide
  source 1..554: mol_type = other DNA

SEQ ID NO: 12427 - DNA, 281 bp, synthetic construct; identical to SEQ ID NO: 9447
  misc_feature 1..281: note = Synthetic polypeptide
  source 1..281: mol_type = other DNA

SEQ ID NO: 12428 - DNA, 990 bp, synthetic construct; identical to SEQ ID NO: 9448
  misc_feature 1..990: note = Synthetic polypeptide
  source 1..990: mol_type = other DNA

SEQ ID NO: 12429 - DNA, 338 bp, synthetic construct; identical to SEQ ID NO: 9449
  misc_feature 1..338: note = Synthetic polypeptide
  source 1..338: mol_type = other DNA

SEQ ID NO: 12430 - DNA, 367 bp, synthetic construct; identical to SEQ ID NO: 9450
  misc_feature 1..367: note = Synthetic polypeptide
  source 1..367: mol_type = other DNA

SEQ ID NO: 12431 - DNA, 197 bp, synthetic construct; identical to SEQ ID NO: 9451
  misc_feature 1..197: note = Synthetic polypeptide
  source 1..197: mol_type = other DNA

SEQ ID NO: 12432 - DNA, 813 bp, synthetic construct; identical to SEQ ID NO: 9452
  misc_feature 1..813: note = Synthetic polypeptide
  source 1..813: mol_type = other DNA

SEQ ID NO: 12433 - DNA, 583 bp, synthetic construct; identical to SEQ ID NO: 9453
  misc_feature 1..583: note = Synthetic polypeptide
  source 1..583: mol_type = other DNA

SEQ ID NO: 12434 - DNA, 795 bp, synthetic construct; identical to SEQ ID NO: 9454
  misc_feature 1..795: note = Synthetic polypeptide
  source 1..795: mol_type = other DNA

SEQ ID NO: 12435 - DNA, 588 bp, synthetic construct; identical to SEQ ID NO: 9455
  misc_feature 1..588: note = Synthetic polypeptide
  source 1..588: mol_type = other DNA

SEQ ID NO: 12436 - DNA, 379 bp, synthetic construct; identical to SEQ ID NO: 9456
  misc_feature 1..379: note = Synthetic polypeptide
  source 1..379: mol_type = other DNA

SEQ ID NO: 12437 - DNA, 2271 bp, synthetic construct; identical to SEQ ID NO: 8631
  misc_feature 1..2271: note = Synthetic polypeptide
  source 1..2271: mol_type = other DNA

SEQ ID NO: 12438 - DNA, 814 bp, synthetic construct; identical to SEQ ID NO: 8476
  misc_feature 1..814: note = Synthetic polypeptide
  source 1..814: mol_type = other DNA

SEQ ID NO: 12439 - DNA, 1348 bp, synthetic construct; identical to SEQ ID NO: 8477
  misc_feature 1..1348: note = Synthetic polypeptide
  source 1..1348: mol_type = other DNA

SEQ ID NO: 12440 - DNA, 780 bp, synthetic construct; identical to SEQ ID NO: 9512
  misc_feature 1..780: note = Synthetic polypeptide
  source 1..780: mol_type = other DNA

SEQ ID NO: 12441 - DNA, 606 bp, synthetic construct; identical to SEQ ID NO: 9513
  misc_feature 1..606: note = Synthetic polypeptide
  source 1..606: mol_type = other DNA

SEQ ID NO: 12442 - DNA, 523 bp, synthetic construct
  misc_feature 1..523: note = Synthetic polypeptide
  source 1..523: mol_type = other DNA
tgatatggtttggctgtgttcccacccaaatctcatcctgaattgtagttcccataatccccacatgtcgtgggagggacccagagggaggtaattggaccttgggggtggctttccccattctattgtcatggtattgagtaagttctcacgagagctgatggttttataaggggcttcccccttcactcagctctcattcttttccctcctgccaccatgtgaagaaggacatgcttgctttctcttctgccatgattgtaagtttcctgaggcctccccagccctgcagaacactactgccttcctcatcaacaaagtgccccttcctgttgacaagttggcacctttacctctggacaacattcttccctttatggatccattaaagcttcttctgaaaactctgggcatttctgttgagcaccttgtggaggggctaaggaagtgtgtaaatgagctgggaccagaggcttctgaagctgtgaagaaactgctggaggcgctatcacacttggtgtga

SEQ ID NO: 12443 - DNA, 398 bp, synthetic construct; identical to SEQ ID NO: 6790
  misc_feature 1..398: note = Synthetic polypeptide
  source 1..398: mol_type = other DNA

SEQ ID NO: 12444 - DNA, 391 bp, synthetic construct; identical to SEQ ID NO: 6791
  misc_feature 1..391: note = Synthetic polypeptide
  source 1..391: mol_type = other DNA

SEQ ID NO: 12445 - DNA, 473 bp, synthetic construct; identical to SEQ ID NO: 6792
  misc_feature 1..473: note = Synthetic polypeptide
  source 1..473: mol_type = other DNA

SEQ ID NO: 12446 - DNA, 622 bp, synthetic construct
  misc_feature 1..622: note = Synthetic polypeptide
  source 1..622: mol_type = other DNA
ccagggggaattttagaaaatgtctggggatgaccttttccccaaagatgataaaggtaatgccatcggtggaaaagcaacgttcttggatgcctgggaggccatggaggagctggtggatgaggggctggtgaaagcccttggggtctccaatttcagccacttccagatcgagaagctcttgaacaaacctggactgaaatataaaccagtgactaaccaggttgagtgtcacccatacctcacacaggagaaactgatccagtactgccactccaagggcatcaccgttacggcctacagccccctgggctctccggatagaccttgggccaagccagaagacccttccctgctggaggatcccaagattaaggagattgctgcaaagcacaaaaaaaccgcagcccaggttctgatccgtttccatatccagaggaatgtgattgtcatccccaagtctgtgacaccagcacgcattgttgagaacattcaggtctttgactttaaattgagtgatgaggagatggcaaccatactcagcttcaacagaaactggagggcctgtaacgtgttgcaatcctctcatttggaagactatcccttcaatgcagaatattga

SEQ ID NO: 12447 - DNA, 384 bp, synthetic construct; identical to SEQ ID NO: 8641
  misc_feature 1..384: note = Synthetic polypeptide
  source 1..384: mol_type = other DNA

SEQ ID NO: 12448 - DNA, 345 bp, synthetic construct; identical to SEQ ID NO: 8642
  misc_feature 1..345: note = Synthetic polypeptide
  source 1..345: mol_type = other DNA

SEQ ID NO: 12449 - DNA, 474 bp, synthetic construct
  misc_feature 1..474: note = Synthetic polypeptide
  source 1..474: mol_type = other DNA
gaccaggcatggtggctcacacctgaaatcccagcactttgggaggccaaagcagaaggatcgcttgagcccaggagttcaggaccagcctgggcaacatagcaagaccctgtctctacagaaaaacacacacacagaaaaattagccgggcatgggagctgcaggaggagagcggtctgacagtggacgccctgcacaaggtgggccagatcgtgtttgagttcgtgggcgagcctgagctcatggacgtgcatgtcttctgcacagacagcatccaggggacccccgtggagagcgacgaaatgcgcccatgctggttccagctggatcagatccccttcaaggacatgtggcccgacgacagctactggtttccactcctgcttcagaagaagaaattccacgggtacttcaagttccagggtcaggacaccatcctggactacacactccgcgaggtggacacggtctag

SEQ ID NO: 12450 - DNA, 878 bp, synthetic construct
  misc_feature 1..878: note = Synthetic polypeptide
  source 1..878: mol_type = other DNA
agattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccagggggccttgggcgtggaagtgcgagccaaggaccaggacatcttggatctggtgggtgtgctgcacgatcccgagactctgcttcgctgcatcgctgaaagggccttcctgaggcacctggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaa

SEQ ID NO: 12451 - DNA, 168 bp, synthetic construct
  misc_feature 1..168: note = Synthetic polypeptide
  source 1..168: mol_type = other DNA
agattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttc

SEQ ID NO: 12452 - DNA, 758 bp, synthetic construct
  misc_feature 1..758: note = Synthetic polypeptide
  source 1..758: mol_type = other DNA
agattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccaggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaa

SEQ ID NO: 12453 - DNA, 366 bp, synthetic construct
  misc_feature 1..366: note = Synthetic polypeptide
  source 1..366: mol_type = other DNA
agattggagagaaaagcctgtttaccaaggagcttgaacatgccctggagaagaatgagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccagg

SEQ ID NO: 12454 - DNA, 839 bp, synthetic construct
  misc_feature 1..839: note = Synthetic polypeptide
  source 1..839: mol_type = other DNA
agattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagggggccttgggcgtggaagtgcgagccaaggaccaggacatcttggatctggtgggtgtgctgcacgatcccgagactctgcttcgctgcatcgctgaaagggccttcctgaggcacctggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaa

SEQ ID NO: 12455 - DNA, 404 bp, synthetic construct
  misc_feature 1..404: note = Synthetic polypeptide
  source 1..404: mol_type = other DNA
agattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcag

SEQ ID NO: 12456 - DNA, 389 bp, synthetic construct
  misc_feature 1..389: note = Synthetic polypeptide
  source 1..389: mol_type = other DNA
gtactcttgaatacaagtttcttataattttaagattgtattatagcactgagtaaacaatttcagaactctaatttttaaaaagtcataaaattgttaactcaacatcaagcaaaacaactaattacattggactaatgtaattttaataacttttttgtttaaaatattgctgattctttttatgttttgctttacagagttaaggaaaatgtttgttctgttaagctttacagaaatgggaaaatctacctgatttttataatgactggatgttcattgctaaacatctgcctgatctcatagagtctggccagcttcgagaaagagttgagaagttaaacatgctcagcattgatcatctcacagaccacaagtcacagcgcctt

SEQ ID NO: 12457 - DNA, 695 bp, synthetic construct
  misc_feature 1..695: note = Synthetic polypeptide
  source 1..695: mol_type = other DNA
gtactcttgaatacaagtttcttataattttaagattgtattatagcactgagtaaacaatttcagaactctaatttttaaaaagtcataaaattgttaactcaacatcaagcaaaacaactaattacattggactaatgtaattttaataacttttttgtttaaaatattgctgattctttttatgttttgctttacagagttaaggaaaatgtttgttctgttaagctttacagaaatgggaaaatctacctgatttttataatgactggatgttcattgctaaacatctgcctgatctcatagagtctggccagcttcgagaaagagttgagaagttaaacatgctcagcattgatcatctcacagaccacaagtcacagcgccttgcacgtctagttctgggatgcatcaccatggcatatgtgtggggcaaaggtcatggagatgtccgtaaggtcttgccaagaaatattgctgttccttactgccaactctccaagaaactggaactgcctcctattttggtttatgcagactgtgtcttggcaaactggaagaaaaaggatcctaataagcccctgacttatgagaacatggacgttttgttctcatttcgtgatggagactgcagtaaaggattcttcctggtctctctattggtggaaatagcagctgcttctgcaatcaaagta

SEQ ID NO: 12458 - DNA, 1367 bp, synthetic construct
  misc_feature 1..1367: note = Synthetic polypeptide
  source 1..1367: mol_type = other DNA
gtactcttgaatacaagtttcttataattttaagattgtattatagcactgagtaaacaatttcagaactctaatttttaaaaagtcataaaattgttaactcaacatcaagcaaaacaactaattacattggactaatgtaattttaataacttttttgtttaaaatattgctgattctttttatgttttgctttacagagttaaggaaaatgtttgttctgttaagctttacagaaatgggaaaatctacctgatttttataatgactggatgttcattgctaaacatctgcctgatctcatagagtctggccagcttcgagaaagagttgagaagttaaacatgctcagcattgatcatctcacagaccacaagtcacagcgccttgcacgtctagttctgggatgcatcaccatggcatatgtgtggggcaaaggtcatggagatgtccgtaaggtcttgccaagaaatattgctgttccttactgccaactctccaagaaactggaactgcctcctattttggtttatgcagactgtgtcttggcaaactggaagaaaaaggatcctaataagcccctgacttatgagaacatggacgttttgttctcatttcgtgatggagactgcagtaaaggattcttcctggtctctctattggtggaaatagcagctgcttctgcaatcaaagtaattcctactgtattcaaggcaatgcaaatgcaagaacgggacactttgctaaaggcgctgttggaaatagcttcttgcttggagaaagcccttcaagtgtttcaccaaatccacgatcatgtgaacccaaaagcatttttcagtgttcttcgcatatatttgtctggctggaaaggcaacccccagctatcagacggtctggtgtatgaagggttctgggaagacccaaaggagtttgcagggggcagtgcaggccaaagcagcgtctttcagtgctttgacgtcctgctgggcatccagcagactgctggtggaggacatgctgctcagttcctccaggacatgagaagatatatgccaccagctcacaggaacttcctgtgctcattagagtcaaatccctcagtccgtgagtttgtcctttcaaaaggtgatgctggcctgcgggaagcttatgacgcctgtgtgaaagctctggtctccctgaggagctaccatctgcaaatcgtgactaagtacatcctgattcctgcaagccagcagccaaaggagaataagacctctgaagacccttcaaaactggaagccaaaggaactggaggcactgatttaatgaatttcctgaagactgtaagaagtacaactgagaaatcccttttgaaggaaggttaa

SEQ ID NO: 12459 - DNA, 297 bp, synthetic construct
  misc_feature 1..297: note = Synthetic polypeptide
  source 1..297: mol_type = other DNA
gtactcttgaatacaagtttcttataattttaagattgtattatagcactgagtaaacaatttcagaactctaatttttaaaaagtcataaaattgttaactcaacatcaagcaaaacaactaattacattggactaatgtaattttaataacttttttgtttaaaatattgctgattctttttatgttttgctttacagagttaaggaaaatgtttgttctgttaagctttacagaaatgggaaaatctacctgatttttataatgactggatgttcattgctaaacatctgcctg

SEQ ID NO: 12460 - DNA, 668 bp, synthetic construct
  misc_feature 1..668: note = Synthetic polypeptide
  source 1..668: mol_type = other DNA
gtactcttgaatacaagtttcttataattttaagattgtattatagcactgagtaaacaatttcagaactctaatttttaaaaagtcataaaattgttaactcaacatcaagcaaaacaactaattacattggactaatgtaattttaataacttttttgtttaaaatattgctgattctttttatgttttgctttacagagttaaggaaaatgtttgttctgttaagctttacagaaatgggaaaatctacctgatttttataatgactggatgttcattgctaaacatctgcctgatctcatagagtctggccagcttcgagaaagagttgagaagttaaacatgctcagcattgatcatctcacagaccacaagtcacagcgccttgcacgtctagttctgggatgcatcaccatggcatatgtgtggggcaaaggtcatggagatgtccgtaaggtcttgccaagaaatattgctgttccttactgccaactctccaagaaactggaactgcctcctattttggtttatgcagactgtgtcttggcaaactggaagaaaaaggatcctaataagtatgtaaacagaacatggacgttttgttctcatttcgtgatggagactgcagtaaaggattcttcctggtctctctattggtggaaatag

SEQ ID NO: 12461 - DNA, 258 bp, synthetic construct
  misc_feature 1..258: note = Synthetic polypeptide
  source 1..258: mol_type = other DNA
ggccaggttcggtggcttatacctgtaatcccagcactttgggaggccaagttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctag

SEQ ID NO: 12462 - DNA, 570 bp, synthetic construct
  misc_feature 1..570: note = Synthetic polypeptide
  source 1..570: mol_type = other DNA
ggccaggttcggtggcttatacctgtaatcccagcactttgggaggccaagttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcagtttagaaaacgctaaaccctcctcccaggcagcctccgtcacgatccctgatcacctcagcatcaacctctctcaaccctccaccccttcttcttcttcctcctccaccaccaccccctcgctcgccacagcggggacctccgacgcaccctccagcctccccaaccctcttccgaccgccccttgtgtctccagtctgcttggcatgaaacccatccctctcctggctctaaatgttgtgtctgctgctaagggtaccggggcttcagctaccaccaccaccacctctgccgtgccatgtgtaactaacaaactgaaaggcgagaaacagagattctctccctactga

SEQ ID NO: 12463 - DNA, 1317 bp, synthetic construct; identical to SEQ ID NO: 7058
  misc_feature 1..1317: note = Synthetic polypeptide
  source 1..1317: mol_type = other DNA

SEQ ID NO: 12464 - DNA, 1083 bp, synthetic construct; identical to SEQ ID NO: 7162
  misc_feature 1..1083: note = Synthetic polypeptide
  source 1..1083: mol_type = other DNA

SEQ ID NO: 12465 - DNA, 648 bp, synthetic construct; identical to SEQ ID NO: 7163
  misc_feature 1..648: note = Synthetic polypeptide
  source 1..648: mol_type = other DNA

SEQ ID NO: 12466 - DNA, 244 bp, synthetic construct; identical to SEQ ID NO: 7164
  misc_feature 1..244: note = Synthetic polypeptide
  source 1..244: mol_type = other DNA

SEQ ID NO: 12467 - DNA, 633 bp, synthetic construct; identical to SEQ ID NO: 7165
  misc_feature 1..633: note = Synthetic polypeptide
  source 1..633: mol_type = other DNA

SEQ ID NO: 12468 - DNA, 495 bp, synthetic construct; identical to SEQ ID NO: 7166
  misc_feature 1..495: note = Synthetic polypeptide
  source 1..495: mol_type = other DNA

SEQ ID NO: 12469 - DNA, 1334 bp, synthetic construct; identical to SEQ ID NO: 9457
  misc_feature 1..1334: note = Synthetic polypeptide
  source 1..1334: mol_type = other DNA

SEQ ID NO: 12470 - DNA, 701 bp, synthetic construct; identical to SEQ ID NO: 9458
  misc_feature 1..701: note = Synthetic polypeptide
  source 1..701: mol_type = other DNA

SEQ ID NO: 12471 - DNA, 2870 bp, synthetic construct; identical to SEQ ID NO: 9459
  misc_feature 1..2870: note = Synthetic polypeptide
  source 1..2870: mol_type = other DNA

SEQ ID NO: 12472 - DNA, 1446 bp, synthetic construct; identical to SEQ ID NO: 8572
  misc_feature 1..1446: note = Synthetic polypeptide
  source 1..1446: mol_type = other DNA

SEQ ID NO: 12473 - DNA, 104 bp, synthetic construct; identical to SEQ ID NO: 8573
  misc_feature 1..104: note = Synthetic polypeptide
  source 1..104: mol_type = other DNA

SEQ ID NO: 12474 - DNA, 489 bp, synthetic construct; identical to SEQ ID NO: 8574
  misc_feature 1..489: note = Synthetic polypeptide
  source 1..489: mol_type = other DNA

SEQ ID NO: 12475 - DNA, 859 bp, synthetic construct; identical to SEQ ID NO: 6990
  misc_feature 1..859: note = Synthetic polypeptide
  source 1..859: mol_type = other DNA

SEQ ID NO: 12476 - DNA, 657 bp, synthetic construct; identical to SEQ ID NO: 6991
  misc_feature 1..657: note = Synthetic polypeptide
  source 1..657: mol_type = other DNA

SEQ ID NO: 12477 - DNA, 587 bp, synthetic construct; identical to SEQ ID NO: 6992
  misc_feature 1..587: note = Synthetic polypeptide
  source 1..587: mol_type = other DNA

SEQ ID NO: 12478 - DNA, 568 bp, synthetic construct; identical to SEQ ID NO: 6993
  misc_feature 1..568: note = Synthetic polypeptide
  source 1..568: mol_type = other DNA

SEQ ID NO: 12479 - DNA, 494 bp, synthetic construct; identical to SEQ ID NO: 6994
  misc_feature 1..494: note = Synthetic polypeptide
  source 1..494: mol_type = other DNA

SEQ ID NO: 12480 - DNA, 368 bp, synthetic construct; identical to SEQ ID NO: 6995
  misc_feature 1..368: note = Synthetic polypeptide
  source 1..368: mol_type = other DNA

SEQ ID NO: 12481 - DNA, 2658 bp, synthetic construct; identical to SEQ ID NO: 9257
  misc_feature 1..2658: note = Synthetic polypeptide
  source 1..2658: mol_type = other DNA

SEQ ID NO: 12482 - DNA, 507 bp, synthetic construct; identical to SEQ ID NO: 881
  misc_feature 1..507: note = Synthetic polypeptide
  source 1..507: mol_type = other DNA

SEQ ID NO: 12483 - DNA, 1713 bp, synthetic construct
  misc_feature 1..1713: note = Synthetic polypeptide
  source 1..1713: mol_type = other DNA
ctctctctaatcactttccccatgtcctgttttattttttctttatagtactgctagcagctgacattatctatgcctttgtttccattagaatgtgagccagatgaagaatcatggggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaa

SEQ ID NO: 12484 - DNA, 1732 bp, synthetic construct
  misc_feature 1..1732: note = Synthetic polypeptide
  source 1..1732: mol_type = other DNA
ggggaaaagtattttcaaactcataataacggctatcattaagaaggcttccgatctagagtacaaaatccagagaagaacccttttcaaggaagactttatcaattatgttcaatatgaaattaatcttttggagctgatccagagaagaagaacacgcattggatattcatttaagaaggatgagattgagaattctattgtacaccgggtacaaggtgttttccagcgtgcctcagcaaaatggaaagacgatgttcaactttggctctcctatgtggctttttgtaagaagtgggctactaaaactcgacttagcaaggtattctctgccatgttggcgattcattccaacaaaccagctttgtggattatggcagccaaatgggaaatggaagatcgattgtcttcagaaagcgcaaggcaactatttcttcgcgcactgcgctttcatccagagtgcccaaaactttataaagaatactttaggatggagctgatgcatgctgaaaaactgaggaaggagaaggaagaatttgaaaaagccagtatggatgtggagaatcctgattattctgaagaaatccttaagggcgagttggcatggatcatctacaaaaattctgtaagcataattaaaggtgcagaatttcacgtgtcactgctttcgattgcacagctatttgactttgccaaagatctacaaaaagagatttatgatgaccttcaggctctacacacagatgatcctctcacttgggattatgtggcaaggcgagaattagagattgagtcacagacagaagagcagcctacaacgaaacaagccaaagcagtggaggtcggccggaaggaggagaggtgctgtgctgtgtatgaagaggcagtgaagactctgccaacagaggccatgtggaagtgttacatcaccttttgcttggaaagatttactaagaagtcaaatagtgggttccttagagggaagaggttggaaagaaccatgactgtattcaggaaggcacatgaactgaagcttctgtcagaatgccaatacaagcagttgagtgtttcgttgctgtgttataacttcctgagggaagctctggaagtggcagtagctggaactgaattgtttagagactctgggacaatgtggcagctgaagctgcaggtgctgatcgagtcaaagagccctgacatagccatgctttttgaagaagcctttgtgcacctgaaaccccaggtttgtctgccattgtggatttcctgggcagagtggagtgaaggtgccaaaagccaagaagacactgaggcagtctttaagaaagctctcttagctgtcataggtgccgactcagtaaccctgaagaataagtacctggattgggcttatcgaagtggtggctacaaaaaggccagagctgtgtttaaaagtttacaggagagccgaccattttcagttgactttttcaggaaaatgattcagtttgaaaaggagcaagaatcctgcaatatggcgaacataagagaatattatgagagagctttgagagagtttggatccgcagattctgatctttggatggattatatgaaagaagaattgaaccacccccttggtagacctgagaactgtggacagatctactggcgagcgatgaaaatgttgcagggagagtcagcagaggcatttgtagctaaacatgctatgcatcagactggccatttatga

SEQ ID NO: 12485 - DNA, 607 bp, synthetic construct; identical to SEQ ID NO: 8464
  misc_feature 1..607: note = Synthetic polypeptide
  source 1..607: mol_type = other DNA

SEQ ID NO: 12486 - DNA, 521 bp, synthetic construct; identical to SEQ ID NO: 8465
  misc_feature 1..521: note = Synthetic polypeptide
  source 1..521: mol_type = other DNA

SEQ ID NO: 12487 - DNA, 2158 bp, synthetic construct; identical to SEQ ID NO: 514
  misc_feature 1..2158: note = Synthetic polypeptide
  source 1..2158: mol_type = other DNA

SEQ ID NO: 12488 - DNA, 124 bp, synthetic construct; identical to SEQ ID NO: 515
  misc_feature 1..124: note = Synthetic polypeptide
  source 1..124: mol_type = other DNA

SEQ ID NO: 12489 - DNA, 166 bp, synthetic construct; identical to SEQ ID NO: 516
  misc_feature 1..166: note = Synthetic polypeptide
  source 1..166: mol_type = other DNA

SEQ ID NO: 12490 - DNA, 1776 bp, synthetic construct; identical to SEQ ID NO: 517
  misc_feature 1..1776: note = Synthetic polypeptide
  source 1..1776: mol_type = other DNA

SEQ ID NO: 12491 - DNA, 319 bp, synthetic construct; identical to SEQ ID NO: 520
  misc_feature 1..319: note = Synthetic polypeptide
  source 1..319: mol_type = other DNA

SEQ ID NO: 12492 - DNA, 1218 bp, synthetic construct; identical to SEQ ID NO: 8394
  misc_feature 1..1218: note = Synthetic polypeptide
  source 1..1218: mol_type = other DNA

SEQ ID NO: 12493 - DNA, 1053 bp, synthetic construct; identical to SEQ ID NO: 8395
  misc_feature 1..1053: note = Synthetic polypeptide
  source 1..1053: mol_type = other DNA

SEQ ID NO: 12494 - DNA, 942 bp, synthetic construct; identical to SEQ ID NO: 8396
  misc_feature 1..942: note = Synthetic polypeptide
  source 1..942: mol_type = other DNA

SEQ ID NO: 12495 - DNA, 1091 bp, synthetic construct; identical to SEQ ID NO: 8397
  misc_feature 1..1091: note = Synthetic polypeptide
  source 1..1091: mol_type = other DNA

SEQ ID NO: 12496 - DNA, 910 bp, synthetic construct
  misc_feature 1..910: note = Synthetic polypeptide
  source 1..910: mol_type = other DNA
catgcctttgctgctgtccttggtcagaatgactcatcattcgtgtaattcttgctacttgctcaatccagttcaaatgctgctccttctcagaagccttccctgttctctccctccctgcacagataattgttttttctggctctggcccttcatcactctgctgttgcaccttctgcagtgtctgtgttctgatcagactgtgggctactggaatgcaggcaccagcttgagtcatccttgtgaatctggggtcttctgccgagtggtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctga

SEQ ID NO: 12497 - DNA, 2154 bp, synthetic construct
  misc_feature 1..2154: note = Synthetic polypeptide
  source 1..2154: mol_type = other DNA
agtagtcagcaaactatgtcccatggagccaaatttagcccatgacctgcaaggtctcacgctgttgcatgtgtcaatcagtttatcatcagtaggactcaagctctaatgttgcacattgattcttttattgagaatctctttgcattagctggtgatgaagaaccagaggtacggaaaaatgtgtgccgagcacttgtgatgttgctcgaagttcgaatggatcgcctgcttcctcacatgcataatatagttgagtacatgctacagaggactcaagatcaagatgaaaatgtggctttagaagcctgtgaattttggctaactttagctgaacagccaatatgcaaagatgtactcgtaaggcatcttcctaagttgattcctgtgttagtgaatggcatgaagtactcagacatagatattatcctacttaagggtgatgttgaagaagacgaaacgattcctgatagtgaacaggatatacggccacgttttcaccgatcgaggacggtggctcagcagcatgatgaagatggaattgaagaggaagatgatgatgatgatgaaattgatgatgatgatacaatttctgactggaatctaagaaaatgttctgctgctgccctggatgttcttgcaaatgtgtatcgtgatgaactgctgccacatattttgccccttttgaaagaattactttttcatcatgaatgggttgttaaagaatcaggcattttggttttaggagcaattgctgaaggttgcatgcagggcatgattccatacttgcctgagcttattcctcaccttattcagtgcctctctgataaaaaggctcttgtgcgttccataacatgctggactcttagccgctatgcacactgggtggtcagccagccgccagacacgtacctgaagccattaatgacagaattgctaaagcgcatcctggacagcaacaagagagtacaagaagctgcctgcagtgcctttgctaccctagaagaggaggcttgtacagaacttgttccttaccttgcttatatacttgataccctggtctttgcatttagtaaataccagcataagaacctgctcattctttacgatgccataggaacattagcagattcagtaggacatcatttaaacaaaccagaatatattcagatgctaatgcctccactgatccagaaatggaacatgttaaaggatgaagataaagatctcttccctttacttgagtgcctatcttcagttgccacagcactgcagtctggattccttccgtactgtgaacctgtgtatcagcgttgtgtaaacctagtacagaagactcttgcacaagccatgctaaacaatgctcaaccagatcaatatgaagctccagataaagattttatgatagtggctcttgatttactgagtggcctggctgaaggacttggaggcaacattgaacagctggtagcccgaagtaacatcctgacactaatgtatcagtgcatgcaggataaaatgccagaagttcgacagagttcttttgccctgttaggtgacctcacaaaagcttgctttcagcatgttaagccttgtatagctgatttcatgccaatattgggaaccaacctaaatccagaattcatttcagtctgcaacaatgccacatgggcaattggagaaatctccattcaaatgggtatagagatgcagccttatattcctatggtgttgcaccagcttgtagaaatcattaacagacccaacacaccaaagacgttgttagagaatacagcaataacaattggtcgtcttggttacgtttgtcctcaagaggtggcccccatgctacagcagtttataagaccctggtgcacctctctgagaaacataagagacaatgaggaaaaggattcagcattccgtggaatttgtaccatgatcagtgtgaatcccagtggcgtaatccaagattttatatttttttgtgatgccgttgcatcatggattaacccaaaagatgatctcagagacatgttctgtaagatccttcatggatttaaaaatcaagttggcgatgaaaattggaggcgtttctctgaccagtttcctcttcccttaaaagagcgtcttgcagctttttatggtgtttaa

SEQ ID NO: 12498 - DNA, 109 bp, synthetic construct
  misc_feature 1..109: note = Synthetic polypeptide
  source 1..109: mol_type = other DNA
agtagtcagcaaactatgtcccatggagccaaatttagcccatgacctgcaaggtctcacgctgttgcatgtgtcaatcagtttatcatcagtaggactcaagctctaa

SEQ ID NO: 12499 - DNA, 1767 bp, synthetic construct
  misc_feature 1..1767: note = Synthetic polypeptide
  source 1..1767: mol_type = other DNA
ggtttggctgtgtccccacacaagtctcaacttgaattataactctcagaattcccatgtgttgtgggagggacccagtggggaggtaatttagtcatgagggccggtctttcccgtgctattctcatgatagtgaacaagtctcacgagatctgatgggtttatcaggggtttctgcttttgcatctttctctttttctcttgctactgccacataagaagtgcctttctcctcctgccatgattctgaggcctccccagccatgtggaacttctgttcggcacttgaagtactccttgtttaagaaatcactactgggcagtgtttcggataatggaatagtaactctctgggatgtaaatagtcagagtccataccataactttgacagtgtacacaaagctccagcgtcaggcatctgtttttctcctgtcaatgaattgctctttgtaaccataggcttggataaaagaatcatcctctatgacacttcaagtaagaagctagtgaaaactttagtggctgacactcctctaactgcggtagatttcatgcctgatggagccactttggctattggatcttcccgggggaaaatatatcaatatgatttaagaatgttgaaatcaccagttaagaccatcagtgctcacaagacatctgtgcagtgtatagcatttcagtactccactgttcttactaagtcaagtttaaataaaggctgttcaaataagcccacaacagtgaacaaacgaagtgttaatgtgaatgctgctagtggaggagttcagaattccggaattgtcagagaagcacctgccacgtccattgccacagttctaccacaacctatgacatcagctatggggaaaggaacagttgctgttcaagaaaaagcaggtttgcctcgaagcataaacacagacactttatctaaggaaacagacagtggaaaaaatcaggatttctccagctttgatgatactgggaaaagtagtttaggtgacatgttctcacctatcagagatgatgctgtagttaacaagggaagtgatgagtccataggcaaaggagatggctttgactttctaccgcagttgaactcagtgtttcctccaagaaaaaatccagtaacttcaagtacttcagtattgcattctagtcctcttaatgtttttatgggatctccagggaaagaggaaaatgaaaaccgtgatctaacagctgagtctaagaaaatatatatgggaaaacaggaatctaaagactccttcaaacagttagcaaagttggtcacatctggtgctgaaagtggaaatctaaatacctctccatcatctaaccaaacaagaaattctgagaaatttgaaaagccagagaatgaaattgaagcccagttgatatgtgaacccccaatcaatggatcctcaactccaaatccaaagatagcatcttctgtcactgctggagttgccagttcactctcagaaaaaatagccgacagcattggaaataaccggcaaaatgcaccattgacttccattcaaattcgttttattcagaacatgatacaggaaacgttggatgactttagagaagcatgccatagggacattgtgaatttgcaagtggagatgattaaacagtttcatatgcaactgaatgaaatgcattctttgctggaaagatactcagtgaatgaaggtttagtggctgaaattgaaagactacgagaagaaaacaaaagattacgggcccacttttga

SEQ ID NO: 12500 - DNA, 278 bp, synthetic construct
  misc_feature 1..278: note = Synthetic polypeptide
  source 1..278: mol_type = other DNA
ggtttggctgtgtccccacacaagtctcaacttgaattataactctcagaattcccatgtgttgtgggagggacccagtggggaggtaatttagtcatgagggccggtctttcccgtgctattctcatgatagtgaacaagtctcacgagatctgatgggtttatcaggggtttctgcttttgcatctttctctttttctcttgctactgccacataagaagtgcctttctcctcctgccatgattctgaggcctccccagccatgtggaacttctgt

SEQ ID NO: 12501 - DNA, 531 bp, synthetic construct
  misc_feature 1..531: note = Synthetic polypeptide
  source 1..531: mol_type = other DNA
ggtttggctgtgtccccacacaagtctcaacttgaattataactctcagaattcccatgtgttgtgggagggacccagtggggaggtaatttagtcatgagggccggtctttcccgtgctattctcatgatagtgaacaagtctcacgagatctgatgggtttatcaggggtttctgcttttgcatctttctctttttctcttgctactgccacataagaagtgcctttctcctcctgccatgattctgaggcctccccagccatgtggaacttctgttcggcacttgaagtactccttgtttaagaaatcactactgggcagtgtttcggataatggaatagtaactctctgggatgtaaatagtcagagtccataccataactttgacagtgtacacaaagctccagcgtcaggcatctgtttttctcctgtcaatgaattgctctttgtaaccataggcttggataaaagaatcatcctctatgacacttcaagtaagaagctagtgaaaactttagtggctgacact

SEQ ID NO: 12502 - DNA, 588 bp, synthetic construct; identical to SEQ ID NO: 7495
  misc_feature 1..588: note = Synthetic polypeptide
  source 1..588: mol_type = other DNA

SEQ ID NO: 12503 - DNA, 873 bp, synthetic construct; identical to SEQ ID NO: 6614
  misc_feature 1..873: note = Synthetic polypeptide
  source 1..873: mol_type = other DNA

SEQ ID NO: 12504 - DNA, 207 bp, synthetic construct; identical to SEQ ID NO: 6615
  misc_feature 1..207: note = Synthetic polypeptide
  source 1..207: mol_type = other DNA

SEQ ID NO: 12505 - DNA, 493 bp, synthetic construct; identical to SEQ ID NO: 9533
  misc_feature 1..493: note = Synthetic polypeptide
  source 1..493: mol_type = other DNA

SEQ ID NO: 12506 - DNA, 304 bp, synthetic construct; identical to SEQ ID NO: 9534
  misc_feature 1..304: note = Synthetic polypeptide
  source 1..304: mol_type = other DNA

SEQ ID NO: 12507 - DNA, 321 bp, synthetic construct; identical to SEQ ID NO: 10088
  misc_feature 1..321: note = Synthetic polypeptide
  source 1..321: mol_type = other DNA

SEQ ID NO: 12508 - DNA, 993 bp, synthetic construct; identical to SEQ ID NO: 10089
  misc_feature 1..993: note = Synthetic polypeptide
  source 1..993: mol_type = other DNA

SEQ ID NO: 12509 - DNA, 298 bp, synthetic construct; identical to SEQ ID NO: 10090
  misc_feature 1..298: note = Synthetic polypeptide
  source 1..298: mol_type = other DNA

SEQ ID NO: 12510 - DNA, 891 bp, synthetic construct; identical to SEQ ID NO: 8626
  misc_feature 1..891: note = Synthetic polypeptide
  source 1..891: mol_type = other DNA

SEQ ID NO: 12511 - DNA, 340 bp, synthetic construct
  misc_feature 1..340: note = Synthetic polypeptide
  source 1..340: mol_type = other DNA
ggccgagtagtggagaaagagtgcctgggagtcaggagtcctgggcgctgccgctgacttcctggcgtccctgagtgagtccatttccctcccaggtgtggcccaggcctacatgaaccagagaaagctggaccatgaggtgaagaccctacaggtccaggctgcccaatttgccaagcagacaggccagtggatcggaatggtggagaacttcaaccaggcactcaaggaaattggggatgtggagaactgggctcggagcatcgagctggacatgcgcaccattgccactgcactggaatatgtctacaaagggcagctgcagtctgccccttcctag

SEQ ID NO: 12512 - DNA, 116 bp, synthetic construct
  misc_feature 1..116: note = Synthetic polypeptide
  source 1..116: mol_type = other DNA
ggccgagtagtggagaaagagtgcctgggagtcaggagtcctgggcgctgccgctgacttcctggcgtccctgagtgagtccatttccctcccaggtgtggcccaggcctacatga

SEQ ID NO: 12513 - DNA, 247 bp, synthetic construct
  misc_feature 1..247: note = Synthetic polypeptide
  source 1..247: mol_type = other DNA
ggccgagtagtggagaaagagtgcctgggagtcaggagtcctgggcgctgccgctgacttcctggcgtccctgagtgagtccatttccctcccaggtgtggcccaggcctacatgaaccagagaaagctggaccatgaggtgaagaccctacaggtccaggctgcccaatttgccaagcagacaggccagtggatcggaatggtggagaacttcaaccaggcactcaagggctttttggtctggtga

SEQ ID NO: 12514 - DNA, 307 bp, synthetic construct
  misc_feature 1..307: note = Synthetic polypeptide
  source 1..307: mol_type = other DNA
ggccgagtagtggagaaagagtgcctgggagtcaggagtcctgggcgctgccgctgacttcctggcgtccctgagtgagtccatttccctcccaggtgtggcccaggcctacatgaaccagagaaagctggaccatgaggtgaagaccctacaggtccaggctgcccaatttgccaagcagacaggccagtggatcggaatggtggagaacttcaaccaggcactcaaggtgggccatactccctacctcaccaccccaatcctgggcccccattggctgcctccagtcaggttacctcaggtttag

SEQ ID NO: 12515 - DNA, 483 bp, synthetic construct; identical to SEQ ID NO: 7330
  misc_feature 1..483: note = Synthetic polypeptide
  source 1..483: mol_type = other DNA

SEQ ID NO: 12516 - DNA, 36 bp, synthetic construct
  misc_feature 1..36: note = Synthetic polypeptide
  source 1..36: mol_type = other DNA
ttaacatccttgtttattgagagaacattcaattga

SEQ ID NO: 12517 - DNA, 217 bp, synthetic construct
  misc_feature 1..217: note = Synthetic polypeptide
  source 1..217: mol_type = other DNA
ttaacatccttgtttattgagagaacattcaattgatggcactggctgggctcccacaagaacattaaaggatgtcgtttggggattaaactctttgtttactgatcttttgaattttgatgatccactgaatattgaagctgcagaacatcatttgcgggacaaggaggacttccggaataaagtggatgactacatcaaacgttatgccagatga

SEQ ID NO: 12518 - DNA, 52 bp, synthetic construct
  misc_feature 1..52: note = Synthetic polypeptide
  source 1..52: mol_type = other DNA
ttaacatccttgtttattgagagaacattcaattgatggcactggctgggct

SEQ ID NO: 12519 - DNA, 172 bp, synthetic construct
  misc_feature 1..172: note = Synthetic polypeptide
  source 1..172: mol_type = other DNA
ttaacatccttgtttattgagagaacattcaattgatggcactggctgggctcccacaagaacattaaaggatgtcgtttggggattaaactctttgtttactgatcttttgaattttgatgatccactgaatattgaagctgcagaacatcatttgcgggacaaggaggac

SEQ ID NO: 12520 - DNA, 154 bp, synthetic construct
  misc_feature 1..154: note = Synthetic polypeptide
  source 1..154: mol_type = other DNA
ttaacatccttgtttattgagagaacattcaattgatggcactggctgggctcccacaagaacattaaaggatgtcgtttggggattaaactctttgtttactgaggacttccggaataaagtggatgactacatcaaacgttatgccagatga

SEQ ID NO: 12521 - DNA, 20 bp, synthetic construct
  misc_feature 1..20: note = Synthetic polypeptide
  source 1..20: mol_type = other DNA
ttaacatccttgtttattga

SEQ ID NO: 12522 - DNA, 174 bp, synthetic construct
  misc_feature 1..174: note = Synthetic polypeptide
  source 1..174: mol_type = other DNA
ttaacatccttgtttattgagagaacattcaattgatggcactggctgggctcccacaagaacattaaaggatgtcgtttggggattaaactctttgtttactgatcttttgaattttgatgatccactgaatattgaagctgcagaacatcatttgcgggacaaggaggactt

SEQ ID NO: 12523 - DNA, 148 bp, synthetic construct
  misc_feature 1..148: note = Synthetic polypeptide
  source 1..148: mol_type = other DNA
ttaacatccttgtttattgagagaacattcaattgatggcactggctgggctcccacaagaacattaaaggatgtcgtttggggattaaactctttgtttactgatcttttgaattttgatgatccactgaatattgaagctgcagaa

SEQ ID NO: 12524 - DNA, 325 bp, synthetic construct
  misc_feature 1..325: note = Synthetic polypeptide
  source 1..325: mol_type = other DNA
ccaatggactaggcggtcctggagggcagagacctgtcttggtatcttcatattcccagcactctgcacaaggaatagagcctagaaggtggggaatagcagcatagcctggtctcttggctacatgctcagcctgaccaaccagatcccagctgaaagccctctgatccgtctgcccatagaaccacctgtctttgtgggcaccctcgctttcttcacagcggcagccttgctgtgtctggcatttcttgcatacctgtgttcagcaaccagaagaaagaggcactccgagcatgcctttgaccatgcagtggattctgactga

SEQ ID NO: 12525 - DNA, 2636 bp, synthetic construct; identical to SEQ ID NO: 8432
  misc_feature 1..2636: note = Synthetic polypeptide
  source 1..2636: mol_type = other DNA

SEQ ID NO: 12526 - DNA, 3776 bp, synthetic construct; identical to SEQ ID NO: 8433
  misc_feature 1..3776: note = Synthetic polypeptide
  source 1..3776: mol_type = other DNA

SEQ ID NO: 12527 - DNA, 659 bp, synthetic construct; identical to SEQ ID NO: 7473
  misc_feature 1..659: note = Synthetic polypeptide
  source 1..659: mol_type = other DNA

SEQ ID NO: 12528 - DNA, 1688 bp, synthetic construct; identical to SEQ ID NO: 7474
  misc_feature 1..1688: note = Synthetic polypeptide
  source 1..1688: mol_type = other DNA

SEQ ID NO: 12529 - DNA, 365 bp, synthetic construct; identical to SEQ ID NO: 7364
  misc_feature 1..365: note = Synthetic polypeptide
  source 1..365: mol_type = other DNA

SEQ ID NO: 12530 - DNA, 493 bp, synthetic construct
  misc_feature 1..493: note = Synthetic polypeptide
  source 1..493: mol_type = other DNA
ggccggacgcagtggctcacgcctgtaatcccagcacttcaggaggctgaggcgggtggatcacaaggtgtccctggtggtgaatgtggccagcgagtgcggcttcacagaccagcactaccgagccctgcagcagctgcagcgagacctgggcccccaccactttaacgtgctcgccttcccctgcaaccagtttggccaacaggagcctgacagcaacaaggagattgagagctttgcccgccgcacctacagtgtctcattccccatgtttagcaagattgcagtcaccggtactggtgcccatcctgccttcaagtacctggcccagacttctgggaaggagcccacctggaacttctggaagtacctagtagccccagatggaaaggtggtaggggcttgggacccaactgtgtcagtggaggaggtcagaccccagatcacagcgctcgtgaggaagctcatcctactgaagcgagaagacttataa

SEQ ID NO: 12531 - DNA, 619 bp, synthetic construct
  misc_feature 1..619: note = Synthetic polypeptide
  source 1..619: mol_type = other DNA
gtatccacctaggaaaatattttgaaggtctaacccccagtacttctaaatgtgaccttatttttaaaatagtgttattgcttatgtaattcttaggatgaagccatcctagagcgaggtggcctcttgatccaatgtgcctggtgtccttataagatgatggtagtaaggagattggaagacacagagagaatgccgtgtgacgacgaaggcagagattgaatttacacagctgcaagataaggagcactaaagattgctggcaaaccaccagcagccagaaagagggaaggaaggatctcccctcagggtctctctcccagcctgtgctgactcaatcatcctctgcctctgcttccctgggatcctcggtcaagctcacctgcactctgagcagtgggcacagtagctacatcatcgcatggcatcagcagcagccagggaaggcccctcggtacttgatgaagcttgaaggtagtggaagctacaacaaggggagcggagttcctgatcgcttctcaggctccagctctggggctgaccgctacctcaccatctccaacctccagtttgaggatgaggctgattattactgtgagacctgggacagtaacactca

SEQ ID NO: 12532 - DNA, 1052 bp, synthetic construct
  misc_feature 1..1052: note = Synthetic polypeptide
  source 1..1052: mol_type = other DNA
cttgaattgtagctgccataattcccacctgttgtgggaggtatctggcggaggtaatgaatcatgggggcgagtctttcctgtgctgttcttgtgagagtaagtctcacgagagctggtcgttttataaacgggagttcctctgcaagtgttctcttgcctaccgccatgtgagacaagcctttgcttcttctttgccttccaccatgattgtgaggcctccccagctatgtggaactgacaagaaatggattctcagtcatgaagatgtcatattgggagaattactgggcaagggaaattttggtgaagtatataagggcacattaaaggataaaacttctgttgctgttaaaacatgtaaagaagatcttcctcaggaattgaaaataaaatttttacaagaagccaaaattctcaagcaatatgatcatcccaatattgtcaaacttataggagtttgcacacaaagacagcctgtctacatcattatggaactggtttcaggaggtgatttcctcacctttctgagaaggaagaaggatgaactaaaactcaaacagttagtgaaattttcattagacgctgctgctggtatgttgtatctcgagagtaaaaactgtatacacagggaccttgctgcaagaaactgcctggtaggtgaaaataatgttctgaaaatcagtgactttggaatgtctcgtcaagaggatggtggagtgtattcatcttctggcttaaagcagattcccattaaatggacagcaccggaagctcttaattatgggagatacagttcagagagtgacgtgtggagctttggcatccttctctgggagaccttcagcttaggggtttgtccgtaccctggaatgacaaatcagcaagcaagagagcaagtagaaagaggataccggatgtcagctccccagcactgtccagaggatatttccaaaatcatgatgaagtgttgggattataaacctgaaaatcgccctaagttcagtgaacttcagaaagagctcactatcatcaagagaaaactcacatag

SEQ ID NO: 12533 - DNA, 445 bp, synthetic construct; identical to SEQ ID NO: 744
  misc_feature 1..445: note = Synthetic polypeptide
  source 1..445: mol_type = other DNA

SEQ ID NO: 12534 - DNA, 59 bp, synthetic construct; identical to SEQ ID NO: 742
  misc_feature 1..59: note = Synthetic polypeptide
  source 1..59: mol_type = other DNA

SEQ ID NO: 12535 - DNA, 123 bp, synthetic construct; identical to SEQ ID NO: 743
  misc_feature 1..123: note = Synthetic polypeptide
  source 1..123: mol_type = other DNA

SEQ ID NO: 12536 - DNA, 1284 bp, synthetic construct; identical to SEQ ID NO: 648
  misc_feature 1..1284: note = Synthetic polypeptide
  source 1..1284: mol_type = other DNA

SEQ ID NO: 12537 - DNA, 1077 bp, synthetic construct; identical to SEQ ID NO: 649
  misc_feature 1..1077: note = Synthetic polypeptide
  source 1..1077: mol_type = other DNA

SEQ ID NO: 12538 - DNA, 972 bp, synthetic construct; identical to SEQ ID NO: 650
  misc_feature 1..972: note = Synthetic polypeptide
  source 1..972: mol_type = other DNA

SEQ ID NO: 12539 - DNA, 3420 bp, synthetic construct
  misc_feature 1..3420: note = Synthetic polypeptide
  source 1..3420: mol_type = other DNA
gaggatctgcaccgagtccctttcttctagtcattagctgggactttggcacgttgccgaaattctcagaagatcttagacgaattttacaatgtgaagttctgcatagatgccagtcaaccagatgttggaagctggctcaagtacattagattcgctggctgttatgatcagcacaaccttgttgcatgccagataaatgatcagatattctatagagtagttgcagacattgcgccgggagaggagcttctgctgttcatgaagagcgaagactatccccatgaaactatggcgccggatatccacgaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatctccaagagatacacacgatccaggagtgtaaggaatgtgaccaagtttttcctgatttgcaaagcctggagaaacacatgctgtcacatactgaagagagggaatacaagtgtgatcagtgtcccaaggcatttaactggaagtccaatttaattcgccaccagatgtcacatgacagtggaaagcactatgaatgtgaaaactgtgccaagcaggttttcacggaccctagcaaccttcagcggcacattcgctctcagcatgtcggtgcccgggcccatgcatgcccggagtgtggcaaaacgtttgccacttcgtcgggcctcaaacaacacaagcacatccacagcagtgtgaagccctttatctgtgaggtctgccataaatcctatactcagttttcaaacctttgccgtcataagcgcatgcatgctgattgcagaacccaaatcaagtgcaaagactgtggacaaatgttcagcactacgtcttccttaaataaacacaggaggttttgtgagggcaagaaccattttgcggcaggtggattttttggccaaggcatttcacttcctggaaccccagctatggataaaacgtccatggttaatatgagtcatgccaacccgggccttgctgactattttggcgccaataggcatcctgctggtcttacctttccaacagctcctggattttcttttagcttccctggtctgtttccttccggcttgtaccacaggcctcctttgatacctgctagttctcctgttaaaggactatcaagtactgaacagacaaacaaaagtcaaagtcccctcatgacacatcctcagatactgccagctacacaggatattttgaaggcactatctaaacacccatctgtaggggacaataagccagtggagctccagcccgagaggtcctctgaagagaggccctttgagaaaatcagtgaccagtcagagagtagtgaccttgatgatgtcagtacaccaagtggcagtgacctggaaacaacctcgggctctgatctggaaagtgacattgaaagtgataaagagaaatttaaagaaaatggtaaaatgttcaaagacaaagtaagccctcttcagaatctggcttcaataaataataagaaagaatacagcaatcattccattttctcaccatctttagaggagcagactgcggtgtcaggagctgtgaatgattctataaaggctattgcttctattgctgaaaaatactttggttcaacaggactggtggggctgcaagacaaaaaagttggagctttaccttacccttccatgtttcccctcccattttttccagcattctctcaatcaatgtacccatttcctgatagagacttgagatcgttacctttgaaaatggaaccccaatcaccaggtgaagtaaagaaactgcagaagggcagctctgagtccccctttgatctcaccactaagcgaaaggatgagaagcccttgactccagtcccctccaagcctccagtgacacctgccacaagccaagaccagcccctggatctaagtatgggcagtaggagtagagccagtgggacaaagctgactgagcctcgaaaaaaccacgtgtttgggggaaaaaaaggaagcaacgtcgaatcaagacctgcttcagatggttccttgcagcatgcaagacccactcctttctttatggaccctatttacagagtagagaaaagaaaactaactgacccacttgaagctttaaaagagaaatacttgaggccttctccaggattcttgtttcacccacaattccaactgcctgatcagagaacttggatgtcagctattgaaaacatggcagaaaagctagagagcttcagtgccctgaaacctgaggccagtgagctcttacagtcagtgccctctatgttcaacttcagggcgcctcccaatgccctgccagagaaccttctgcggaagggaaaggagcgctatacctgcagatactgtggcaagatttttccaaggtctgcaaacctaacacggcacttgagaacccacacaggagagcagccttacagatgcaaatactgtgacagatcatttagcatatcttctaacttgcaaaggcatgttcgcaacatccacaataaagagaagccatttaagtgtcacttatgtgataggtgttttggtcaacaaaccaatttagacagacacctaaagaaacatgagaatgggaacatgtccggtacagcaacatcgtcgcctcattctgaactggaaagtacaggtgcgattctggatgacaaagaagatgcttacttcacagaaattcgaaatttcattgggaacagcaaccatggcagccaatctcccaggaatgtggaggagagaatgaatggcagtcattttaaagatgaaaaggctttggtgaccagtcaaaattcagacttgctggatgatgaagaagttgaagatgaggtgttgttagatgaggaggatgaagacaatgatattactggaaaaacaggaaaggaaccagtgacaagtaatttacatgaaggaaaccctgaggatgactatgaagaaaccagtgccctggagatgagttgcaagacatccccagtgaggtataaagaggaagaatataaaagtggactttctgctctagatcatataaggcacttcacagatagcctcaaaatgaggaaaatggaagataatcaatattctgaagctgagctgtcttcttttagtacttcccatgtgccagaggaacttaagcagccgttacacagaaagtccaaatcgcaggcatatgctatgatgctgtcactgtctgacaaggagtccctccattctacatcccacagttcttccaacgtgtggcacagtatggccagggctgcggcggaatccagtgctatccagtccataagccacgtatga

SEQ ID NO: 12540 - DNA, 3390 bp, synthetic construct
  misc_feature 1..3390: note = Synthetic polypeptide
  source 1..3390: mol_type = other DNA
gaggatctgcaccgagtccctttcttctagtcattagctgggactttggcacgttgccgaaattctcagaagatcttagacgaattttacaatgtgaagttctgcatagatgccagtcaaccagatgttggaagctggctcaagtacattagattcgctggctgttatgatcagcacaaccttgttgcatgccagataaatgatcagatattctatagagtagttgcagacattgcgccgggagaggagcttctgctgttcatgaagagcgaagactatccccatgaaactatggcgccggatatccacgaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatctccaagagatacacacgatccaggagtgtaaggaatgtgaccaagtttttcctgatttgcaaagcctggagaaacacatgctgtcacatactgaagagagggaatacaagtgtgatcagtgtcccaaggcatttaactggaagtccaatttaattcgccaccagatgtcacatgacagtggaaagcactatgaatgtgaaaactgtgccaaggttttcacggaccctagcaaccttcagcggcacattcgctctcagcatgtcggtgcccgggcccatgcatgcccggagtgtggcaaaacgtttgccacttcgtcgggcctcaaacaacacaagcacatccacagcagtgtgaagccctttatctgtgaggtctgccataaatcctatactcagttttcaaacctttgccgtcataagcgcatgcatgctgattgcagaacccaaatcaagtgcaaagactgtggacaaatgttcagcactacgtcttccttaaataaacacaggaggttttgtgagggcaagaaccattttgcggcaggtggattttttggccaaggcatttcacttcctggaaccccagctatggataaaacgtccatggttaatatgagtcatgccaacccgggccttgctgactattttggcgccaataggcatcctgctggtcttacctttccaacagctcctggattttcttttagcttccctggtctgtttccttccggcttgtaccacaggcctcctttgatacctgctagttctcctgttaaaggactatcaagtactgaacagacaaacaaaagtcaaagtcccctcatgacacatcctcagatactgccagctacacaggatattttgaaggcactatctaaacacccatctgtaggggacaataagccagtggagctccagcccgagaggtcctctgaagagaggccctttgagaaaatcagtgaccagtcagagagtagtgaccttgatgatgtcagtacaccaagtggcagtgacctggaaacaacctcgggctctgatctggaaagtgacattgaaagtgataaagagaaatttaaagaaaatggtaaaatgttcaaagacaaagtaagccctcttcagaatctggcttcaataaataataagaaagaatacagcaatcattccattttctcaccatctttagaggagcagactgcggtgtcaggagctgtgaatgattctataaaggctattgcttctattgctgaaaaatactttggttcaacaggactggtggggctgcaagacaaaaaagttggagctttaccttacccttccatgtttcccctcccattttttccagcattctctcaatcaatgtacccatttcctgatagagacttgagatcgttacctttgaaaatggaaccccaatcaccaggtgaagtaaagaaactgcagaagggcagctctgagtccccctttgatctcaccactaagcgaaaggatgagaagcccttgactccagtcccctccaagcctccagtgacacctgccacaagccaagaccagcccctggatctaagtatgggcagtaggagtagagccagtgggacaaagctgactgagcctcgaaaaaaccacgtgtttgggggaaaaaaaggaagcaacgtcgaatcaagacctgcttcagatggttccttgcagcatgcaagacccactcctttctttatggaccctatttacagagtagagaaaagaaaactaactgacccacttgaagctttaaaagagaaatacttgaggccttctccaggattcttgtttcacccacaaatgtcagctattgaaaacatggcagaaaagctagagagcttcagtgccctgaaacctgaggccagtgagctcttacagtcagtgccctctatgttcaacttcagggcgcctcccaatgccctgccagagaaccttctgcggaagggaaaggagcgctatacctgcagatactgtggcaagatttttccaaggtctgcaaacctaacacggcacttgagaacccacacaggagagcagccttacagatgcaaatactgtgacagatcatttagcatatcttctaacttgcaaaggcatgttcgcaacatccacaataaagagaagccatttaagtgtcacttatgtgataggtgttttggtcaacaaaccaatttagacagacacctaaagaaacatgagaatgggaacatgtccggtacagcaacatcgtcgcctcattctgaactggaaagtacaggtgcgattctggatgacaaagaagatgcttacttcacagaaattcgaaatttcattgggaacagcaaccatggcagccaatctcccaggaatgtggaggagagaatgaatggcagtcattttaaagatgaaaaggctttggtgaccagtcaaaattcagacttgctggatgatgaagaagttgaagatgaggtgttgttagatgaggaggatgaagacaatgatattactggaaaaacaggaaaggaaccagtgacaagtaatttacatgaaggaaaccctgaggatgactatgaagaaaccagtgccctggagatgagttgcaagacatccccagtgaggtataaagaggaagaatataaaagtggactttctgctctagatcatataaggcacttcacagatagcctcaaaatgaggaaaatggaagataatcaatattctgaagctgagctgtcttcttttagtacttcccatgtgccagaggaacttaagcagccgttacacagaaagtccaaatcgcaggcatatgctatgatgctgtcactgtctgacaaggagtccctccattctacatcccacagttcttccaacgtgtggcacagtatggccagggctgcggcggaatccagtgctatccagtccataagccacgtatga

SEQ ID NO: 12541 - DNA, 464 bp, synthetic construct
  misc_feature 1..464: note = Synthetic polypeptide
  source 1..464: mol_type = other DNA
gctgggcgcagtggctcacacctgtaatcccagcactttggaaggccaagattgcccctgcggaaggcccagacgtcagcgaaaggatggtcatcatcaccgggccaccggaagcccagttcaaggcccagggacggatctttgggaaactgaaagaggaaaacttctttaaccccaaagaagaagtgaagctggaagcgcatatcagagtgccctcttccacagctggccgggtgattggcaaaggtggcaagaccgtgaacgaactgcagaacttaaccagtgcagaagtcatcgtgcctcgtgaccaaacgccagatgaaaatgaggaagtgatcgtcagaattatcgggcacttctttgctagccagactgcacagcgcaagatcagggaaattgtacaacaggtgaagcagcaggagcagaaataccctcagggagtcgcctcacagcgcagcaagtga

SEQ ID NO: 12542 - DNA, 1218 bp, synthetic construct; identical to SEQ ID NO: 654
  misc_feature 1..1218: note = Synthetic polypeptide
  source 1..1218: mol_type = other DNA

SEQ ID NO: 12543 - DNA, 382 bp, synthetic construct
  misc_feature 1..382: note = Synthetic polypeptide
  source 1..382: mol_type = other DNA
accatggctaaatcactcccttccctggacctcagtttttccagctgtaaaatggctgtatgtgcaggcacgactctgttggaagtgggcacggctgctgcgacccacagtccagttcttcctggtggcctttgccctctacgtgggctacacccgcgtgtctgattacaaacaccactggagcgatgtccttgttggcctcctgcagggggcactggtggctgccctcactgtctgctacatctcagacttcttcaaagcccgacccccacagcactgtctgaaggaggaggagctggaacggaagcccagcctgtcactgacgttgaccctgggcgaggctgaccacaaccactatggatacccgcactcctcctcctga

SEQ ID NO: 12544 - DNA, 244 bp, synthetic construct
  misc_feature 1..244: note = Synthetic polypeptide
  source 1..244: mol_type = other DNA
accatggctaaatcactcccttccctggacctcagtttttccagctgtaaaatggctgtatgtgcaggcacgactctgttggaagtgggcacggctgctgcgacccacagtccagttcttcctggtggcctttgccctctacgtgggctacacccgcgtgtctgattacaaacaccactggagcgatgtccttgttggcctcctgcagggggcactggtggctgccctcactgtgagcttctaa

SEQ ID NO: 12545 - DNA, 637 bp, synthetic construct
  misc_feature 1..637: note = Synthetic polypeptide
  source 1..637: mol_type = other DNA
aggcagtatgacggcagtggaaagaaccctggactaacgatttcgagatttactactgcctccatctagtcaagactccgaaattctgcccttcattcaatctagaaattatcccaagctgtatattgatggtccttttggaagtccatttgaggaatcactgaactatgaggtcagcctctgcgtggctggaggcattggagtaactccatttgcatcaatactcaacaccctgttggatgactggaaaccatacaagcttagaagactatactttatttgggtatgcagagatatccagtccttccgttggtttgcagatttactctgtatgttgcataacaagttttggcaagagaacagacctgactatgtcaacatccagctgtacctcagtcaaacagatgggatacagaagataattggagaaaaatatcatgcactgaattcaagactgtttataggacgtcctcggtggaaacttttgtttgatgaaatagcaaaatataacagaggaaaaacagttggtgttttctgttgtggacccaattcactatccaagactcttcataaactgagtaaccagaacaactcatatgggacaagatttgaatacaataaagagtctttcagctga

SEQ ID NO: 12546 - DNA, 517 bp, synthetic construct
  misc_feature 1..517: note = Synthetic polypeptide
  source 1..517: mol_type = other DNA
aggcagtatgacggcagtggaaagaaccctggactaacgatttcgagatttactactgcctccatctagtcaagactccgaaattctgcccttcattcaatctagaaattatcccaaggatgactggaaaccatacaagcttagaagactatactttatttgggtatgcagagatatccagtccttccgttggtttgcagatttactctgtatgttgcataacaagttttggcaagagaacagacctgactatgtcaacatccagctgtacctcagtcaaacagatgggatacagaagataattggagaaaaatatcatgcactgaattcaagactgtttataggacgtcctcggtggaaacttttgtttgatgaaatagcaaaatataacagaggaaaaacagttggtgttttctgttgtggacccaattcactatccaagactcttcataaactgagtaaccagaacaactcatatgggacaagatttgaatacaataaagagtctttcagctga

SEQ ID NO: 12547 - DNA, 574 bp, synthetic construct
  misc_feature 1..574: note = Synthetic polypeptide
  source 1..574: mol_type = other DNA
aggcagtatgacggcagtggaaagaaccctggactaacgatttcgagatttactactgcctccatctagtcaagactccgaaattctgcccttcattcaatctagaaattatcccaagctgtatattgatggtccttttggaagtccatttgaggaatcactgaactatgaggtcagcctctgcgtggctggaggcattggagtaactccatttgcatcaatactcaacaccctgttggatgactggaaaccatacaagcttagaagactatactttatttggttttggcaagagaacagacctgactatgtcaacatccagctgtacctcagtcaaacagatgggatacagaagataattggagaaaaatatcatgcactgaattcaagactgtttataggacgtcctcggtggaaacttttgtttgatgaaatagcaaaatataacagaggaaaaacagttggtgttttctgttgtggacccaattcactatccaagactcttcataaactgagtaaccagaacaactcatatgggacaagatttgaatacaataaagagtctttcagctga

SEQ ID NO: 12548 - DNA, 981 bp, synthetic construct
  misc_feature 1..981: note = Synthetic polypeptide
  source 1..981: mol_type = other DNA
tgcagtcgggaaggggaggacgggaagtctagccggcttggacccgccccactctgttacctgccagatgacgctgaggaaactgcttttcttctcgaggcctccgttgcctcgtctgtgcccgggcggtgacttcccaagaaggacaacccgaggcgaggcttgtggctggccaactgccagcggctggaccccagcggccagggcctgtgggacccggcatccgagtacatctacttctgctccaaacactttgaggaggactgctttgagctggtgggaatcagtggatatcacaggctaaaggagggggcagtccccaccatatttgagtctttctccaagttgcgccggacaaccaagaccaaaggacacagttacccacctggccccgctgaagtcagccggctcagacgatgcaggaagcgctgctccgagggccgagggcccacaactccattttctccacctccacctgctgatgtcacctgctttcctgtggaagaggcctcagcacctgccactttgccggcctccccagctgggaggctggagcctggccttagcagccccttttcagacctactgggccccttgggtgcccaggcagatgaagcaggctgcagcgcccagccttcaccagagcggcagccctcccctctcgaaccacggccagtctccccctcagcgtatatgctgcgcctgcccccacccgccggagcctacatccagaatgaacacagctaccaggtgggcagcgccttactctggaagcggcgagccgaggcagcccttgatgcccttgacaaggcccagcgccagctgcaggcctgcaagcggcgggagcagcggctgcggttgagactgaccaagctgcagcaggagcgggcacgggagaagcgggcacaggcagatgcccgccagactctgaaggagcatgtgcaggactttgccatgcagctgagcagcagcatggcctga

SEQ ID NO: 12549 - DNA, 1110 bp, synthetic construct; identical to SEQ ID NO: 8310
  misc_feature 1..1110: note = Synthetic polypeptide
  source 1..1110: mol_type = other DNA

SEQ ID NO: 12550 - DNA, 564 bp, synthetic construct
  misc_feature 1..564: note = Synthetic polypeptide
  source 1..564: mol_type = other DNA
aagcaagacagcaagagacagcaagagatggcattttgtgagaagatggacatagcgatcagcaatgggcaagacagctattggagaagtggcaagacagtgatcagtgagagagggtgtgatggggatcagcactacagcgagcaaagctacagagttgctaacattgcagagctgttaacactagccaaaggctgttttaagagccatcatctttcctgacaggcggtggagctgagcagaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 12551 - DNA, 1681 bp, synthetic construct; identical to SEQ ID NO: 714
  misc_feature 1..1681: note = Synthetic polypeptide
  source 1..1681: mol_type = other DNA

SEQ ID NO: 12552 - DNA, 1543 bp, synthetic construct; identical to SEQ ID NO: 717
  misc_feature 1..1543: note = Synthetic polypeptide
  source 1..1543: mol_type = other DNA

SEQ ID NO: 12553 - DNA, 258 bp, synthetic construct; identical to SEQ ID NO: 719
  misc_feature 1..258: note = Synthetic polypeptide
  source 1..258: mol_type = other DNA

SEQ ID NO: 12554 - DNA, 1058 bp, synthetic construct; identical to SEQ ID NO: 7375
  misc_feature 1..1058: note = Synthetic polypeptide
  source 1..1058: mol_type = other DNA

SEQ ID NO: 12555 - DNA, 1008 bp, synthetic construct
  misc_feature 1..1008: note = Synthetic polypeptide
  source 1..1008: mol_type = other DNA
tttggtgccatgactcggatcgggggacctcccttgggagatcaatcccctgttctcctgctctttgctccgtgagaaagatccacctatgacctcaggtcctcagaccgaccagcccaagaaatatctcaccaatttcaaatctggtgcgttgtagaagacaagaactcaaaggtggcctggttgaaccgttctggcatcatttttgctggacatgacaagtggtctctggacccacgggttgagctggagaaacgccattctctggaatacagcctccgaatccagaaggtggatgtctatgatgagggttcctacacttgctcagttcagacacagcatgagcccaagacctcccaagtttacttgatcgtacaagtcccaccaaagatctccaatatctcctcggatgtcactgtgaatgagggcagcaacgtgactctggtctgcatggccaatggccgtcctgaacctgttatcacctggagacaccttacaccaactggaagggaatttgaaggagaagaagaatatctggagatccttggcatcaccagggagcagtcaggcaaatatgagtgcaaagctgccaacgaggtctcctcggcggatgtcaaacaagtcaaggtcactgtgaactatcctcccactatcacagaatccaagagcaatgaagccaccacaggacgacaagcttcactcaaatgtgaggcctcggcagtgcctgcacctgactttgagtggtaccgggatgacactaggataaatagtgccaatggccttgagattaagagcacggagggccagtcttccctgacggtgaccaacgtcactgaggagcactacggcaactacacctgtgtggctgccaacaagctgggggtcaccaatgccagcctagtccttttcagacctgggtcggtgagaggaataaatggatccatcagtctggccgtaccactgtggctgctggcagcatctctgctctgccttctcagcaaatgttaa

SEQ ID NO: 12556 - DNA, 1077 bp, synthetic construct
  misc_feature 1..1077: note = Synthetic polypeptide
  source 1..1077: mol_type = other DNA
tttggtgccatgactcggatcgggggacctcccttgggagatcaatcccctgttctcctgctctttgctccgtgagaaagatccacctatgacctcaggtcctcagaccgaccagcccaagaaatatctcaccaatttcaaatctggtgcgttgtagaagacaagaactcaaaggtggcctggttgaaccgttctggcatcatttttgctggacatgacaagtggtctctggacccacgggttgagctggagaaacgccattctctggaatacagcctccgaatccagaaggtggatgtctatgatgagggttcctacacttgctcagttcagacacagcatgagcccaagacctcccaagtttacttgatcgtacaagtcccaccaaagatctccaatatctcctcggatgtcactgtgaatgagggcagcaacgtgactctggtctgcatggccaatggccgtcctgaacctgttatcacctggagacaccttacaccaactggaagggaatttgaaggagaagaagaatatctggagatccttggcatcaccagggagcagtcaggcaaatatgagtgcaaagctgccaacgaggtctcctcggcggatgtcaaacaagtcaaggtcactgtgaactatcctcccactatcacagaatccaagagcaatgaagccaccacaggacgacaagcttcactcaaatgtgaggcctcggcagtgcctgcacctgactttgagtggtaccgggatgacactaggataaatagtgccaatggccttgagattaagagcacggagggccagtcttccctgacggtgaccaacgtcactgaggagcactacggcaactacacctgtgtggctgccaacaagctgggggtcaccaatgccagcctagtccttttcaaacgtgttttacccacaatcccccaccccattcaagaaattggtaccaccgtgcacttcaagcaaaaaggacctgggtcggtgagaggaataaatggatccatcagtctggccgtaccactgtggctgctggcagcatctctgctctgccttctcagcaaatgttaa

SEQ ID NO: 12557 - DNA, 505 bp, synthetic construct
  misc_feature 1..505: note = Synthetic polypeptide
  source 1..505: mol_type = other DNA
tttggtgccatgactcggatcgggggacctcccttgggagatcaatcccctgttctcctgctctttgctccgtgagaaagatccacctatgacctcaggtcctcagaccgaccagcccaagaaatatctcaccaatttcaaatctggtgcgttgtagaagacaagaactcaaaggtggcctggttgaaccgttctggcatcatttttgctggacatgacaagtggtctctggacccacgggttgagctggagaaacgccattctctggaatacagcctccgaatccagaaggtggatgtctatgatgagggttcctacacttgctcagttcagacacagcatgagcccaagacctcccaagtttacttgatcgtacaagtcccaccaaagatctccaatatctcctcggatgtcactgtgaatgagggcagcaacgtgactctggtctgcatggccaatggccgtcctgaacctgttatcacctggagacaccttacaccaactg

SEQ ID NO: 12558 - DNA, 304 bp, synthetic construct; identical to SEQ ID NO: 7490
  misc_feature 1..304: note = Synthetic polypeptide
  source 1..304: mol_type = other DNA

SEQ ID NO: 12559 - DNA, 1200 bp, synthetic construct
  misc_feature 1..1200: note = Synthetic polypeptide
  source 1..1200: mol_type = other DNA
cagcttagaagtcagatttgagccaaaattgttgtactgctgctgctgctgcttttctctgtggctttggacacctcagacacagagattgactggaaggcctacatggccgaggtagaaggcgtcatcaatggtacctatgactatacccaactgcagggtgacaccggaccacttgtgtacccagctggtttcgtgtacatctttatggggttgtactatgccaccagccgaggcactgacatccgcatggcccagaacatctttgctgtgctctacctggctaccttgctgcttgtcttcttgatctatcaccagacctgcaaggtacctcccttcgtctttttcttcatgtgctgcgcctcttaccgtgtccactccatctttgtgctgcggctcttcaatgacccagtggccatggtgctgctcttcctcagtatcaacctcctgctggcccagcgctggggctggggttgctgctttttcagcctggcagtctctgtgaagatgaatgtgctgctcttcgcccctgggttactgtttcttctcctcacacagtttggcttccgtggggccctccccaagctgggaatctgtgctggccttcaggtggtgctggggctgcccttcctgctggagaaccccagcggctacctgtcccgctcctttgaccttggccgccagtttctgttccactggacagtgaactggcgcttcctcccagaggcgctcttcctgcatcgagccttccacctggccctgttgactgcccacctcaccctgctcctgctgtttgccctctgcaggtggcacaggacaggggaaagtatcttgtcgctgctgagggatccctccaaaaggaaggttccaccccagccccttacacccaaccagatcgtttctaccctcttcacctccaacttcattggcatctgcttcagccgctccctccactaccagttctacgtctggtatttccacacactgccctacctcctgtgggccatgcctgcacgctggctcacacacctgctcaggttgttggtgctggggctcatcgagctctcctggaacacatacccttccacatcctgcagctctgctgccctgcacatatgccatgccgtcatcctgctgcagctctggctgggcccgcagcctttccccaagagcacccaacacagcaagaaagcccactga

SEQ ID NO: 12560 - DNA, 118 bp, synthetic construct
  misc_feature 1..118: note = Synthetic polypeptide
  source 1..118: mol_type = other DNA
cagcttagaagtcagatttgagccaaaattgttgtactgctgctgctgctgcttttctctgtggctttggacacctcagacacagagattgactggaaggcctacatggccgaggtag

SEQ ID NO: 12561 - DNA, 1635 bp, synthetic construct; identical to SEQ ID NO: 11249
  misc_feature 1..1635: note = Synthetic polypeptide
  source 1..1635: mol_type = other DNA

SEQ ID NO: 12562 - DNA, 1704 bp, synthetic construct; identical to SEQ ID NO: 11250
  misc_feature 1..1704: note = Synthetic polypeptide
  source 1..1704: mol_type = other DNA

SEQ ID NO: 12563 - DNA, 333 bp, synthetic construct; identical to SEQ ID NO: 6583
  misc_feature 1..333: note = Synthetic polypeptide
  source 1..333: mol_type = other DNA

SEQ ID NO: 12564 - DNA, 288 bp, synthetic construct
  misc_feature 1..288: note = Synthetic polypeptide
  source 1..288: mol_type = other DNA
tgtttgttcacgttccggaactttaagatcatttaccgccgctatgctggcctctacttctgcatctgtgtggatgtcaatgacaacaacctggcttacctggaggccattcacaacttcgtggaggtcttaaacgaatatttccacaatgtctgtgaactggacctggtgttcaacttctacaaggtttacacggtcgtggacgagatgttcctggctggcgaaatccgagagaccagccagacgaaggtgctgaaacagctgctgatgctacagtccctggagtga

SEQ ID NO: 12565 - DNA, 1791 bp, synthetic construct
  misc_feature 1..1791: note = Synthetic polypeptide
  source 1..1791: mol_type = other DNA
agcaggtcctccaataacattgctttgttcaacatcttttcattataacattgctgagggaaaaaaatcgatttccagctgggccactgtctgtataaggagtttgcagattctccccatgtccttgtgggctttctccgggcgctctggtttcttctcacgtctcaaatctgtgcatgttaggttaggtgaacaggcatgcctacgtggtcccagcctgcgtgagtataggtgtgcttgtgtgagtttgccctgcaatgggatggcatcctggtcaagactagttacctcctggtgccctgagctgcttgataggcttggcaacccacaaccctgaaatggaatcagcagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatccccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatgggcctacagcaggggcagccatttcttctcacatggatatagacaaagtagccttcacaggatcaacagaggttggcaagttgatcaaagaagctgccgggaaaagcaatctgaagagggtgaccctggagcttggaggaaagagcccttgcattgtgttagctgatgccgacttggacaatgctgttgaatttgcacaccatggggtattctaccaccagggccagtgttgtatagccgcatccaggatttttgtggaagaatcaatttatgatgagtttgttcgaaggagtgttgagcgggctaagaagtatatccttggaaatcctctgaccccaggagtcactcaaggccctcagattgacaaggaacaatatgataaaatacttgacctcattgagagtgggaagaaagaaggggccaaactggaatgtggaggaggcccgtgggggaataaaggctactttgtccagcccacagtgttctctaatgttacagatgagatgcgcattgccaaagaggagatttttggaccagtgcagcaaatcatgaagtttaaatctttagatgacgtgatcaaaagagcaaacaatactttctatggcttatcagcaggagtgtttaccaaagacattgataaagccataacaatctcctctgctctgcaggcaggaacagtgtgggtgaattgctatggcgtggtaagtgcccagtgcccctttggtggattcaagatgtctggaaatggaagagaactgggagagtacggtttccatgaatatacagaggtcaaaacagtcacagtgaaaatctctcagaagaactcataa

SEQ ID NO: 12566 - DNA, 978 bp, synthetic construct
  misc_feature 1..978: note = Synthetic polypeptide
  source 1..978: mol_type = other DNA
agcaggtcctccaataacattgctttgttcaacatcttttcattataacattgctgagggaaaaaaatcgatttccagctgggccactgtctgtataaggagtttgcagattctccccatgtccttgtgggctttctccgggcgctctggtttcttctcacgtctcaaatctgtgcatgttaggttaggtgaacaggcatgcctacgtggtcccagcctgcgtgagtataggtgtgcttgtgtgagtttgccctgcaatgggatggcatcctggtcaagactagttacctcctggtgccctgagctgcttgataggcttggcaacccacaaccctgaaatggaatcagcagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatccccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatggggccagtgttgtatag

SEQ ID NO: 12567 - DNA, 1001 bp, synthetic construct
  misc_feature 1..1001: note = Synthetic polypeptide
  source 1..1001: mol_type = other DNA
agcaggtcctccaataacattgctttgttcaacatcttttcattataacattgctgagggaaaaaaatcgatttccagctgggccactgtctgtataaggagtttgcagattctccccatgtccttgtgggctttctccgggcgctctggtttcttctcacgtctcaaatctgtgcatgttaggttaggtgaacaggcatgcctacgtggtcccagcctgcgtgagtataggtgtgcttgtgtgagtttgccctgcaatgggatggcatcctggtcaagactagttacctcctggtgccctgagctgcttgataggcttggcaacccacaaccctgaaatggaatcagcagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatccccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatgggcctacagcaggggcagccatttcttctcacatggatat

SEQ ID NO: 12568 - DNA, 894 bp, synthetic construct
  misc_feature 1..894: note = Synthetic polypeptide
  source 1..894: mol_type = other DNA
agcaggtcctccaataacattgctttgttcaacatcttttcattataacattgctgagggaaaaaaatcgatttccagctgggccactgtctgtataaggagtttgcagattctccccatgtccttgtgggctttctccgggcgctctggtttcttctcacgtctcaaatctgtgcatgttaggttaggtgaacaggcatgcctacgtggtcccagcctgcgtgagtataggtgtgcttgtgtgagtttgccctgcaatgggatggcatcctggtcaagactagttacctcctggtgccctgagctgcttgataggcttggcaacccacaaccctgaaatggaatcagcagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatccccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctc

SEQ ID NO: 12569 - DNA, 599 bp, synthetic construct; identical to SEQ ID NO: 9649
  misc_feature 1..599: note = Synthetic polypeptide
  source 1..599: mol_type = other DNA

SEQ ID NO: 12570 - DNA, 686 bp, synthetic construct; identical to SEQ ID NO: 9650
  misc_feature 1..686: note = Synthetic polypeptide
  source 1..686: mol_type = other DNA

SEQ ID NO: 12571 - DNA, 956 bp, synthetic construct; identical to SEQ ID NO: 7135
  misc_feature 1..956: note = Synthetic polypeptide
  source 1..956: mol_type = other DNA

SEQ ID NO: 12572 - DNA, 133 bp, synthetic construct; identical to SEQ ID NO: 6551
  misc_feature 1..133: note = Synthetic polypeptide
  source 1..133: mol_type = other DNA

SEQ ID NO: 12573 - DNA, 1226 bp, synthetic construct
  misc_feature 1..1226: note = Synthetic polypeptide
  source 1..1226: mol_type = other DNA
gcggggtgcagtggctcacacctataatcccagcactttgggaggccgaggttcttggtgagattcaggaaattgtgaaaacagggctttgggtaggcgattgcttcatttacacaagttctgtgaacagattaaattattatgttggaggagaaatagtcaccattgcccacttggacaggacgatgtatctcctaggctacattcctaaagacaacaggctttatctgggggataaagaattgaacatcattagctattccctgctggtttcagtcctggaataccagacagctgtcatgcggagggactttagcatggctgataaggtccttcctaccattccaaaagaacagaggaccagagttgcacactttttggaaaagcagggcttcaagcagcaagctcttacagtatccacagatcctgagcatcgttttgagcttgctcttcagcttggagagttaaaaattgcataccagttagcagtggaagcagagtcagaacagaagtggaaacaacttgctgaacttgccattagtaaatgtcagtttggcctagcccaggagtgcctgcatcatgcacaggattatgggggcctgctgcttttggccactgcctctggaaatgctaatatggtgaacaagctagcagagggtgcggagagagatggcaaaaataatgtggcattcatgagctactttttacagggcaaggttgatgcctgcctagagctcttaattagaactggacggctgccagaagctgccttcttggcccgaacttacttacccagtcaggtttcaagggtagtgaaactctggagagagaatctctcaaaagtcaatcagaaagcagcagaatcccttgctgacccaacagagtatgaaaacctgttccctggattaaaagaagcctttgttgttgaagaatgggtgaaggaaacacatgctgatctgtggccagccaaacaatacccacttgtcacgccaaatgaagagagaaatgtcatggaagagggaaaagactttcagccctcaagatctacagctcaacaggaacttgatgggaaacctgcttctcctactccggttattgtggcctcccacacagccaacaaagaagaaaagagtttactcgaactagaagtagatttggataatttggaattagaagatattgacacaacagatatcaatctggatgaagatattttggatgattga

SEQ ID NO: 12574 - DNA, 170 bp, synthetic construct
  misc_feature 1..170: note = Synthetic polypeptide
  source 1..170: mol_type = other DNA
gcggggtgcagtggctcacacctataatcccagcactttgggaggccgaggttcttggtgagattcaggaaattgtgaaaacagggctttgggtagatttggataatttggaattagaagatattgacacaacagatatcaatctggatgaagatattttggatgattga

SEQ ID NO: 12575 - DNA, 751 bp, synthetic construct
  misc_feature 1..751: note = Synthetic polypeptide
  source 1..751: mol_type = other DNA
tgatatggtttggatttttgtctctgcccgaatctcatgttgaattataattcccagtgttggaggaggggcctggtatgagacgattggaccgcaggggtggatttccttcttgctgttctcgtgataatgagtgagttctcatgagatctggttgtttaaaagtgtgtagcacctacacctttgctctcttcctccttctccggctgtgcctgcttcctgtttacctttgccatgattggaagtttcctgaggcctccccagccgtgcctcacagcctgcagaactgttgataaaaattaaagagtgggtggacaagtatgacccaggtgctttggtcattccttttagtggggccttggaactcaagttgcaagaattgagtgctgaggagagacagaagtatctggaagcgaacatgacacaaagtgctttgccaaagatcattaaggctgggtttgcagcactccaactagaatactttttcactgcaggcccagatgaagtgcgtgcatggaccatcaggaaagggactaaggctcctcaggctgcaggaaagattcacacagattttgaaaagggattcattatggctgaagtaatgaaatacgaagattttaaagaggaaggttctgaaaatgcagtcaaggctgctggaaagtacagacaacaaggcagaaattatattgttgaagatggagatattatcttcttcaaatttaacacacctcaacaaccgaagaagaaataa

SEQ ID NO: 12576 - DNA, 343 bp, synthetic construct
  misc_feature 1..343: note = Synthetic polypeptide
  source 1..343: mol_type = other DNA
tgatatggtttggatttttgtctctgcccgaatctcatgttgaattataattcccagtgttggaggaggggcctggtatgagacgattggaccgcaggggtggatttccttcttgctgttctcgtgataatgagtgagttctcatgagatctggttgtttaaaagtgtgtagcacctacacctttgctctcttcctccttctccggctgtgcctgcttcctgtttacctttgccatgattggaagtttcctgaggcctccccagccgtgcctcacagcctgcagaactgttgataaaaattaaagagtgggtggacaagtatgacccaggtgctttggtcatt

SEQ ID NO: 12577 - DNA, 336 bp, synthetic construct; identical to SEQ ID NO: 7520
  misc_feature 1..336: note = Synthetic polypeptide
  source 1..336: mol_type = other DNA

SEQ ID NO: 12578 - DNA, 346 bp, synthetic construct; identical to SEQ ID NO: 7521
  misc_feature 1..346: note = Synthetic polypeptide
  source 1..346: mol_type = other DNA

SEQ ID NO: 12579 - DNA, 1691 bp, synthetic construct
  misc_feature 1..1691: note = Synthetic polypeptide
  source 1..1691: mol_type = other DNA
tgatatggtttggctctgtgtccccactcaaatctcaccttgaattgtaacaattcctatgtgtcgtgggaggaacctggtgggagggaattgaatcatgagggtgagtctctttcccgtgctgttcccatggcagtgaataagtctcacgagatctgatggttttataaataggagttcccctacacaagctctctctcgcctgctgccatgcaagacgtgactttgcttctccttccccttctgccatgatttgtgatgcctcctcagccatgtggaactgagtcatggccggcttcaacatggggggcgacctcagggagcctgccgccagcattcccccgggctccctggcagctgttggcatctcgtggtttctgtacatcatcttcgtcttcctcctgggcgccatctgcactcgagaggcccttcgctatgacttcctgatagcggaaaaggtatccctcatgggcttcctgttccttttgggcttatacatctcgtccctggcttcctgcatgggaggactttatggagctccccgcatcctgcagtgcattgcccaggagaaagtgatccctgcacttgcctgtctgggacaagggaaggggccaaacaaaacacccgtggctgccatctgcctgaccagcttggtgaccatggcctttgtttttgtgggtcaagtgaacgttctggcccccatcgtcaccatcaacttcatgctgacatacgttgcagtggactactcttacttctccctgtccatgtgttcctgcagcctgaccccggtgcctgagccggtgctcagggagggcgcagaaggcctccactgctctgagcacctgctcttagagaaagctcccagttacggctctgagggacctgcccaaagagtcttggagggcacgctactggaattcaccaaggacatggatcagctcctccagctaaccaggaagcttgagagtagccagcccaggcaaggagagggtaacaggaccccagaaagtcagaagaggaaaagcaagaaggccaccaagcagaccctacaagatagcttcctcttggacctcaaatcccctccttctttccctgtcgagatctctgacaggttgcccgctgcctcctgggaggggcaggagtcctgctggaacaagcagacttccaagagcgaagggactcagcctgagggaacatatggagagcaacttgttcctgagctgtgcaaccaatcagagtccagtggagaagatttcttcctgaagtccaggctccaagaacaagatgtctggagaagatccacttctttctatacccacatgtgcaacccctgggtctccctgttgggggctgttgggtcccttctcatcatgtttgtgatacagtgggtgtataccctggttaacatgggtgttgctgccatcgtgtatttctacattggccgggccagtccagggcttcaccttggatcagcctccaacttcagctttttccggtggatgaggtctctcttgctcccctcctgcaggagcttgcggtcccctcaggagcagatcatcttggcgccgtccctggctaaggttgacatggagatgactcagctcacccaggagaatgcagacttcgccactcgggatcgctaccaccactcctccctcgtgaaccgggagcagctgatgcctcactactag

SEQ ID NO: 12580 - DNA, 522 bp, synthetic construct
  misc_feature 1..522: note = Synthetic polypeptide
  source 1..522: mol_type = other DNA
tgatatggtttggctctgtgtccccactcaaatctcaccttgaattgtaacaattcctatgtgtcgtgggaggaacctggtgggagggaattgaatcatgagggtgagtctctttcccgtgctgttcccatggcagtgaataagtctcacgagatctgatggttttataaataggagttcccctacacaagctctctctcgcctgctgccatgcaagacgtgactttgcttctccttccccttctgccatgatttgtgatgcctcctcagccatgtggaactgagtcatggccggcttcaacatggggggcgacctcagggagcctgccgccagcattcccccgggctccctggcagctgttggcatctcgtggtttctgtacatcatcttcgtcttcctcctgggcgccatctgcactcgagaggcccttcgctatgacttcctgatagcggaaaaggtatccctcatgggcttcctgttccttttgggcttatacatctcgtccctggcttcctgcatgg

SEQ ID NO: 12581 - DNA, 796 bp, synthetic construct
  misc_feature 1..796: note = Synthetic polypeptide
  source 1..796: mol_type = other DNA
tgatatggtttggatttttgtctctgcccgaatctcatgttgaattataattcccagtgttggaggaggggcctggtatgagacgattggaccgcaggggtggatttccttcttgctgttctcgtgataatgagtgagttctcatgagatctggttgtttaaaagtgtgtagcacctacacctttgctctcttcctccttctccggctgtgcctgcttcctgtttacctttgccatgattggaagtttcctgaggcctccccagccgtgcctcacagcctgcagaactgtgagccagttagacctcttttctttataaattacccagtctcaggttgataaaaattaaagagtgggtggacaagtatgacccaggtgctttggtcattccttttagtggggccttggaactcaagttgcaagaattgagtgctgaggagagacagaagtatctggaagcgaacatgacacaaagtgctttgccaaagatcattaaggctgggtttgcagcactccaactagaatactttttcactgcaggcccagatgaagtgcgtgcatggaccatcaggaaagggactaaggctcctcaggctgcaggaaagattcacacagattttgaaaagggattcattatggctgaagtaatgaaatacgaagattttaaagaggaaggttctgaaaatgcagtcaaggctgctggaaagtacagacaacaaggcagaaattatattgttgaagatggagatattatcttcttcaaatttaacacacctcaacaaccgaagaagaaataa

SEQ ID NO: 12582 - DNA, 388 bp, synthetic construct
  misc_feature 1..388: note = Synthetic polypeptide
  source 1..388: mol_type = other DNA
tgatatggtttggatttttgtctctgcccgaatctcatgttgaattataattcccagtgttggaggaggggcctggtatgagacgattggaccgcaggggtggatttccttcttgctgttctcgtgataatgagtgagttctcatgagatctggttgtttaaaagtgtgtagcacctacacctttgctctcttcctccttctccggctgtgcctgcttcctgtttacctttgccatgattggaagtttcctgaggcctccccagccgtgcctcacagcctgcagaactgtgagccagttagacctcttttctttataaattacccagtctcaggttgataaaaattaaagagtgggtggacaagtatgacccaggtgctttggtcatt

SEQ ID NO: 12583 - DNA, 1533 bp, synthetic construct; identical to SEQ ID NO: 8543
  misc_feature 1..1533: note = Synthetic polypeptide
  source 1..1533: mol_type = other DNA

SEQ ID NO: 12584 - DNA, 5853 bp, synthetic construct; identical to SEQ ID NO: 7611
  misc_feature 1..5853: note = Synthetic polypeptide
  source 1..5853: mol_type = other DNA

SEQ ID NO: 12585 - DNA, 5826 bp, synthetic construct; identical to SEQ ID NO: 7612
  misc_feature 1..5826: note = Synthetic polypeptide
  source 1..5826: mol_type = other DNA

SEQ ID NO: 12586 - DNA, 917 bp, synthetic construct; identical to SEQ ID NO: 7613
  misc_feature 1..917: note = Synthetic polypeptide
  source 1..917: mol_type = other DNA

SEQ ID NO: 12587 - DNA, 382 bp, synthetic construct; identical to SEQ ID NO: 434
  misc_feature 1..382: note = Synthetic polypeptide
  source 1..382: mol_type = other DNA

SEQ ID NO: 12588 - DNA, 571 bp, synthetic construct
  misc_feature 1..571: note = Synthetic polypeptide
  source 1..571: mol_type = other DNA
ggcctggcacagtggctcatgcctgtaatcccagcacttcaggaggccgaggcaagcagatcatttggggtcaggagttcgagaccagcctggacaacatgggtatattcaggcctgccgggcactcatgatcaccgccatcctcctgggcttcctcggcctcttgctaggcatagcgggcctgcgctgcaccaacattgggggcctggagctctccaggaaagccaagctggcggccaccgcaggggccctccacattctggccggtatctgcgggatggtggccatctcctggtacgccttcaacatcacccgggacttcttcgaccccttgtaccccggaaccaagtacgagctgggccccgccctctacctggggtggagcgcctcactgatctccatcctgggtggcctctgcctctgctccgcctgctgctgcggctctgacgaggacccagccgccagcgcccggcggccctaccaggctccagtgtccgtgatgcccgtcgccacctcggaccaagaaggcgacagcagctttggcaaatacggcagaaacgcctacgtgtag

SEQ ID NO: 12589 - DNA, 307 bp, synthetic construct
  misc_feature 1..307: note = Synthetic polypeptide
  source 1..307: mol_type = other DNA
ggcctggcacagtggctcatgcctgtaatcccagcacttcaggaggccgaggcaagcagatcatttggggtcaggagttcgagaccagcctggacaacatgggtatattcaggcctgccgggcactcatgatcaccgccatcctcctgggcttcctcggcctcttgctaggcatagcgggcctgcgctgcaccaacattgggggcctggagctctccaggaaagccaagctggcggccaccgcaggggccctccacattctggccgatctcctggctgcaaatcagcccatcggcagtgtttcttga

SEQ ID NO: 12590 - DNA, 619 bp, synthetic construct
  misc_feature 1..619: note = Synthetic polypeptide
  source 1..619: mol_type = other DNA
ggcctggcacagtggctcatgcctgtaatcccagcacttcaggaggccgaggcaagcagatcatttggggtcaggagttcgagaccagcctggacaacatggtgaaaccctgtctctactaaaaacagaaaaattagccgggcgtggtgggtatattcaggcctgccgggcactcatgatcaccgccatcctcctgggcttcctcggcctcttgctaggcatagcgggcctgcgctgcaccaacattgggggcctggagctctccaggaaagccaagctggcggccaccgcaggggccctccacattctggccggtatctgcgggatggtggccatctcctggtacgccttcaacatcacccgggacttcttcgaccccttgtaccccggaaccaagtacgagctgggccccgccctctacctggggtggagcgcctcactgatctccatcctgggtggcctctgcctctgctccgcctgctgctgcggctctgacgaggacccagccgccagcgcccggcggccctaccaggctccagtgtccgtgatgcccgtcgccacctcggaccaagaaggcgacagcagctttggcaaatacggcagaaacgcctacgtgtag

SEQ ID NO: 12591 - DNA, 355 bp, synthetic construct
  misc_feature 1..355: note = Synthetic polypeptide
  source 1..355: mol_type = other DNA
ggcctggcacagtggctcatgcctgtaatcccagcacttcaggaggccgaggcaagcagatcatttggggtcaggagttcgagaccagcctggacaacatggtgaaaccctgtctctactaaaaacagaaaaattagccgggcgtggtgggtatattcaggcctgccgggcactcatgatcaccgccatcctcctgggcttcctcggcctcttgctaggcatagcgggcctgcgctgcaccaacattgggggcctggagctctccaggaaagccaagctggcggccaccgcaggggccctccacattctggccgatctcctggctgcaaatcagcccatcggcagtgtttcttga

SEQ ID NO: 12592 - DNA, 1075 bp, synthetic construct
  misc_feature 1..1075: note = Synthetic polypeptide
  source 1..1075: mol_type = other DNA
ccactccctacttcacaccccatgtttcagccatattaagcagcttgtagttctacagctggactacgctgtatttttttttttttctctaggcctttggatatgctgttttccctgccttggattggcttcctactgataaatcatgtttattctctcagaataagctaagatgtcacctggactggaagatgaggctaatacttacttcaaggaatggacctgttcttcgtctccatctctgcccagaagctgcaaggaaatcaaagacgaatgtcctagtgcatttgatggcctgtattttctccgcactgagaatggtgttatctaccagaccttctgtgacatgacctctgggggtggcggctggaccctggtggccagcgtgcacgagaatgacatgcgtgggaagtgcacggtgggcgatcgctggtccagtcagcagggcagcaaagcagtctacccagagggggacggcaactgggccaactacaacacctttggatctgcagaggcggccacgagcgatgactacaagaaccctggctactacgacatccaggccaaggacctgggcatctggcacgtgcccaataagtcccccatgcagcactggagaaacagctccctgctgaggtaccgcacggacactggcttcctccagacactgggacataatctgtttggcatctaccagaaatatccagtgaaatatggagaaggaaagtgttggactgacaacggcccggtgatccctgtggtctatgattttggcgacgcccagaaaacagcatcttattactcaccctatggccagcgggaattcactgcgggatttgttcagttcagggtatttaataacgagagagcagccaacgccttgtgtgctggaatgagggtcaccggatgtaacactgagcaccactgcattggtggaggaggatactttccagaggccagtccccagcagtgtggagatttttctggttttgattggagtggatatggaactcatgttggttacagcagcagccgtgagataactgaggcagctgtgcttctattctatcgttga

SEQ ID NO: 12593 - DNA, 213 bp, synthetic construct; identical to SEQ ID NO: 7877
  misc_feature 1..213: note = Synthetic polypeptide
  source 1..213: mol_type = other DNA

SEQ ID NO: 12594 - DNA, 852 bp, synthetic construct
  misc_feature 1..852: note = Synthetic polypeptide
  source 1..852: mol_type = other DNA
agcaaactgtcgcaaggacagaaaaccaaacatcgcatgttctcactcataggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactga

SEQ ID NO: 12595 - DNA, 1161 bp, synthetic construct
  misc_feature 1..1161: note = Synthetic polypeptide
  source 1..1161: mol_type = other DNA
agcaaactgtcgcaaggacagaaaaccaaacatcgcatgttctcactcataggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactga

SEQ ID NO: 12596 - DNA, 255 bp, synthetic construct
  misc_feature 1..255: note = Synthetic polypeptide
  source 1..255: mol_type = other DNA
ggccaggcacagtggctcatgccgataatccctgtaatcactttgggaggccaagatcgggggattgcttgaccctaggagttcaagaccagcctgggcaacatgcctacaagtgtaaggaatccagaacttgaacgaaacggactctacccggcctacactggactgccaggatcacggcattcttgcattttccccggacagtataacccgtctttcatcagtgatgaaagcagaagaagagactacttttaa

SEQ ID NO: 12597 - DNA, 1250 bp, synthetic construct; identical to SEQ ID NO: 6341
  misc_feature 1..1250: note = Synthetic polypeptide
  source 1..1250: mol_type = other DNA

SEQ ID NO: 12598 - DNA, 1379 bp, synthetic construct; identical to SEQ ID NO: 6342
  misc_feature 1..1379: note = Synthetic polypeptide
  source 1..1379: mol_type = other DNA

SEQ ID NO: 12599 - DNA, 514 bp, synthetic construct; identical to SEQ ID NO: 6343
  misc_feature 1..514: note = Synthetic polypeptide
  source 1..514: mol_type = other DNA

SEQ ID NO: 12600 - DNA, 2582 bp, synthetic construct
  misc_feature 1..2582: note = Synthetic polypeptide
  source 1..2582: mol_type = other DNA
gtccagagaacaaacctctggtcctttagatctgttgccacctactgtgggaactttgtgatgaaaatgccaggaaagatttaaagacattaccagcctttccaaccaaaactcttcaggagcatccatcccttgcctactgtgaggacagggtaattgagcattatttgaaaatcaaaggtctcactcgaggtcaagctgtggttcagtatatgaaaatagtagaagctctaccgacttacggtgtccattattatgcagtaaaggataagcaaggacttccttggtggcttggaataagctataagggaattggccaatatgatatacaagacaaggtgaagcctcggaagttattccaatggaaacagctggagaacttatatttccgtgagaaaaaatttgctgttgaagttcatgatccacgaaggatttcagtttcaagaagaacctttgggcaaagtggcttgtttgtgcaaacatggtatgctaactcttctctcatcaagtccatttgggtaatggcaattagtcagcatcagttttacttggaccggaagcaaagcaaagcaaaaattccttcagccaggagtttagatgagattgcaatggatttgacagagacaggaacacaaagggcctccaagctggtgacactggagacgaaaagtcagttcatcatggcaagtaatggcagtttaatctcctcaggttctcaagactcagaagttagtgaagagcaaaagagagaaaaaatccttgaactaaagaagaaggagaaactattacaagaaaaacttctgaaaaaagttgaggagcttaagaagatctgtctgcgggaggctgagctcacaggcaaaatgccaaaggagtatcccctgaacataggcgagaagcctcctcaggtcagaagacgtgtgggtactgcgttcaaattagatgacaacttgctgccgagtgaagaagatcctgctttgcaagaactggagagtaattttctaatacaacaaaagctggtggaagctgcaaagaaacttgccaatgagccagacctttgtaaaactgtgaagaaaaagcgaaagcaagattacacagatgcgatgaaaaagcttcaggagattgaaaatgcaataaacgaataccgaattaggtgtggaaagaaacccagccagaaagcaacagtgttaccagaagacataatcccctcagagagtagctctttgtctgacaccaccacctatgatgatcccagtgatgccttcacttttcctgggcagcgatcaagttcagtacctcattctccaagaattcttccccccaagtctcttggtattgagcgaatccatttcagaaagtcgtccatcaatgaacagtttgtggataccaggcagtccagagaaatgctgtccacacacagcagcccttacaaaactctggagaggcggccccagggaggacgaagcatgcccaccacgccagttcttacccgaaacgcctacagcagcagccacttggaacccgaatcttcatctcagcactgccgccagcggagtggaagcctggagtcccagtcccacctgctctccgagatggacagcgataagccatttttctccctctccaaatcccaaagaagcagcagcacagaaatcctcgatgacgggtcttcttatacaagccaatcaagcacagagtattactgtgtgacaccagttaccggcccctattacaccacccagaccctggacactcgcaccaggggtcggaggaggtcaaagaaacagaatgtttctacttcaaattcaggaagcatgcccaacctagcacaaaaggatagtttgaggaatggtgtttactcaaagagtcaggagccaccgtcttccagttactacattgccgggtacacaccctatgcagagtgtgacttttattacagtggtggttatgtctatgagaatgacaccgagggacagtatagtgtcaacccttcctaccggtcctcagcccactatggatatgagcgccagagggactacagcagatcctttcacgaagatgaggtcgaccgggtaccccataacccatatgcaactctccggctgccaaggaaggctgctgcaaaatcggagcacatcaccaaaaacatccacaaggccttagttgccgagcacttgcgtggctggtaccagcgggcctctgggcagaaggatcagggacacagcccgcagaccagctttgactcagacaggggatcacagagatgcctggggtttgcggggctgcaagtaccttgttctccaagcagtcgtgcatcctcgtactcttcagtgtcttctacaaatgcttctgggaactggaggacccagttaaccatagggctgtcggattacgagactccagcacattcttcttacaccagctgctatggcaatgtctataatcctttaccctctccaagcagacaatacacagaaatcagtcaactggatggtacagatggaaaccagctggaagacaacctggagagtagtgagcagagactcttttggcatgaagattcaaagcctggaacattagtctga

SEQ ID NO: 12601 - DNA, 353 bp, synthetic construct
  misc_feature 1..353: note = Synthetic polypeptide
  source 1..353: mol_type = other DNA
gtccagagaacaaacctctggtcctttagatctgttgccacctactgtgggaactttgtgatgaaaatgccaggaaagatttaaagacattaccagcctttccaaccaaaactcttcaggagcatccatcccttgcctactgtgaggacagggtaattgagcattatttgaaaatcaaaggtctcactcgaggtcaagctgtggttcagtatatgaaaatagtagaagctctaccgacttacggtgtccattattatgcagtaaaggataagcaaggacttccttggtggcttggaataagctataagggaattggccaatatgatatacaagacaaggtgaagcctcggaag

SEQ ID NO: 12602 - DNA, 142 bp, synthetic construct
  misc_feature 1..142: note = Synthetic polypeptide
  source 1..142: mol_type = other DNA
gtccagagaacaaacctctggtcctttagatctgttgccacctactgtgggaactttgtgatgaaaatgccaggaaagatttaaagacattaccagcctttccaaccaaaactcttcaggagcatccatcccttgcctactg

SEQ ID NO: 12603 - DNA, 66 bp, synthetic construct
  misc_feature 1..66: note = Synthetic polypeptide
  source 1..66: mol_type = other DNA
gtccagagaacaaacctctggtcctttagatctgttgccacctactgtgggaactttgtgatgaaa

SEQ ID NO: 12604 - DNA, 161 bp, synthetic construct; identical to SEQ ID NO: 7668
  misc_feature 1..161: note = Synthetic polypeptide
  source 1..161: mol_type = other DNA

SEQ ID NO: 12605 - DNA, 178 bp, synthetic construct; identical to SEQ ID NO: 7669
  misc_feature 1..178: note = Synthetic polypeptide
  source 1..178: mol_type = other DNA

SEQ ID NO: 12606 - DNA, 560 bp, synthetic construct; identical to SEQ ID NO: 6322
  misc_feature 1..560: note = Synthetic polypeptide
  source 1..560: mol_type = other DNA

SEQ ID NO: 12607 - DNA, 678 bp, synthetic construct; identical to SEQ ID NO: 8918
  misc_feature 1..678: note = Synthetic polypeptide
  source 1..678: mol_type = other DNA

SEQ ID NO: 12608 - DNA, 726 bp, synthetic construct; identical to SEQ ID NO: 8919
  misc_feature 1..726: note = Synthetic polypeptide
  source 1..726: mol_type = other DNA

SEQ ID NO: 12609 - DNA, 355 bp, synthetic construct; identical to SEQ ID NO: 8039
  misc_feature 1..355: note = Synthetic polypeptide
  source 1..355: mol_type = other DNA

SEQ ID NO: 12610 - DNA, 282 bp, synthetic construct; identical to SEQ ID NO: 7621
  misc_feature 1..282: note = Synthetic polypeptide
  source 1..282: mol_type = other DNA

SEQ ID NO: 12611 - DNA, 647 bp, synthetic construct
  misc_feature 1..647: note = Synthetic polypeptide
  source 1..647: mol_type = other DNA
agaaggcaggctctgttgtcaggctgcctgggttcagatcccagctctgcacctggctgatgtgtctccttgggcttatatttggcaccctttaccctgcgtattattcctacaaggctgtgaaatcaaaggacattaaggaatatgtcaaatggatgatgtactggattatatttgcacttttcaccacagcagagacattcacagacatcttcctttgttggtttccattctattatgaactaaaaatagcatttgtagcctggctgctgtctccctacacaaaaggctccagcctcctgtacaggaagtttgtacatcccacgctatcttcaaaagaaaaggaaatcgatgattgtctggtccaagcaaaagaccgaagttacgatgcccttgtgcacttcgggaagcggggcttgaacgtggccgccacagcggctgtgatggctgcttccaagggacagggtgccttatcggagagactgcggagcttcagcatgcaggacctcaccaccatcaggggagacggcgcccctgctccctcgggccccccaccaccggggtctgggcgggccagcggcaaacacggccagcctaagatgtccaggagtgcttctgagagcgctagcagctcaggcaccgcctag

SEQ ID NO: 12612 - DNA, 473 bp, synthetic construct
  misc_feature 1..473: note = Synthetic polypeptide
  source 1..473: mol_type = other DNA
agaaggcaggctctgttgtcaggctgcctgggttcagatcccagctctgcacctggctgatgtgtctccttgggcttatatttggcaccctttaccctgcgtattattcctacaaggctgtgaaatcaaaggacattaaggaatatgtcaaatggatgatgtactggattatatttgcacttttcaccacagcagagacattcacagacatcttcctttgttgggacagggtgccttatcggagagactgcggagcttcagcatgcaggacctcaccaccatcaggggagacggcgcccctgctccctcgggccccccaccaccggggtctgggcgggccagcggcaaacacggccagcctaagatgtccaggagtgcttctgagagcgctagcagctcaggcaccgcctagaatccttcgatctcgcttcaggaagaaaagtacctcatcctcggccaccgaaaccacgtga

SEQ ID NO: 12613 - DNA, 402 bp, synthetic construct
  misc_feature 1..402: note = Synthetic polypeptide
  source 1..402: mol_type = other DNA
agaaggcaggctctgttgtcaggctgcctgggttcagatcccagctctgcacctggctgatgtgtctccttgggcttatatttggcaccctttaccctgcgtattattcctacaaggctgtgaaatcaaaggacattaaggaatatgtcaaatggatgatgtactggattatatttgcacttttcaccacagcagagacattcacagacatcttcctttgttgggacagggtgccttatcggagagactgcggagcttcagcatgcaggacctcaccaccatcaggggagacggcgcccctgctccctcgggccccccaccaccggggtctgggcgggccagcggcaaacacggccagcctaagatgtccaggagtgcttctgagagcgctagcagctcagg

SEQ ID NO: 12614 - DNA, 591 bp, synthetic construct
  misc_feature 1..591: note = Synthetic polypeptide
  source 1..591: mol_type = other DNA
agaaggcaggctctgttgtcaggctgcctgggttcagatcccagctctgcacctggctgatgtgtctccttgggcttatatttggcaccctttaccctgcgtattattcctacaaggctgtgaaatcaaaggacattaaggaatatgtcaaatggatgatgtactggattatatttgcacttttcaccacagcagagacattcacagacatcttcctttgttggtttccattctattatgaactaaaaatagcatttgtagcctggctgctgtctccctacacaaaaggctccagcctcctgtacaggaagtttgtacatcccacgctatcttcaaaagaaaaggaaatcgatgattgtctggtccaagcaaaagaccgaagttacgatgcccttgtgcacttcgggaagcggggcttgaacgtggccgccacagcggctgtgatggctgcttccaagggacagggtgccttatcggagagactgcggagcttcagcatgcaggacctcaccaccatcaggggagacggcgcccctgctccctcgggccccccaccaccggggtctgggcgggccagcggcaaacacggcc

SEQ ID NO: 12615 - DNA, 68 bp, synthetic construct; identical to SEQ ID NO: 6862
  misc_feature 1..68: note = Synthetic polypeptide
  source 1..68: mol_type = other DNA

SEQ ID NO: 12616 - DNA, 1053 bp, synthetic construct; identical to SEQ ID NO: 6863
  misc_feature 1..1053: note = Synthetic polypeptide
  source 1..1053: mol_type = other DNA

SEQ ID NO: 12617 - DNA, 407 bp, synthetic construct; identical to SEQ ID NO: 6864
  misc_feature 1..407: note = Synthetic polypeptide
  source 1..407: mol_type = other DNA

SEQ ID NO: 12618 - DNA, 673 bp, synthetic construct; identical to SEQ ID NO: 6865
  misc_feature 1..673: note = Synthetic polypeptide
  source 1..673: mol_type = other DNA

SEQ ID NO: 12619 - DNA, 1004 bp, synthetic construct; identical to SEQ ID NO: 8920
  misc_feature 1..1004: note = Synthetic polypeptide
  source 1..1004: mol_type = other DNA

SEQ ID NO: 12620 - DNA, 887 bp, synthetic construct; identical to SEQ ID NO: 8921
  misc_feature 1..887: note = Synthetic polypeptide
  source 1..887: mol_type = other DNA

SEQ ID NO: 12621 - DNA, 1266 bp, synthetic construct; identical to SEQ ID NO: 9947
  misc_feature 1..1266: note = Synthetic polypeptide
  source 1..1266: mol_type = other DNA

SEQ ID NO: 12622 - DNA, 1537 bp, synthetic construct; identical to SEQ ID NO: 9702
  misc_feature 1..1537: note = Synthetic polypeptide
  source 1..1537: mol_type = other DNA

SEQ ID NO: 12623 - DNA, 418 bp, synthetic construct; identical to SEQ ID NO: 11223
  misc_feature 1..418: note = Synthetic polypeptide
  source 1..418: mol_type = other DNA

SEQ ID NO: 12624 - DNA, 386 bp, synthetic construct; identical to SEQ ID NO: 11224
  misc_feature 1..386: note = Synthetic polypeptide
  source 1..386: mol_type = other DNA

SEQ ID NO: 12625 - DNA, 457 bp, synthetic construct; identical to SEQ ID NO: 11225
  misc_feature 1..457: note = Synthetic polypeptide
  source 1..457: mol_type = other DNA

SEQ ID NO: 12626 - DNA, 496 bp, synthetic construct; identical to SEQ ID NO: 11226
  misc_feature 1..496: note = Synthetic polypeptide
  source 1..496: mol_type = other DNA

SEQ ID NO: 12627 - DNA, 385 bp, synthetic construct; identical to SEQ ID NO: 11229
  misc_feature 1..385: note = Synthetic polypeptide
  source 1..385: mol_type = other DNA

SEQ ID NO: 12628 - DNA, 385 bp, synthetic construct; identical to SEQ ID NO: 11229
  misc_feature 1..385: note = Synthetic polypeptide
  source 1..385: mol_type = other DNA

SEQ ID NO: 12629 - DNA, 385 bp, synthetic construct; identical to SEQ ID NO: 11229
  misc_feature 1..385: note = Synthetic polypeptide
  source 1..385: mol_type = other DNA

SEQ ID NO: 12630 - DNA, 418 bp, synthetic construct; identical to SEQ ID NO: 11223
  misc_feature 1..418: note = Synthetic polypeptide
  source 1..418: mol_type = other DNA

SEQ ID NO: 12631 - DNA, 418 bp, synthetic construct; identical to SEQ ID NO: 11223
  misc_feature 1..418: note = Synthetic polypeptide
  source 1..418: mol_type = other DNA

SEQ ID NO: 12632 - DNA, 418 bp, synthetic construct; identical to SEQ ID NO: 11223
  misc_feature 1..418: note = Synthetic polypeptide
  source 1..418: mol_type = other DNA

SEQ ID NO: 12633 - DNA, 418 bp, synthetic construct; identical to SEQ ID NO: 11223
  misc_feature 1..418: note = Synthetic polypeptide
  source 1..418: mol_type = other DNA

SEQ ID NO: 12634 - DNA, 418 bp, synthetic construct; identical to SEQ ID NO: 11223
  misc_feature 1..418: note = Synthetic polypeptide
  source 1..418: mol_type = other DNA

SEQ ID NO: 12635 - DNA, 1320 bp, synthetic construct; identical to SEQ ID NO: 8817
  misc_feature 1..1320: note = Synthetic polypeptide
  source 1..1320: mol_type = other DNA

SEQ ID NO: 12636 - DNA, 420 bp, synthetic construct; identical to SEQ ID NO: 8818
  misc_feature 1..420: note = Synthetic polypeptide
  source 1..420: mol_type = other DNA

SEQ ID NO: 12637 - DNA, 632 bp, synthetic construct; identical to SEQ ID NO: 9782
  misc_feature 1..632: note = Synthetic polypeptide
  source 1..632: mol_type = other DNA

SEQ ID NO: 12638 - DNA, 163 bp, synthetic construct; identical to SEQ ID NO: 480
  misc_feature 1..163: note = Synthetic polypeptide
  source 1..163: mol_type = other DNA

SEQ ID NO: 12639 - DNA, 104 bp, synthetic construct; identical to SEQ ID NO: 481
  misc_feature 1..104: note = Synthetic polypeptide
  source 1..104: mol_type = other DNA

SEQ ID NO: 12640 - DNA, 110 bp, synthetic construct
  misc_feature 1..110: note = Synthetic polypeptide
  source 1..110: mol_type = other DNA
ccaactcctcctctttctcctcctcctcagtctacacgaaaatgaaaatgacaacaatgaagacctttatgatgatctacttccacttaatgaatagtaagaggaagtga

SEQ ID NO: 12641 - DNA, 352 bp, synthetic construct; identical to SEQ ID NO: 8547
  misc_feature 1..352: note = Synthetic polypeptide
  source 1..352: mol_type = other DNA

SEQ ID NO: 12642 - DNA, 274 bp, synthetic construct; identical to SEQ ID NO: 8548
  misc_feature 1..274: note = Synthetic polypeptide
  source 1..274: mol_type = other DNA

SEQ ID NO: 12643 - DNA, 246 bp, synthetic construct; identical to SEQ ID NO: 8549
  misc_feature 1..246: note = Synthetic polypeptide
  source 1..246: mol_type = other DNA

SEQ ID NO: 12644 - DNA, 80 bp, synthetic construct; identical to SEQ ID NO: 6364
  misc_feature 1..80: note = Synthetic polypeptide
  source 1..80: mol_type = other DNA

SEQ ID NO: 12645 - DNA, 217 bp, synthetic construct; identical to SEQ ID NO: 6365
  misc_feature 1..217: note = Synthetic polypeptide
  source 1..217: mol_type = other DNA

SEQ ID NO: 12646 - DNA, 1791 bp, synthetic construct
  misc_feature 1..1791: note = Synthetic polypeptide
  source 1..1791: mol_type = other DNA
tttggccctgcctacctctgtaacctcatcctccacctacccagaactccttgcagctccttcccttttcaaaaattttatgcctttgtcacaatagcctctcttcctagaattcccacattcacctggaaaaatcctgctcatcctgtaaagcctgatttactgtcacctcctctgtcaagtcttcccttctgccctgccatgctcacccatgcccccgggcagagtccattactccttcctgcatacacttgtagaaggcacctgccatcttgctgcaacttgtctacctatctgtctcctcttctggtctttgagctgcttgaggacagggacaaagtctgcatcatctttgcatccccaggccctaaaactgcctggtttcagaagcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtggccagtgctgctgcagtcgcaggccctgaaatgcagactggccgaaataactttgtcatccggcggaacccagctgaccctcagcgcattccctccaacccttcccaccgtatccagtgtgcagcaggctacgagcaaagtgaacacaacgtgtgccaagacatagacgagtgcactgcagggacgcacaactgtagagcagaccaagtgtgcatcaatttacggggatcctttgcatgtcagtgccctcctggatatcagaagcgaggggagcagtgcgtagacatagatgaatgtaccatccctccatattgccaccaaagatgcgtgaatacaccaggctcattttattgccagtgcagtcctgggtttcaattggcagcaaacaactatacctgcgtagatataaatgaatgtgatgccagcaatcaatgtgctcagcagtgctacaacattcttggttcattcatctgtcagtgcaatcaaggatatgagctaagcagtgacaggctcaactgtgaagacattgatgaatgcagaacctcaagctacctgtgtcaatatcaatgtgtcaatgaacctgggaaattctcatgtatgtgcccccagggataccaagtggtgagaagtagaacatgtcaagatataaatgagtgtgagaccacaaatgaatgccgggaggatgaaatgtgttggaattatcatggcggcttccgttgttatccacgaaatccttgtcaagatccctacattctaacaccagagaaccgatgtgtttgcccagtctcaaatgccatgtgccgagaactgccccagtcaatagtctacaaatacatgagcatccgatctgataggtctgtgccatcagacatcttccagatacaggccacaactatttatgccaacaccatcaatacttttcggattaaatctggaaatgaaaatggagagttctacctacgacaaacaagtcctgtaagtgcaatgcttgtgctcgtgaagtcattatcaggaccaagagaacatatcgtggacctggagatgctgacagtcagcagtatagggaccttccgcacaagctctgtgttaagattgacaataatagtggggccattttcattttag

SEQ ID NO: 12647 - DNA, 826 bp, synthetic construct
  misc_feature 1..826: note = Synthetic polypeptide
  source 1..826: mol_type = other DNA
tttggccctgcctacctctgtaacctcatcctccacctacccagaactccttgcagctccttcccttttcaaaaattttatgcctttgtcacaatagcctctcttcctagaattcccacattcacctggaaaaatcctgctcatcctgtaaagcctgatttactgtcacctcctctgtcaagtcttcccttctgccctgccatgctcacccatgcccccgggcagagtccattactccttcctgcatacacttgtagaaggcacctgccatcttgctgcaacttgtctacctatctgtctcctcttctggtctttgagctgcttgaggacagggacaaagtctgcatcatctttgcatccccaggccctaaaactgcctggtttcagaagcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtggccagtgctgctgcagtcgcaggccctgaaatgcagactggccgaaataactttgtcatccggcggaacccagctgaccctcagcgcattccctccaacccttcccaccgtatccagtgtgcagcaggctacgagcaaagtgaacacaacgtgtgccaag

SEQ ID NO: 12648 - DNA, 666 bp, synthetic construct
  misc_feature 1..666: note = Synthetic polypeptide
  source 1..666: mol_type = other DNA
tttggccctgcctacctctgtaacctcatcctccacctacccagaactccttgcagctccttcccttttcaaaaattttatgcctttgtcacaatagcctctcttcctagaattcccacattcacctggaaaaatcctgctcatcctgtaaagcctgatttactgtcacctcctctgtcaagtcttcccttctgccctgccatgctcacccatgcccccgggcagagtccattactccttcctgcatacacttgtagaaggcacctgccatcttgctgcaacttgtctacctatctgtctcctcttctggtctttgagctgcttgaggacagggacaaagtctgcatcatctttgcatccccaggccctaaaactgcctggtttcagaagcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtg

SEQ ID NO: 12649 - DNA, 627 bp, synthetic construct
  misc_feature 1..627: note = Synthetic polypeptide
  source 1..627: mol_type = other DNA
tttggccctgcctacctctgtaacctcatcctccacctacccagaactccttgcagctccttcccttttcaaaaattttatgcctttgtcacaatagcctctcttcctagaattcccacattcacctggaaaaatcctgctcatcctgtaaagcctgatttactgtcacctcctctgtcaagtcttcccttctgccctgccatgctcacccatgcccccgggcagagtccattactccttcctgcatacacttgtagaaggcacctgccatcttgctgcaacttgtctacctatctgtctcctcttctggtctttgagctgcttgaggacagggacaaagtctgcatcatctttgcatccccaggccctaaaactgcctggtttcagaagcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagc

SEQ ID NO: 12650 - DNA, 570 bp, synthetic construct
  misc_feature 1..570: note = Synthetic polypeptide
  source 1..570: mol_type = other DNA
tttggccctgcctacctctgtaacctcatcctccacctacccagaactccttgcagctccttcccttttcaaaaattttatgcctttgtcacaatagcctctcttcctagaattcccacattcacctggaaaaatcctgctcatcctgtaaagcctgatttactgtcacctcctctgtcaagtcttcccttctgccctgccatgctcacccatgcccccgggcagagtccattactccttcctgcatacacttgtagaaggcacctgccatcttgctgcaacttgtctacctatctgtctcctcttctggtctttgagctgcttgaggacagggacaaagtctgcatcatctttgcatccccaggccctaaaactgcctggtttcagaagcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaa

SEQ ID NO: 12651 - DNA, 494 bp, synthetic construct
  misc_feature 1..494: note = Synthetic polypeptide
  source 1..494: mol_type = other DNA
tttggccctgcctacctctgtaacctcatcctccacctacccagaactccttgcagctccttcccttttcaaaaattttatgcctttgtcacaatagcctctcttcctagaattcccacattcacctggaaaaatcctgctcatcctgtaaagcctgatttactgtcacctcctctgtcaagtcttcccttctgccctgccatgctcacccatgcccccgggcagagtccattactccttcctgcatacacttgtagaaggcacctgccatcttgctgcaacttgtctacctatctgtctcctcttctggtctttgagctgcttgaggacagggacaaagtctgcatcatctttgcatccccaggccctaaaactgcctggtttcagaagcaatgcactgacggatatgagtgggatcctgtgagacagcaatgcaaagatattgatgaatgtgacattgtcccagacgcttgtaaaggtggaatgaagtgtgt

SEQ ID NO: 12652 - DNA, 464 bp, synthetic construct
  misc_feature 1..464: note = Synthetic polypeptide
  source 1..464: mol_type = other DNA
tttggccctgcctacctctgtaacctcatcctccacctacccagaactccttgcagctccttcccttttcaaaaattttatgcctttgtcacaatagcctctcttcctagaattcccacattcacctggaaaaatcctgctcatcctgtaaagcctgatttactgtcacctcctctgtcaagtcttcccttctgccctgccatgctcacccatgcccccgggcagagtccattactccttcctgcatacacttgtagaaggcacctgccatcttgctgcaacttgtctacctatctgtctcctcttctggtctttgagctgcttgaggacagggacaaagtctgcatcatctttgcatccccaggccctaaaactgcctggtttcagaagcaatgcactgacggatatgagtgggatcctgtgagacagcaatgcaaagatattgatgaatgtgacattgtccc

SEQ ID NO: 12653 - DNA, 596 bp, synthetic construct
  misc_feature 1..596: note = Synthetic polypeptide
  source 1..596: mol_type = other DNA
tgatatggtttggatttttgtctctgcccgaatctcatgttgaattataattcccagtgttggaggaggggcctggtatgagacgattggaccgcaggggtggatttccttcttgctgttctcgtgataatgagttgataaaaattaaagagtgggtggacaagtatgacccaggtgctttggtcattccttttagtggggccttggaactcaagttgcaagaattgagtgctgaggagagacagaagtatctggaagcgaacatgacacaaagtgctttgccaaagatcattaaggctgggtttgcagcactccaactagaatactttttcactgcaggcccagatgaagtgcgtgcatggaccatcaggaaagggactaaggctcctcaggctgcaggaaagattcacacagattttgaaaagggattcattatggctgaagtaatgaaatacgaagattttaaagaggaaggttctgaaaatgcagtcaaggctgctggaaagtacagacaacaaggcagaaattatattgttgaagatggagatattatcttcttcaaatttaacacacctcaacaaccgaagaagaaataa

SEQ ID NO: 12654 - DNA, 188 bp, synthetic construct
  misc_feature 1..188: note = Synthetic polypeptide
  source 1..188: mol_type = other DNA
tgatatggtttggatttttgtctctgcccgaatctcatgttgaattataattcccagtgttggaggaggggcctggtatgagacgattggaccgcaggggtggatttccttcttgctgttctcgtgataatgagttgataaaaattaaagagtgggtggacaagtatgacccaggtgctttggtcatt

SEQ ID NO: 12655 - DNA, 459 bp, synthetic construct; identical to SEQ ID NO: 6510
  misc_feature 1..459: note = Synthetic polypeptide
  source 1..459: mol_type = other DNA

SEQ ID NO: 12656 - DNA, 504 bp, synthetic construct; identical to SEQ ID NO: 6511
  misc_feature 1..504: note = Synthetic polypeptide
  source 1..504: mol_type = other DNA

SEQ ID NO: 12657 - DNA, 3887 bp, synthetic construct
  misc_feature 1..3887: note = Synthetic polypeptide
  source 1..3887: mol_type = other DNA
agacagacctaggtccacatctcagctctgccactcagcagccctgagctcttggtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagcttctggctagcaaggaggacgaggacacgatcaaaattggggaggatgacgagattaatttcctgagtgaccagcatttgcagcagagtaatgagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctga

SEQ ID NO: 12658 - DNA, 3914 bp, synthetic construct
  misc_feature 1..3914: note = Synthetic polypeptide
  source 1..3914: mol_type = other DNA
agacagacctaggtccacatctcagctctgccactcagcagccctgagctcttggtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctga

SEQ ID NO: 12659 - DNA, 4010 bp, synthetic construct
  misc_feature 1..4010: note = Synthetic polypeptide
  source 1..4010: mol_type = other DNA
agacagacctaggtccacatctcagctctgccactcagcagccctgagctcttggtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagcttctggctagcaaggaggacgaggacacgatcaaaattggggaggatgacgagattaatttcctgagtgaccagcatttgcagcagagtaatgagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctga

SEQ ID NO: 12660 - DNA, 3773 bp, synthetic construct
  misc_feature 1..3773: note = Synthetic polypeptide
  source 1..3773: mol_type = other DNA
agacagacctaggtccacatctcagctctgccactcagcagccctgagctcttggtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagcttctggctagcaaggaggacgaggacacgatcaaaattggggaggatgacgagattaatttcctgagtgaccagcatttgcagcagagtaatgagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctga

SEQ ID NO: 12661 - DNA, 581 bp, synthetic construct
  misc_feature 1..581: note = Synthetic polypeptide
  source 1..581: mol_type = other DNA
agacagacctaggtccacatctcagctctgccactcagcagccctgagctcttggtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagacatcactgacttattcatacatattcatgctgcacacttttttgggttgcattttcacaccattccatgctccatgtagcttctggctagcaaggaggacgaggacacgatcaaaattggggaggatgacgagattaatttcctga

SEQ ID NO: 12662 - DNA, 354 bp, synthetic construct
  misc_feature 1..354: note = Synthetic polypeptide
  source 1..354: mol_type = other DNA
atcagccgggcgtggtggttcacgcctgtaatcccagcactttgggaggctgaggcaggagaatggcttgaacctgggacgtagaggttgcaatgagccaagattgcgccattgcactccagcctgggcaacagagtcagactccgtctcagaaaaaagtaccttctggatacctccacatggtccgagtgcactgaacccaagcacattgtggaatggaatgtatctctgttttctatcctcttggctcttggtggaattgaattcatcttgtgtcttattcaagtaataaatggagtgcttggaggcatatgtggcttttgctgctctcaccaacagcaatatgactgctaa

SEQ ID NO: 12663 - DNA, 366 bp, synthetic construct
  misc_feature 1..366: note = Synthetic polypeptide
  source 1..366: mol_type = other DNA
atcagccgggcgtggtggttcacgcctgtaatcccagcactttgggaggctgaggcaggagaatggcttgaacctgggacgtagaggttgcaatgagccaagattgcgccattgcactccagcctgggcaacagagtcagactccgtctcagaaaaaagtaccttctggatacctccacatggtccgagtgcactgaacccaagcacattgtggaatggaatgtatctctgttttctatcctcttggctcttggtggaattgaattcatcttgtgtcttattcaagtaataaatggagtgcttggaggcatatgtggcttttgctgctctcaccaacaggtaagaacctgcatgaaaatgtcgtag

SEQ ID NO: 12664 - DNA, 197 bp, synthetic construct
  misc_feature 1..197: note = Synthetic polypeptide
  source 1..197: mol_type = other DNA
atcagccgggcgtggtggttcacgcctgtaatcccagcactttgggaggctgaggcaggagaatggcttgaacctgggacgtagaggttgcaatgagccaagattgcgccattgcactccagcctgggcaacagagtcagactccgtctcagaaaaaagtaccttctggatacctccacatggtccgagtgcactga

SEQ ID NO: 12665 - DNA, 921 bp, synthetic construct; identical to SEQ ID NO: 8805
  misc_feature 1..921: note = Synthetic polypeptide
  source 1..921: mol_type = other DNA

SEQ ID NO: 12666 - DNA, 389 bp, synthetic construct
  misc_feature 1..389: note = Synthetic polypeptide
  source 1..389: mol_type = other DNA
ctcagtgggacatctcgcccgtcctgaaggaccccgcctccttccgcgccgccatcggcctcctggcgcgacacctgaaggcgacccacgggggccgcatcgactacatcgcaggcgagtgcccagtggccgcatctagggcgcttccgcctctgcgcgcgccgagggctgagctggagattcagaaagacgccctggagccaggacagagggtggtcgtcgtggatgatctgctggccactggtggaaccatgaacgctgcctgtgagctgctgggccgcctgcaggctgaggtcctggagtgcgtgagcctggtggagctgacctcgcttaagggcagggagaagctggcacctgtacccttcttctctctcctgcagtatgagtga

SEQ ID NO: 12667 - DNA, 470 bp, synthetic construct
  misc_feature 1..470: note = Synthetic polypeptide
  source 1..470: mol_type = other DNA
ctcagtgggacatctcgcccgtcctgaaggaccccgcctccttccgcgccgccatcggcctcctggcgcgacacctgaaggcgacccacgggggccgcatcgactacatcgcaggcctagactcccgaggcttcctctttggcccctccctggcccaggagcttggactgggctgcgtgctcatccgaaagcgggggaagctgccaggccccactctgtgggcctcctattccctggagtacgggaaggctgagctggagattcagaaagacgccctggagccaggacagagggtggtcgtcgtggatgatctgctggccactggtggaaccatgaacgctgcctgtgagctgctgggccgcctgcaggctgaggtcctggagtgcgtgagcctggtggagctgacctcgcttaagggcagggagaagctggcacctgtacccttcttctctctcctgcagtatgagtga

SEQ ID NO: 12668 - DNA, 373 bp, synthetic construct
  misc_feature 1..373: note = Synthetic polypeptide
  source 1..373: mol_type = other DNA
ctcagtgggacatctcgcccgtcctgaaggaccccgcctccttccgcgccgccatcggcctcctggcgcgacacctgaaggcgacccacgggggccgcatcgactacatcgcaggcctagactcccgaggcttcctctttggcccctccctggcccaggagcttggactgggctgcgtgctcatccgaaagcgggggaagctgccaggccccactctgtgggcctcctattccctggagtacgggaagctgtgtttcagccacactgaacccaattacacacagcgggagaacgcagtaaacagctttcccacaagagccgtctcctgtcctcctgttccccagggcagggagccccaggacaacaccagact

SEQ ID NO: 12669 - DNA, 332 bp, synthetic construct
  misc_feature 1..332: note = Synthetic polypeptide
  source 1..332: mol_type = other DNA
ctcagtgggacatctcgcccgtcctgaaggaccccgcctccttccgcgccgccatcggcctcctggcgcgacacctgaaggcgacccacgggggccgcatcgactacatcgcaggcctagactcccgaggcttcctctttggcccctccctggcccaggagcttggactgggctgcgtgctcatccgaaagcgggggaagctgccaggccccactctgtgggcctcctattccctggagtacgggaaggctgagctggagattcagaaagacgccctggagccaggacagagggtggtcgtcgtggatgatctgctggccactggtgtatga

SEQ ID NO: 12670 - DNA, 119 bp, synthetic construct
  misc_feature 1..119: note = Synthetic polypeptide
  source 1..119: mol_type = other DNA
ctcagtgggacatctcgcccgtcctgaaggaccccgcctccttccgcgccgccatcggcctcctggcgcgacacctgaaggcgacccacgggggccgcatcgactacatcgcaggctga

SEQ ID NO: 12671 - DNA, 416 bp, synthetic construct
  misc_feature 1..416: note = Synthetic polypeptide
  source 1..416: mol_type = other DNA
ctcagtgggacatctcgcccgtcctgaaggaccccgcctccttccgcgccgccatcggcctcctggcgcgacacctgaaggcgacccacgggggccgcatcgactacatcgcaggcctagactcccgaggcttcctctttggcccctccctggcccaggagcttggactgggctgcgtgctcatccgaaagcgggggaagctgccaggccccactctgtgggcctcctattccctggagtacgggaaggctgagctggagattcagaaagacgccctggagccaggacagagggtggtcgtcgtggatgatctgctggccactggtggggctggcctggagcacctgctctctgcagcccaggccaactggggacctcaccctcccatccccaggaaccatgaacgctgcctgtga

SEQ ID NO: 12672 - DNA, 753 bp, synthetic construct; identical to SEQ ID NO: 7919
  misc_feature 1..753: note = Synthetic polypeptide
  source 1..753: mol_type = other DNA

SEQ ID NO: 12673 - DNA, 873 bp, synthetic construct; identical to SEQ ID NO: 7920
  misc_feature 1..873: note = Synthetic polypeptide
  source 1..873: mol_type = other DNA

SEQ ID NO: 12674 - DNA, 964 bp, synthetic construct
  misc_feature 1..964: note = Synthetic polypeptide
  source 1..964: mol_type = other DNA
ttctcttgattttgccgcttaagtagctgttgaatctgcgaattccctatgtcctggctataactcctctagtttagaatattgtcatttgatgcctggattattgcagcagaaggccttacgaccggatatgggctataatacattagccaactttcgaatagaaaagaaaattggtcgcggacaatttagtgaagtttatagagcagcctgtctcttggatggagtaccagtagctttaaaaaaagtgcagatatttgatttaatggatgccaaagcacgtgctgattgcatcaaagaaatagatcttcttaagcaactcaaccatccaaatgtaataaaatattatgcatcattcattgaagataatgaactaaacatagttttggaactagcagatgctggcgacctatccagaatgatcaagcattttaagaagcaaaagaggctaattcctgaaagaactgtttggaagtattttgttcagctttgcagtgcattggaacacatgcattctcgaagagtcatgcatagagatataaaaccagctaatgtgttcattacagccactggggtggtaaaacttggagatcttgggcttggccggtttttcagctcaaaaaccacagctgcacattctttagttggtacgccttattacatgtctccagagagaatacatgaaaatggatacaacttcaaatctgacatctggtctcttggctgtctactatatgagatggctgcattacaaagtcctttctatggtgacaaaatgaatttatactcactgtgtaagaagatagaacagtgtgactacccacctcttccttcagatcactattcagaagaactccgacagttagttaatatgtgcatcaacccagatccagagaagcgaccagacgtcacctatgtttatgacgtagcaaagaggatgcatgcatgcactgcaagcagctaa

SEQ ID NO: 12675 - DNA, 151 bp, synthetic construct
  misc_feature 1..151: note = Synthetic polypeptide
  source 1..151: mol_type = other DNA
ttctcttgattttgccgcttaagtagctgttgaatctgcgaattccctatgtcctggctataactcctctagtttagaatattgtcatttgatgcctggattattgcagcagaaggccttacgaccggatatgggctataatacattagcc

SEQ ID NO: 12676 - DNA, 415 bp, synthetic construct
  misc_feature 1..415: note = Synthetic polypeptide
  source 1..415: mol_type = other DNA
ttctcttgattttgccgcttaagtagctgttgaatctgcgaattccctatgtcctggctataactcctctagtttagaatattgtcatttgatgcctggattattgcagcagaaggccttacgaccggatatgggctataatacattagccaactttcgaatagaaaagaaaattggtcgcggacaatttagtgaagtttatagagcagcctgtctcttggatggagtaccagtagctttaaaaaaagtgcaggtttgcctgttacctgtatgggaaagaagagtgtgtgcgctaaatgcatgttacttcttggaaatcataaagggatctgagagcctacagtatatggcaacattaaccaatctttttgaaaatttacctgtatcccatcatggttcatttgcaaaaaaataa

SEQ ID NO: 12677 - DNA, 241 bp, synthetic construct
  misc_feature 1..241: note = Synthetic polypeptide
  source 1..241: mol_type = other DNA
ttctcttgattttgccgcttaagtagctgttgaatctgcgaattccctatgtcctggctataactcctctagtttagaatattgtcatttgatgcctggattattgcagcagaaggccttacgaccggatatgggctataatacattagccaactttcgaatagaaaagaaaattggtcgcggacaatttagtgaagtttatagagcagcctgtctcttggatggagtaccagtagcttta

SEQ ID NO: 12678 - DNA, 302 bp, synthetic construct
  misc_feature 1..302: note = Synthetic polypeptide
  source 1..302: mol_type = other DNA
ttctcttgattttgccgcttaagtagctgttgaatctgcgaattccctatgtcctggctataactcctctagtttagaatattgtcatttgatgcctggattattgcagcagaaggccttacgaccggatatgggctataatacattagccaactttcgaatagaaaagaaaattggtcgcggacaatttagtgaagtttatagagcagcctgtctcttggatggagtaccagtagctttaaaaaaagtgcagatatttgatttaatggatgccaaagcacgtgctgattgcatcaaagaaa

SEQ ID NO: 12679 - DNA, 554 bp, synthetic construct
  misc_feature 1..554: note = Synthetic polypeptide
  source 1..554: mol_type = other DNA
aaatataaaaggtaaattatagagttagtagaaaatcatatagggcaatatctttgttaggagcagggaaaaacttcttgatgaaacttcaaatataaatcgtaagaaacttcaaatataaatcgtaaggccaaaaacattcatgaattaaattacattaaaaataaaacttctttcagcaaaggactacatggaaaaagatagatgatacttgttcgtcttttctgtccattgattctcagcctcaggcatccaacgcactggaggagctttgctttatgattatgggaatgctaccaaagcctcaggaacaagatgaaaaagataatactaaaaggttcttatttcattattcgaagacacagaagttgggcaagtcaaatgttgtgtcgtcagttgtgcatccgttgctgcagctcgttcctcacctgcatgagagaagaatgaagagattcagagtggacgaagaattccaaagtccctttgcaagtcaaagtcgaggatattttttattcaggccacggaatggaagaaggtcagcagggttcatttaa

SEQ ID NO: 12680 - DNA, 473 bp, synthetic construct
  misc_feature 1..473: note = Synthetic polypeptide
  source 1..473: mol_type = other DNA
aaatataaaaggtaaattatagagttagtagaaaatcatatagggcaatatctttgttaggagcagggaaaaacttcttgatgaaacttcaaatataaatcgtaagaaacttcaaatataaatcgtaaggccaaaaacattcatgaattaaattacattaaaaataaaacttctttcagcaaaggactacatggaaaaagatagatgatacttgttcgtcttttctgtccattgattctcagcctcaggcatccaacgcactggaggagctttgctttatgattatgggaatgctaccaaagcctcagtcgtcagttgtgcatccgttgctgcagctcgttcctcacctgcatgagagaagaatgaagagattcagagtggacgaagaattccaaagtccctttgcaagtcaaagtcgaggatattttttattcaggccacggaatggaagaaggtcagcagggttcatttaa

SEQ ID NO: 12681 - DNA, 479 bp, synthetic construct
  misc_feature 1..479: note = Synthetic polypeptide
  source 1..479: mol_type = other DNA
aaatataaaaggtaaattatagagttagtagaaaatcatatagggcaatatctttgttaggagcagggaaaaacttcttgatgaaacttcaaatataaatcgtaagaaacttcaaatataaatcgtaaggccaaaaacattcatgaattaaattacattaaaaataaaacttctttcagcaaaggactacatggaaaaagatagatgatacttgttcgtcttttctgtccattgattctcagcctcaggcatccaacgcactggaggagctttgctttatgattatgggaatgctaccaaagcctcaggaacaagatgaaaaagataatactaaaaggttcttatttcattattcgaagacacagaagttgggcaagtcaaatgttgtggaagaattccaaagtccctttgcaagtcaaagtcgaggatattttttattcaggccacggaatggaagaaggtcagcagggttcatttaa

SEQ ID NO: 12682 - DNA, 3055 bp, synthetic construct; identical to SEQ ID NO: 709
  misc_feature 1..3055: note = Synthetic polypeptide
  source 1..3055: mol_type = other DNA

SEQ ID NO: 12683 - DNA, 3058 bp, synthetic construct; identical to SEQ ID NO: 710
  misc_feature 1..3058: note = Synthetic polypeptide
  source 1..3058: mol_type = other DNA

SEQ ID NO: 12684 - DNA, 287 bp, synthetic construct
  misc_feature 1..287: note = Synthetic polypeptide
  source 1..287: mol_type = other DNA
ggccaggcgtgggattcacacctttaatcccagcaccttgggaggctgaggtgggatgatcacttgagtccaggagtttgacaccagctgggcagcataatccagctagcgggagcagcatcgactgggcatatgacaacggcatcaaatttgcattcacatttgagttgagagataccgggacctatggcttcctcctgccagctaaccagatcatccccactgcagaggagacgtggctggggctgaagaccatcatggagcatgtgcgggacaacctctactag

SEQ ID NO: 12685 - DNA, 892 bp, synthetic construct
  misc_feature 1..892: note = Synthetic polypeptide
  source 1..892: mol_type = other DNA
agaaatatgtgagcaatttgatgcggatctcagagagcctcgtggaagtaatggcgctgagagatggcgcctggggaagaaagaggagacaaggatagtattctggccccagaagaaactatgagaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcattcgcaacgacaggcgcctcctctgccaaccggtttgtcagcatcggaccccgggacggcaactttctga

SEQ ID NO: 12686 - DNA, 1075 bp, synthetic construct
  misc_feature 1..1075: note = Synthetic polypeptide
  source 1..1075: mol_type = other DNA
agaaatatgtgagcaatttgatgcggatctcagagagcctcgtggaagtaatggcgctgagagatggcgcctggggaagaaagaggagacaaggatagtattctggccccagaagaaactatgagaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcccaacggtagcggccagggcaaagtcccggggtcatttttgctaccgccgccgcctccagtggccagacctgtgccccttcctatgcctgattccaaatccaccagcactgccccagacggcgccgccttgactcctccatcaccttcattcgcaacgacaggcgcctcctctgccaaccggtttgtcagcatcggaccccgggacggcaactttctgaacatcccacagcagtctcagtcctggttcctctga

SEQ ID NO: 12687 - DNA, 197 bp, synthetic construct
  misc_feature 1..197: note = Synthetic polypeptide
  source 1..197: mol_type = other DNA
agaaatatgtgagcaatttgatgcggatctcagagagcctcgtggaagtaatggcgctgagagatggcgcctggggaagaaagaggagacaaggatagtattctggccccagaagaaactatgagaatccggacaatcagatagttcaaaccagcaaggagatgcggacatcaaaccactgcccaacgggcacttaa

SEQ ID NO: 12688 - DNA, 769 bp, synthetic construct
  misc_feature 1..769: note = Synthetic polypeptide
  source 1..769: mol_type = other DNA
agaaatatgtgagcaatttgatgcggatctcagagagcctcgtggaagtaatggcgctgagagatggcgcctggggaagaaagaggagacaaggatagtattctggccccagaagaaactatgagaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcattcgcaacgacaggcgcctcctctgccaaccggtttgtcagcatcggaccccgggacggcaactttctga

SEQ ID NO: 12689 - DNA, 952 bp, synthetic construct
  misc_feature 1..952: note = Synthetic polypeptide
  source 1..952: mol_type = other DNA
agaaatatgtgagcaatttgatgcggatctcagagagcctcgtggaagtaatggcgctgagagatggcgcctggggaagaaagaggagacaaggatagtattctggccccagaagaaactatgagaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcccaacggtagcggccagggcaaagtcccggggtcatttttgctaccgccgccgcctccagtggccagacctgtgccccttcctatgcctgattccaaatccaccagcactgccccagacggcgccgccttgactcctccatcaccttcattcgcaacgacaggcgcctcctctgccaaccggtttgtcagcatcggaccccgggacggcaactttctgaacatcccacagcagtctcagtcctggttcctctga

SEQ ID NO: 12690 - DNA, 1515 bp, synthetic construct
  misc_feature 1..1515: note = Synthetic polypeptide
  source 1..1515: mol_type = other DNA
tgatatggtttggctctgtgtccccactcaaatctcaccttgaattgtaacaattcctatgtgtcgtgggaggaacctggtgggagggaattgaatcatgagggtgagtctctttcccgtgctgttcccatggcagtgaataagtctcacgagatctgatggttttataaataggagttcccctacacaagctctctctcgcctgctgccatgcaagacgtgactttgcttctccttccccttctgccatgatttgtgatgcctcctcagccatgtggaactgtatccctcatgggcttcctgttccttttgggcttatacatctcgtccctggcttcctgcatgggaggactttatggagctccccgcatcctgcagtgcattgcccaggagaaagtgatccctgcacttgcctgtctgggacaagggaaggggccaaacaaaacacccgtggctgccatctgcctgaccagcttggtgaccatggcctttgtttttgtgggtcaagtgaacgttctggcccccatcgtcaccatcaacttcatgctgacatacgttgcagtggactactcttacttctccctgtccatgtgttcctgcagcctgaccccggtgcctgagccggtgctcagggagggcgcagaaggcctccactgctctgagcacctgctcttagagaaagctcccagttacggctctgagggacctgcccaaagagtcttggagggcacgctactggaattcaccaaggacatggatcagctcctccagctaaccaggaagcttgagagtagccagcccaggcaaggagagggtaacaggaccccagaaagtcagaagaggaaaagcaagaaggccaccaagcagaccctacaagatagcttcctcttggacctcaaatcccctccttctttccctgtcgagatctctgacaggttgcccgctgcctcctgggaggggcaggagtcctgctggaacaagcagacttccaagagcgaagggactcagcctgagggaacatatggagagcaacttgttcctgagctgtgcaaccaatcagagtccagtggagaagatttcttcctgaagtccaggctccaagaacaagatgtctggagaagatccacttctttctatacccacatgtgcaacccctgggtctccctgttgggggctgttgggtcccttctcatcatgtttgtgatacagtgggtgtataccctggttaacatgggtgttgctgccatcgtgtatttctacattggccgggccagtccagggcttcaccttggatcagcctccaacttcagctttttccggtggatgaggtctctcttgctcccctcctgcaggagcttgcggtcccctcaggagcagatcatcttggcgccgtccctggctaaggttgacatggagatgactcagctcacccaggagaatgcagacttcgccactcgggatcgctaccaccactcctccctcgtgaaccgggagcagctgatgcctcactactag

SEQ ID NO: 12691 - DNA, 1239 bp, synthetic construct
  misc_feature 1..1239: note = Synthetic polypeptide
  source 1..1239: mol_type = other DNA
tgatatggtttggctctgtgtccccactcaaatctcaccttgaattgtaacaattcctatgtgtcgtgggaggaacctggtgggagggaattgaatcatgagggtgagtctctttcccgtgctgttcccatggcagtgaataagtctcacgagatctgatggttttataaataggagttcccctacacaagctctctctcgcctgctgccatgcaagacgtgactttgcttctccttccccttctgccatgatttgtgatgcctcctcagccatgtggaactgtatccctcatgggcttcctgttccttttgggcttatacatctcgtccctggcttcctgcatgggaggactttatggagctccccgcatcctgcagtgcattgcccaggagaaagtgatccctgcacttgcctgtctgggacaagggaaggggccaaacaaaacacccgtggctgccatctgcctgaccagcttggtgaccatggcctttgtttttgtgggtcaagtgaacgttctggcccccatcgtcaccatcaacttcatgctgacatacgttgcagtggactactcttacttctccctgtccatgtgttcctgcagcctgaccccggtgcctgagccggtgctcagggagggcgcagaaggcctccactgctctgagcacctgctcttagagaaagctcccagttacggctctgagggacctgcccaaagagtcttggagggcacgctactggaattcaccaaggacatggatcagctcctccagctaaccaggaagcttgagagtagccagcccaggcaaggagagggtaacaggaccccagaaagtcagaagaggaaaagcaagaaggccaccaagcagaccctacaagatagcttcctcttggacctcaaatcccctccttctttccctgtcgagatctctgacaggttgcccgctgcctcctgggaggggcaggagtcctgctggaacaagcagacttccaagagcgaagggactcagcctgagggaacatatggagagcaacttgttcctgagctgtgcaaccaatcagagtccagtggagaaggtgacttgcggtcccctcaggagcagatcatcttggcgccgtccctggctaaggttgacatggagatgactcagctcacccaggagaatgcagacttcgccactcgggatcgctaccaccactcctccctcgtgaaccgggagcagctgatgcctcactactag

SEQ ID NO: 12692 - DNA, 346 bp, synthetic construct
  misc_feature 1..346: note = Synthetic polypeptide
  source 1..346: mol_type = other DNA
tgatatggtttggctctgtgtccccactcaaatctcaccttgaattgtaacaattcctatgtgtcgtgggaggaacctggtgggagggaattgaatcatgagggtgagtctctttcccgtgctgttcccatggcagtgaataagtctcacgagatctgatggttttataaataggagttcccctacacaagctctctctcgcctgctgccatgcaagacgtgactttgcttctccttccccttctgccatgatttgtgatgcctcctcagccatgtggaactgtatccctcatgggcttcctgttccttttgggcttatacatctcgtccctggcttcctgcatgg

SEQ ID NO: 12693 - DNA, 1443 bp, synthetic construct
  misc_feature 1..1443: note = Synthetic polypeptide
  source 1..1443: mol_type = other DNA
gggttttagttcacactgtgccacccacacaagcaggctgggtaaccttgggtctatttctgaccttttagaatattgtttctctctgtaccacaggaagaagcttctctgcccttcattgggtggtttctgtacatcatcttcgtcttcctcctgggcgccatctgcactcgagaggcccttcgctatgacttcctgatagcggaaaaggtatccctcatgggcttcctgttccttttgggcttatacatctcgtccctggcttcctgcatgggaggactttatggagctccccgcatcctgcagtgcattgcccaggagaaagtgatccctgcacttgcctgtctgggacaagggaaggggccaaacaaaacacccgtggctgccatctgcctgaccagcttggtgaccatggcctttgtttttgtgggtcaagtgaacgttctggcccccatcgtcaccatcaacttcatgctgacatacgttgcagtggactactcttacttctccctgtccatgtgttcctgcagcctgaccccggtgcctgagccggtgctcagggagggcgcagaaggcctccactgctctgagcacctgctcttagagaaagctcccagttacggctctgagggacctgcccaaagagtcttggagggcacgctactggaattcaccaaggacatggatcagctcctccagctaaccaggaagcttgagagtagccagcccaggcaaggagagggtaacaggaccccagaaagtcagaagaggaaaagcaagaaggccaccaagcagaccctacaagatagcttcctcttggacctcaaatcccctccttctttccctgtcgagatctctgacaggttgcccgctgcctcctgggaggggcaggagtcctgctggaacaagcagacttccaagagcgaagggactcagcctgagggaacatatggagagcaacttgttcctgagctgtgcaaccaatcagagtccagtggagaagatttcttcctgaagtccaggctccaagaacaagatgtctggagaagatccacttctttctatacccacatgtgcaacccctgggtctccctgttgggggctgttgggtcccttctcatcatgtttgtgatacagtgggtgtataccctggttaacatgggtgttgctgccatcgtgtatttctacattggccgggccagtccagggcttcaccttggatcagcctccaacttcagctttttccggtggatgaggtctctcttgctcccctcctgcaggagcttgcggtcccctcaggagcagatcatcttggcgccgtccctggctaaggttgacatggagatgactcagctcacccaggagaatgcagacttcgccactcgggatcgctaccaccactcctccctcgtgaaccgggagcagctgatgcctcactactag

SEQ ID NO: 12694 - DNA, 1167 bp, synthetic construct
  misc_feature 1..1167: note = Synthetic polypeptide
  source 1..1167: mol_type = other DNA
gggttttagttcacactgtgccacccacacaagcaggctgggtaaccttgggtctatttctgaccttttagaatattgtttctctctgtaccacaggaagaagcttctctgcccttcattgggtggtttctgtacatcatcttcgtcttcctcctgggcgccatctgcactcgagaggcccttcgctatgacttcctgatagcggaaaaggtatccctcatgggcttcctgttccttttgggcttatacatctcgtccctggcttcctgcatgggaggactttatggagctccccgcatcctgcagtgcattgcccaggagaaagtgatccctgcacttgcctgtctgggacaagggaaggggccaaacaaaacacccgtggctgccatctgcctgaccagcttggtgaccatggcctttgtttttgtgggtcaagtgaacgttctggcccccatcgtcaccatcaacttcatgctgacatacgttgcagtggactactcttacttctccctgtccatgtgttcctgcagcctgaccccggtgcctgagccggtgctcagggagggcgcagaaggcctccactgctctgagcacctgctcttagagaaagctcccagttacggctctgagggacctgcccaaagagtcttggagggcacgctactggaattcaccaaggacatggatcagctcctccagctaaccaggaagcttgagagtagccagcccaggcaaggagagggtaacaggaccccagaaagtcagaagaggaaaagcaagaaggccaccaagcagaccctacaagatagcttcctcttggacctcaaatcccctccttctttccctgtcgagatctctgacaggttgcccgctgcctcctgggaggggcaggagtcctgctggaacaagcagacttccaagagcgaagggactcagcctgagggaacatatggagagcaacttgttcctgagctgtgcaaccaatcagagtccagtggagaaggtgacttgcggtcccctcaggagcagatcatcttggcgccgtccctggctaaggttgacatggagatgactcagctcacccaggagaatgcagacttcgccactcgggatcgctaccaccactcctccctcgtgaaccgggagcagctgatgcctcactactag

SEQ ID NO: 12695 - DNA, 274 bp, synthetic construct
  misc_feature 1..274: note = Synthetic polypeptide
  source 1..274: mol_type = other DNA
gggttttagttcacactgtgccacccacacaagcaggctgggtaaccttgggtctatttctgaccttttagaatattgtttctctctgtaccacaggaagaagcttctctgcccttcattgggtggtttctgtacatcatcttcgtcttcctcctgggcgccatctgcactcgagaggcccttcgctatgacttcctgatagcggaaaaggtatccctcatgggcttcctgttccttttgggcttatacatctcgtccctggcttcctgcatgg

SEQ ID NO: 12696 - DNA, 2289 bp, synthetic construct
  misc_feature 1..2289: note = Synthetic polypeptide
  source 1..2289: mol_type = other DNA
tggaatgggttcccttgagaggcagtgaggtccctgttcctggaagcattcaagtagagctggtgatggctgggctgccccaagggctactatggcaagcactgtcgcaagaaatgcaactgtgccaaccggggccggtgccaccgcctctacggggcctgcctctgcgacccagggctctacggccgcttctgccacctcacctgcccgccgtgggcctttgggccgggctgctcggaggagtgccagtgtgtgcagccccacacgcagtcctgtgacaagagggatggcagctgctcctgcaaggctggcttccggggcgagcgctgtcaggcagagtgtgagctgggctactttgggccggggtgctggcaggcatgcacctgcccagtgggcgtggcctgtgactccgtgagcggcgagtgtgggaagcggtgtcctgctggcttccagggagaggactgtggccaagagtgcccggtggggacgtttggcgtgaactgctcgagctcctgctcctgtgggggggccccctgccacggggtcacggggcagtgccggtgtccgccggggaggactggggaagactgtgaggcagattgtcccgagggccgctgggggctgggctgccaggagatctgcccagcatgccagcacgctgcccgctgcgaccctgagaccggagcctgcctgtgcctccctggcttcgtcggcagccgctgccaggacgtgtgcccagcaggctggtatggtcccagctgccagacaaggtgctcttgtgccaatgatgggcactgccacccagccaccggacactgcagctgtgcccccgggtggaccggctttagctgccagagagcctgtgatactgggcactggggacctgactgcagccacccctgcaactgcagcgctggccacgggagctgtgatgccatcagcggcctgtgtctgtgtgaggctggctacgtgggcccgcggtgcgagcagcagtgtccccagggccactttgggcccggctgtgagcagcggtgccagtgtcagcatggagcagcctgtgaccacgtcagcggggcctgcacctgcccggccggctggaggggcaccttctgcgagcatgcctgcccggccggcttctttggattggactgtcgcagtgcctgcaactgcaccgccggagctgcctgtgatgccgtgaatggctcctgcctctgccccgctggccgccggggcccccgctgtgccgagaagtgcctcccccgggacgtcagagctggctgccggcacagcggcggttgcctcaacgggggcctgtgtgacccgcacacgggccgctgcctctgcccagccggctggactggggacaagtgtcagagcccctgcctgcggggctggtttggagaggcctgtgcccagcgctgcagctgcccgcctggcgctgcctgccaccacgtcactggggcctgccgctgtccccctggcttcactggctccggctgcgagcagggatgtccgcccgggcggtatgggccaggctgtgaacagctgtgtgggtgtctcaacgggggctcctgtgatgcggccacgggggcctgccgctgccccactgggttcctcgggacggactgcaacctcacctgtccgcagggccgcttcggccccaactgcacccacgtgtgtgggtgtgggcagggggcggcctgcgaccctgtgaccggcacctgcctctgccccccggggagagccggcgtccgctgtgagcgaggctgcccccagaaccggtttggcgtgggctgcgagcacacctgctcctgcagaaatgggggcctgtgccacgccagcaacggcagctgctcctgtggcctgggctggacggggcggcactgcgagctggcctgtccccctgggcgctacggagccgcctgccatctggagtgctcctgccacaacaacagcacgtgtgagcctgccacgggcacctgccgctgcggccccggcttctatggccaggcctgcgagcaccggcgctcaggagccacctgtaacctggattgcagaaggggccagtttgggcccagctgcaccctgcactgtgactgcgggggtggggctgactgcgaccctgtcagtgggcagtgtcactgtgtggatggctacatggggcccacgtgccgggaaggtgggcccctccggctccccgagaacccgtccttagcccagggctcagcgggcacactgcccgcctccagcagacccacatcccggagcggtggaccagcgaggcactag

SEQ ID NO: 12697 - DNA, 2910 bp, synthetic construct
  misc_feature 1..2910: note = Synthetic polypeptide
  source 1..2910: mol_type = other DNA
tggaatgggttcccttgagaggcagtgaggtccctgttcctggaagcattcaagtagagctggtgatggctgggctgccccaagggctactatggcaagcactgtcgcaagaaatgcaactgtgccaaccggggccggtgccaccgcctctacggggcctgcctctgcgacccagggctctacggccgcttctgccacctcacctgcccgccgtgggcctttgggccgggctgctcggaggagtgccagtgtgtgcagccccacacgcagtcctgtgacaagagggatggcagctgctcctgcaaggctggcttccggggcgagcgctgtcaggcagagtgtgagctgggctactttgggccggggtgctggcaggcatgcacctgcccagtgggcgtggcctgtgactccgtgagcggcgagtgtgggaagcggtgtcctgctggcttccagggagaggactgtggccaagagtgcccggtggggacgtttggcgtgaactgctcgagctcctgctcctgtgggggggccccctgccacggggtcacggggcagtgccggtgtccgccggggaggactggggaagactgtgaggcagattgtcccgagggccgctgggggctgggctgccaggagatctgcccagcatgccagcacgctgcccgctgcgaccctgagaccggagcctgcctgtgcctccctggcttcgtcggcagccgctgccaggacgtgtgcccagcaggctggtatggtcccagctgccagacaaggtgctcttgtgccaatgatgggcactgccacccagccaccggacactgcagctgtgcccccgggtggaccggctttagctgccagagagcctgtgatactgggcactggggacctgactgcagccacccctgcaactgcagcgctggccacgggagctgtgatgccatcagcggcctgtgtctgtgtgaggctggctacgtgggcccgcggtgcgagcagcagtgtccccagggccactttgggcccggctgtgagcagcggtgccagtgtcagcatggagcagcctgtgaccacgtcagcggggcctgcacctgcccggccggctggaggggcaccttctgcgagcatgcctgcccggccggcttctttggattggactgtcgcagtgcctgcaactgcaccgccggagctgcctgtgatgccgtgaatggctcctgcctctgccccgctggccgccggggcccccgctgtgccgagacctgcccagcccacacctacgggcacaattgcagccaggcctgtgcctgctttaacggggcctcctgtgaccctgtccacgggcagtgccactgtgcccctggctggatggggccctcctgcctgcaggcctgccctgccggcctgtacggcgacaactgtcggcattcctgcctctgccagaacggagggacctgtgaccctgtctcaggccactgtgcgtgcccagagggctgggccggcctggcctgtgagaaggagtgcctcccccgggacgtcagagctggctgccggcacagcggcggttgcctcaacgggggcctgtgtgacccgcacacgggccgctgcctctgcccagccggctggactggggacaagtgtcagagcccctgcctgcggggctggtttggagaggcctgtgcccagcgctgcagctgcccgcctggcgctgcctgccaccacgtcactggggcctgccgctgtccccctggcttcactggctccggctgcgagcaggcctgcccacccggcagctttggggaggactgtgcgcagatgtgccagtgtcccggtgagaacccggcctgccaccctgccaccgggacctgctcatgtgctgctggctaccacggccccagctgccagcaacgatgtccgcccgggcggtatgggccaggctgtgaacagctgtgtgggtgtctcaacgggggctcctgtgatgcggccacgggggcctgccgctgccccactgggttcctcgggacggactgcaacctcacctgtccgcagggccgcttcggccccaactgcacccacgtgtgtgggtgtgggcagggggcggcctgcgaccctgtgaccggcacctgcctctgccccccggggagagccggcgtccgctgtgagcgaggctgcccccagaaccggtttggcgtgggctgcgagcacacctgctcctgcagaaatgggggcctgtgccacgccagcaacggcagctgctcctgtggcctgggctggacggggcggcactgcgagctggcctgtccccctgggcgctacggagccgcctgccatctggagtgctcctgccacaacaacagcacgtgtgagcctgccacgggcacctgccgctgcggccccggcttctatggccaggcctgcgagcacccctgtccccctggcttccacggggctggctgccaggggttgtgctggtgtcaacatggagccccctgcgaccccatcagtggccgatgcctctgccctgccggcttccacggccacttctgtgagagggggtgtgagccaggttcatttggagagggctgccaccagcgctgtgactgtgacgggggggcaccctgtgaccctgtcaccggtctctgcctttgcccaccagggcgctcaggagccacctgtaacctggattgcagaaggggccagtttgggcccagctgcaccctgcactgtgactgcgggggtggggctgactgcgaccctgtcagtgggcagtgtcactgtgtggatggctacatggggcccacgtgccgggaaggtgggcccctccggctccccgagaacccgtccttagcccagggctcagcgggcacactgcccgcctccagcagacccacatcccggagcggtggaccagcgaggcactag

SEQ ID NO: 12698 - DNA, 2235 bp, synthetic construct
  misc_feature 1..2235: note = Synthetic polypeptide
  source 1..2235: mol_type = other DNA
tggaatgggttcccttgagaggcagtgaggtccctgttcctggaagcattcaagtagagctggtgatggctgggctgccccaagggctactatggcaagcactgtcgcaagaaatgcaactgtgccaaccggggccggtgccaccgcctctacggggcctgcctctgcgacccagggctctacggccgcttctgccacctcacctgcccgccgtgggcctttgggccgggctgctcggaggagtgccagtgtgtgcagccccacacgcagtcctgtgacaagagggatggcagctgctcctgcaaggctggcttccggggcgagcgctgtcaggcagagtgtgagctgggctactttgggccggggtgctggcaggcatgcacctgcccagtgggcgtggcctgtgactccgtgagcggcgagtgtgggaagcggtgtcctgctggcttccagggagaggactgtggccaagagtgcccggtggggacgtttggcgtgaactgctcgagctcctgctcctgtgggggggccccctgccacggggtcacggggcagtgccggtgtccgccggggaggactggggaagactgtgaggcagattgtcccgagggccgctgggggctgggctgccaggagatctgcccagcatgccagcacgctgcccgctgcgaccctgagaccggagcctgcctgtgcctccctggcttcgtcggcagccgctgccaggacgtgtgcccagcaggctggtatggtcccagctgccagacaaggtgctcttgtgccaatgatgggcactgccacccagccaccggacactgcagctgtgcccccgggtggaccggctttagctgccagagagcctgtgatactgggcactggggacctgactgcagccacccctgcaactgcagcgctggccacgggagctgtgatgccatcagcggcctgtgtctgtgtgaggctggctacgtgggcccgcggtgcgagcagcagtgtccccagggccactttgggcccggctgtgagcagcggtgccagtgtcagcatggagcagcctgtgaccacgtcagcggggcctgcacctgcccggccggctggaggggcaccttctgcgagcatgcctgcccggccggcttctttggattggactgtcgcagtgcctgcaactgcaccgccggagctgcctgtgatgccgtgaatggctcctgcctctgccccgctggccgccggggcccccgctgtgccgagacctgcccagcccacacctacgggcacaattgcagccaggcctgtgcctgctttaacggggcctcctgtgaccctgtccacgggcagtgccactgtgcccctggctggatggggccctcctgcctgcaggcctgccctgccggcctgtacggcgacaactgtcggcattcctgcctctgccagaacggagggacctgtgaccctgtctcaggccactgtgcgtgcccagagggctgggccggcctggcctgtgagaaggagtgcctcccccgggacgtcagagctggctgccggcacagcggcggttgcctcaacgggggcctgtgtgacccgcacacgggccgctgcctctgcccagccggctggactggggacaagtgtcagagcccctgtgccaagggcacattcgggcctcactgtgaggggcgctgtgcctgccggtggggaggcccctgccaccttgccaccggggcctgcctctgccctccggggtggcggggggctccaggtgtgagaatgcctgcctgcggggctggtttggagaggcctgtgcccagcgctgcagctgcccgcctggcgctgcctgccaccacgtcactggggcctgccgctgtccccctggcttcactggctccggctgcgagcaggcctgcccacccggcagctttggggaggactgtgcgcagatgtgccagtgtcccggtgagaacccggcctgccaccctgccaccgggacctgctcatgtgctgctggctaccacggccccagctgccagcaacgatgtccgcccgggcggtatgggccaggctgtgaacagctgtgtgggtgtctcaacgggggctcctgtgatgcggccacgggggcctgccgctgccccactgggttcctcgggacggactgcaacctcacctgtccgcagggccgcttcggccccaactgcacccacgtgtgtgggtgtgggcagggggcggcctgcgaccctgtga

SEQ ID NO: 12699 - DNA, 414 bp, synthetic construct; identical to SEQ ID NO: 6481
  misc_feature 1..414: note = Synthetic polypeptide
  source 1..414: mol_type = other DNA

SEQ ID NO: 12700 - DNA, 337 bp, synthetic construct; identical to SEQ ID NO: 6393
  misc_feature 1..337: note = Synthetic polypeptide
  source 1..337: mol_type = other DNA

SEQ ID NO: 12701 - DNA, 605 bp, synthetic construct; identical to SEQ ID NO: 8066
  misc_feature 1..605: note = Synthetic polypeptide
  source 1..605: mol_type = other DNA

SEQ ID NO: 12702 - DNA, 372 bp, synthetic construct; identical to SEQ ID NO: 8067
  misc_feature 1..372: note = Synthetic polypeptide
  source 1..372: mol_type = other DNA

SEQ ID NO: 12703 - DNA, 422 bp, synthetic construct; identical to SEQ ID NO: 8068
  misc_feature 1..422: note = Synthetic polypeptide
  source 1..422: mol_type = other DNA

SEQ ID NO: 12704 - DNA, 476 bp, synthetic construct; identical to SEQ ID NO: 8069
  misc_feature 1..476: note = Synthetic polypeptide
  source 1..476: mol_type = other DNA

SEQ ID NO: 12705 - DNA, 1188 bp, synthetic construct; identical to SEQ ID NO: 8232
  misc_feature 1..1188: note = Synthetic polypeptide
  source 1..1188: mol_type = other DNA

SEQ ID NO: 12706 - DNA, 853 bp, synthetic construct; identical to SEQ ID NO: 8074
  misc_feature 1..853: note = Synthetic polypeptide
  source 1..853: mol_type = other DNA

SEQ ID NO: 12707 - DNA, 1966 bp, synthetic construct
  misc_feature 1..1966: note = Synthetic polypeptide
  source 1..1966: mol_type = other DNA
ctggcatacagcctggaagaaacgctggtttatcctgcggagtggccggatgagcggtgacccagatgttctggaatactacaagaacgatcactccaagaagcctctgcggatcatcaacctgaacttctgtgagcaggtagatgcaggcctgacctttaacaagaaggagctgcaggatagttttgtgtttgacatcaagaccagtgaacgcaccttttacctggtggctgagacagaagaggacatgaataagtgggtccagagcatctgccagatctgtggcttcaatcaggctgaggagagcacagactccctgagaaatgtttcctcagccggtcatggcccccgctcttctccagctgagctcagcagctctagccagcaccttctccgagagcgcaagtcctcagccccatcacactccagccagccaactctgttcacgtttgaaccccctgtgtcaaaccacatgcagcccaccttgtccaccagcgcacctcaggagtatctctacttgcaccagtgcataagccgaagagcagaaaatgcaaggagtgccagcttctctcagggcaccagagcctcttttctcatgaggagtgacacagctgtacaaaaacttgcccagggcaatggacactgtgtcaacgggatcagtggtcaagtccatggcttctatagccttcccaagccgagccggcacaatacagaattcagagacagtacctacgacctcccccgcagcctggcctcccatggccacaccaagggcagcctcacaggctccgagacagataatgaggatgtgtacaccttcaagacgcccagcaacaccctgtgcagggagttcggggacctcctggtagacaatatggatgttccggccaccccactctcagcctaccagatccctaggacattcactctggacaaaaaccacaatgccatgacagtggccactcctggggactcagccatagctcccccaccccgcccccccaagccaagtcaggcagaaacacctcgatggggcagtcctcagcagagaccgccaatcagtgaaaatagcagatctgtcgctgccaccatccccagacgcaacaccctccctgcaatggacaacagccgacttcaccgagcttcttcctgtgagacctacgagtacccacagcgtggtggagagagtgcaggccggtctgctgaatccatgagtgatggagttggctctttcctgccagggaaaatgattgtgggccgatcggacagcaccaattctgaagacaactatgtgcccatgaatccaggttcttccaccctgttggccatggaacgagcaggtgataattcccagagcgtctacatcccaatgagcccaggggcccatcactttgactcacttggctacccatcaacaacccttcctgtgcaccgaggccccagcagaggaagtgagattcagccaccccctgtcaaccgcaacctcaaacctgatcggaaagcaaagccaacaccacttgacctgaggaacaacaccgtcatcgatgaactccccttcaagtcacctatcaccaagtcttggtctagggccaaccacaccttcaactccagctcctcccagtactgccgccccatctccacccagagcatcaccagcacagactcaggagacagcgaagagaactatgtccctatgcaaaacccagtgtctgcatctcccgttcccagtggcacgaacagtcctgcccctaagaagagcaccggcagcgttgattatctggccctggacttccagccgagctccccaagcccccaccgcaagccatctacttcatccgtcacctctgatgagaaggtggactacgttcaggtggacaaggagaagacccaggccctgcagaacaccatgcaggagtggacagacgtgcggcagtcctcagagccttccaagggtgccaagctgtga

SEQ ID NO: 12708 - DNA, 560 bp, synthetic construct; identical to SEQ ID NO: 6322
  misc_feature 1..560: note = Synthetic polypeptide
  source 1..560: mol_type = other DNA

SEQ ID NO: 12709 - DNA, 404 bp, synthetic construct; identical to SEQ ID NO: 6813
  misc_feature 1..404: note = Synthetic polypeptide
  source 1..404: mol_type = other DNA

SEQ ID NO: 12710 - DNA, 417 bp, synthetic construct; identical to SEQ ID NO: 6814
  misc_feature 1..417: note = Synthetic polypeptide
  source 1..417: mol_type = other DNA

SEQ ID NO: 12711 - DNA, 485 bp, synthetic construct; identical to SEQ ID NO: 6815
  misc_feature 1..485: note = Synthetic polypeptide
  source 1..485: mol_type = other DNA

SEQ ID NO: 12712 - DNA, 1745 bp, synthetic construct; identical to SEQ ID NO: 6816
  misc_feature 1..1745: note = Synthetic polypeptide
  source 1..1745: mol_type = other DNA

SEQ ID NO: 12713 - DNA, 2484 bp, synthetic construct; identical to SEQ ID NO: 9884
  misc_feature 1..2484: note = Synthetic polypeptide
  source 1..2484: mol_type = other DNA

SEQ ID NO: 12714 - DNA, 1554 bp, synthetic construct; identical to SEQ ID NO: 8073
  misc_feature 1..1554: note = Synthetic polypeptide
  source 1..1554: mol_type = other DNA

SEQ ID NO: 12715 - DNA, 423 bp, synthetic construct; identical to SEQ ID NO: 6550
  misc_feature 1..423: note = Synthetic polypeptide
  source 1..423: mol_type = other DNA

SEQ ID NO: 12716 - DNA, 163 bp, synthetic construct; identical to SEQ ID NO: 480
  misc_feature 1..163: note = Synthetic polypeptide
  source 1..163: mol_type = other DNA

SEQ ID NO: 12717 - DNA, 104 bp, synthetic construct; identical to SEQ ID NO: 481
  misc_feature 1..104: note = Synthetic polypeptide
  source 1..104: mol_type = other DNA

SEQ ID NO: 12718 - DNA, 523 bp, synthetic construct; identical to SEQ ID NO: 8925
  misc_feature 1..523: note = Synthetic polypeptide
  source 1..523: mol_type = other DNA

SEQ ID NO: 12719 - DNA, 1807 bp, synthetic construct; identical to SEQ ID NO: 8089
  misc_feature 1..1807: note = Synthetic polypeptide
  source 1..1807: mol_type = other DNA

SEQ ID NO: 12720 - DNA, 487 bp, synthetic construct
  misc_feature 1..487: note = Synthetic polypeptide
  source 1..487: mol_type = other DNA
ggcggcctggccaagctcggcgccgctcaccagcgctgacctgggggtggtttgacctcccagtgcctcagtttcttcacaggagggtgtgaagacagagaatgaccacatcaacctgaaggtggccgggcaggacggctccgtggtgcagttcaagatcaagaggcacacgccgctgagcaagctgatgaaggcctactgcgagaggcaggtgcggcaccttgctcccccgcagagcctccccgtgtgcgcactggtcctgtgcgttccaggcatccccagagcacgagcgtctcggggctggacccagatgcagctgcccgagggcttgtcaatgaggcagatcagattcaggttcgacgggcagccaatcaatgaaactgacactccagcacagctggagatggaggacgaggacaccatcgacgtgttccagcagcagacgggaggtgtgccggagagcagcctggcagggcacagtttctag

SEQ ID NO: 12721 - DNA, 469 bp, synthetic construct
  misc_feature 1..469: note = Synthetic polypeptide
  source 1..469: mol_type = other DNA
ggcggcctggccaagctcggcgccgctcaccagcgctgacctgggggtggtttgacctcccagtgcctcagtttcttcacaggagggtgtgaagacagagaatgaccacatcaacctgaaggtggccgggcaggacggctccgtggtgcagttcaagatcaagaggcacacgccgctgagcaagctgatgaaggcctactgcgagaggcagggcttgtcaatgaggcagatcagattcaggttcgacgggcagccaatcaatgaaactgacactccagcacaggtacggagctggcttcgcgtggttccagggcgacttccgatttgtgcgggctggagatggaggacgaggacaccatcgacgtgttccagcagcagacgggaggtgtgccggagagcagcctggcagggcacagtttctagagggcccgtccccagcccgggccgtccatcctcgcattgctgttga

SEQ ID NO: 12722 - DNA, 373 bp, synthetic construct
  misc_feature 1..373: note = Synthetic polypeptide
  source 1..373: mol_type = other DNA
ggcggcctggccaagctcggcgccgctcaccagcgctgacctgggggtggtttgacctcccagtgcctcagtttcttcacaggagggtgtgaagacagagaatgaccacatcaacctgaaggtggccgggcaggacggctccgtggtgcagttcaagatcaagaggcacacgccgctgagcaagctgatgaaggcctactgcgagaggcagggcttgtcaatgaggcagatcagattcaggttcgacgggcagccaatcaatgaaactgacactccagcacagctggagatggaggacgaggacaccatcgacgtgttccagcagcagacgggaggtgtgccggagagcagcctggcagggcacagtttctag

SEQ ID NO: 12723 - DNA, 505 bp, synthetic construct
  misc_feature 1..505: note = Synthetic polypeptide
  source 1..505: mol_type = other DNA
ggcggcctggccaagctcggcgccgctcaccagcgctgacctgggggtggtttgacctcccagtgcctcagtttcttcacaggagggtgtgaagacagagaatgaccacatcaacctgaaggtggccgggcaggacggctccgtggtgcagttcaagatcaagaggcacacgccgctgagcaagctgatgaaggcctactgcgagaggcagggcttgtcaatgaggcagatcagattcaggttcgacgggcagccaatcaatgaaactgacactccagcacagggcatcatactgtcatggaaagagctttggacctggaaacagacttttttttttgagacggagtctcgctttgttgcccaggctagaatgcagtggcgcagtctcagctcactgtgcaagctctgcctcctgagttcacgccattctcctgcctcagcctcccaagtagctgggactataggtgcccaccaccactcccggctaatttttttgtatttttag

SEQ ID NO: 12724 - DNA, 534 bp, synthetic construct; identical to SEQ ID NO: 8079
  misc_feature 1..534: note = Synthetic polypeptide
  source 1..534: mol_type = other DNA

SEQ ID NO: 12725 - DNA, 500 bp, synthetic construct; identical to SEQ ID NO: 8080
  misc_feature 1..500: note = Synthetic polypeptide
  source 1..500: mol_type = other DNA

SEQ ID NO: 12726 - DNA, 453 bp, synthetic construct; identical to SEQ ID NO: 8081
  misc_feature 1..453: note = Synthetic polypeptide
  source 1..453: mol_type = other DNA

SEQ ID NO: 12727 - DNA, 1038 bp, synthetic construct; identical to SEQ ID NO: 12062
  misc_feature 1..1038: note = Synthetic polypeptide
  source 1..1038: mol_type = other DNA

SEQ ID NO: 12728 - DNA, 742 bp, synthetic construct; identical to SEQ ID NO: 6357
  misc_feature 1..742: note = Synthetic polypeptide
  source 1..742: mol_type = other DNA

SEQ ID NO: 12729 - DNA, 590 bp, synthetic construct; identical to SEQ ID NO: 6358
  misc_feature 1..590: note = Synthetic polypeptide
  source 1..590: mol_type = other DNA

SEQ ID NO: 12730 - DNA, 577 bp, synthetic construct; identical to SEQ ID NO: 6359
  misc_feature 1..577: note = Synthetic polypeptide
  source 1..577: mol_type = other DNA

SEQ ID NO: 12731 - DNA, 430 bp, synthetic construct; identical to SEQ ID NO: 6360
  misc_feature 1..430: note = Synthetic polypeptide
  source 1..430: mol_type = other DNA

SEQ ID NO: 12732 - DNA, 670 bp, synthetic construct; identical to SEQ ID NO: 6361
  misc_feature 1..670: note = Synthetic polypeptide
  source 1..670: mol_type = other DNA

SEQ ID NO: 12733 - DNA, 797 bp, synthetic construct
  misc_feature 1..797: note = Synthetic polypeptide
  source 1..797: mol_type = other DNA
ggaggcaggtgtgtggggggaagcgggtgtgtgtctgaggaagcgggtgtgtgtggggggaagcgggtgtgtggaggcgggcgtgtgggggaggcgggtgtgtgtgtgagaggaaggtgtgtgggaggaggcagatttgtggggggaggcgggcgtgtgggggaggcgggtgtgaggcgggtgtccgggaggcaggtgttggagcgcgggcagccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtccagccctag

SEQ ID NO: 12734 - DNA, 192 bp, synthetic construct
  misc_feature 1..192: note = Synthetic polypeptide
  source 1..192: mol_type = other DNA
aaaggtacaacttgctgggaatacgctgccatcaactccatgctggaccagatcaactcctgtctggaccacctggaggagaagaatgaccacctccacgcccgcctccaggagctgctggagtccaaccggcagacacgcctggagttccagcagcagctcggggaggcccccagtgatgccagcccctag

SEQ ID NO: 12735 - DNA, 529 bp, synthetic construct
  misc_feature 1..529: note = Synthetic polypeptide
  source 1..529: mol_type = other DNA
tgatacggtttggctgtgtccccaccccagatctcatcttgaattcccatgtgttgtgggaaggacttgtgggaggtaattgaatcatgggggtatgtctttgccatgctgttctcgtgatgctgaataagtctcatgagatctgatggttctataagggggaatttccctgcacaagctctctcttttcctgctgctatccattgtaagatgtgacttgctccgccttgccttctgccacgattgtgtgaggcttccccagccacatgtcactgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagaga

SEQ ID NO: 12736 - DNA, 1317 bp, synthetic construct
  misc_feature 1..1317: note = Synthetic polypeptide
  source 1..1317: mol_type = other DNA
tgatacggtttggctgtgtccccaccccagatctcatcttgaattcccatgtgttgtgggaaggacttgtgggaggtaattgaatcatgggggtatgtctttgccatgctgttctcgtgatgctgaataagtctcatgagatctgatggttctataagggggaatttccctgcacaagctctctcttttcctgctgctatccattgtaagatgtgacttgctccgccttgccttctgccacgattgtgtgaggcttccccagccacatgtcactgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaagggatgccaagggagcagagatgcctgcagcccgtgggagcaagtcctggcctttgcagttgcaaaaactggctgcaagctgctccagccccagaggaactggccaagctccagagggcctccttggagggcctcagagggagagagaactgctcagtaa

SEQ ID NO: 12737 - DNA, 1221 bp, synthetic construct
  misc_feature 1..1221: note = Synthetic polypeptide
  source 1..1221: mol_type = other DNA
tgatacggtttggctgtgtccccaccccagatctcatcttgaattcccatgtgttgtgggaaggacttgtgggaggtaattgaatcatgggggtatgtctttgccatgctgttctcgtgatgctgaataagtctcatgagatctgatggttctataagggggaatttccctgcacaagctctctcttttcctgctgctatccattgtaagatgtgacttgctccgccttgccttctgccacgattgtgtgaggcttccccagccacatgtcactgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaggcttatttcaaaacctttgtccctcagttccaggaggcagcatttgccaatggaaagctctag

SEQ ID NO: 12738 - DNA, 1200 bp, synthetic construct
  misc_feature 1..1200: note = Synthetic polypeptide
  source 1..1200: mol_type = other DNA
tgatacggtttggctgtgtccccaccccagatctcatcttgaattcccatgtgttgtgggaaggacttgtgggaggtaattgaatcatgggggtatgtctttgccatgctgttctcgtgatgctgaataagtctcatgagatctgatggttctataagggggaatttccctgcacaagctctctcttttcctgctgctatccattgtaagatgtgacttgctccgccttgccttctgccacgattgtgtgaggcttccccagccacatgtcactgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaaagagagagcaacagagatggggaggaatccagctctgcctga

SEQ ID NO: 12739 - DNA, 922 bp, synthetic construct
  misc_feature 1..922: note = Synthetic polypeptide
  source 1..922: mol_type = other DNA
tgatacggtttggctgtgtccccaccccagatctcatcttgaattcccatgtgttgtgggaaggacttgtgggaggtaattgaatcatgggggtatgtctttgccatgctgttctcgtgatgctgaataagtctcatgagatctgatggttctataagggggaatttccctgcacaagctctctcttttcctgctgctatccattgtaagatgtgacttgctccgccttgccttctgccacgattgtgtgaggcttccccagccacatgtcactgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcagttaagcctgagcccttgccacacggatttccttctcacccgcttcctccccgcaccactctggggatcagaagtatcagtgccaagtggtccctttcatctcctcataattcttccccagccacttagtgggttagtcaggccctgccttctcttcagccagccctgcagtc

SEQ ID NO: 12740 - DNA, 632 bp, synthetic construct
  misc_feature 1..632: note = Synthetic polypeptide
  source 1..632: mol_type = other DNA
tgatacggtttggctgtgtccccaccccagatctcatcttgaattcccatgtgttgtgggaaggacttgtgggaggtaattgaatcatgggggtatgtctttgccatgctgttctcgtgatgctgaataagtctcatgagatctgatggttctataagggggaatttccctgcacaagctctctcttttcctgctgctatccattgtaagatgtgacttgctccgccttgccttctgccacgattgtgtgaggcttccccagccacatgtcactgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactgggtaaggatttttgagaatggaaaaaaagatgacttcatccataataaaataatcaattcatatgtcca

SEQ ID NO: 12741 - DNA, 441 bp, synthetic construct
  misc_feature 1..441: note = Synthetic polypeptide
  source 1..441: mol_type = other DNA
gcgtggcaacagtgcagggatcccagggctggggagagacctgagctacgagagtacaagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctag

SEQ ID NO: 12742 - DNA, 558 bp, synthetic construct
  misc_feature 1..558: note = Synthetic polypeptide
  source 1..558: mol_type = other DNA
gcgtggcaacagtgcagggatcccagggctggggagagacctgagctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctag

SEQ ID NO: 12743 - DNA, 492 bp, synthetic construct
  misc_feature 1..492: note = Synthetic polypeptide
  source 1..492: mol_type = other DNA
gcgtggcaacagtgcagggatcccagggctggggagagacctgagctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccgcacaagccacgcttcaccaccaagaggcccaacaccttcttctag

SEQ ID NO: 12744 - DNA, 1549 bp, synthetic construct
  misc_feature 1..1549: note = Synthetic polypeptide
  source 1..1549: mol_type = other DNA
gaccgggcgcagtggctcacgcctgtaatctcagcactttgggaggcctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtga

SEQ ID NO: 12745 - DNA, 845 bp, synthetic construct
  misc_feature 1..845: note = Synthetic polypeptide
  source 1..845: mol_type = other DNA
gaccgggcgcagtggctcacgcctgtaatctcagcactttgggaggcctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggaca

SEQ ID NO: 12746 - DNA, 403 bp, synthetic construct
  misc_feature 1..403: note = Synthetic polypeptide
  source 1..403: mol_type = other DNA
gaccgggcgcagtggctcacgcctgtaatctcagcactttgggaggcctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagttt

SEQ ID NO: 12747 - DNA, 331 bp, synthetic construct; identical to SEQ ID NO: 7504
  misc_feature 1..331: note = Synthetic polypeptide
  source 1..331: mol_type = other DNA

SEQ ID NO: 12748 - DNA, 148 bp, synthetic construct; identical to SEQ ID NO: 6388
  misc_feature 1..148: note = Synthetic polypeptide
  source 1..148: mol_type = other DNA

SEQ ID NO: 12749 - DNA, 1100 bp, synthetic construct; identical to SEQ ID NO: 6389
  misc_feature 1..1100: note = Synthetic polypeptide
  source 1..1100: mol_type = other DNA

SEQ ID NO: 12750 - DNA, 464 bp, synthetic construct; identical to SEQ ID NO: 6390
  misc_feature 1..464: note = Synthetic polypeptide
  source 1..464: mol_type = other DNA

SEQ ID NO: 12751 - DNA, 280 bp, synthetic construct; identical to SEQ ID NO: 6391
  misc_feature 1..280: note = Synthetic polypeptide
  source 1..280: mol_type = other DNA

SEQ ID NO: 12752 - DNA, 1691 bp, synthetic construct; identical to SEQ ID NO: 12579
  misc_feature 1..1691: note = Synthetic polypeptide
  source 1..1691: mol_type = other DNA

SEQ ID NO: 12753 - DNA, 522 bp, synthetic construct; identical to SEQ ID NO: 12580
  misc_feature 1..522: note = Synthetic polypeptide
  source 1..522: mol_type = other DNA

SEQ ID NO: 12754 - DNA, 792 bp, synthetic construct; identical to SEQ ID NO: 6418
  misc_feature 1..792: note = Synthetic polypeptide
  source 1..792: mol_type = other DNA

SEQ ID NO: 12755 - DNA, 369 bp, synthetic construct; identical to SEQ ID NO: 6419
  misc_feature 1..369: note = Synthetic polypeptide
  source 1..369: mol_type = other DNA

SEQ ID NO: 12756 - DNA, 249 bp, synthetic construct; identical to SEQ ID NO: 6420
  misc_feature 1..249: note = Synthetic polypeptide
  source 1..249: mol_type = other DNA

SEQ ID NO: 12757 - DNA, 369 bp, synthetic construct; identical to SEQ ID NO: 6421
  misc_feature 1..369: note = Synthetic polypeptide
  source 1..369: mol_type = other DNA

SEQ ID NO: 12758 - DNA, 843 bp, synthetic construct; identical to SEQ ID NO: 6422
  misc_feature 1..843: note = Synthetic polypeptide
  source 1..843: mol_type = other DNA

SEQ ID NO: 12759 - DNA, 116 bp, synthetic construct; identical to SEQ ID NO: 8185
  misc_feature 1..116: note = Synthetic polypeptide
  source 1..116: mol_type = other DNA

SEQ ID NO: 12760 - DNA, 105 bp, synthetic construct; identical to SEQ ID NO: 8186
  misc_feature 1..105: note = Synthetic polypeptide
  source 1..105: mol_type = other DNA

SEQ ID NO: 12761 - DNA, 1325 bp, synthetic construct; identical to SEQ ID NO: 7686
  misc_feature 1..1325: note = Synthetic polypeptide
  source 1..1325: mol_type = other DNA

SEQ ID NO: 12762 - DNA, 1691 bp, synthetic construct; identical to SEQ ID NO: 7687
  misc_feature 1..1691: note = Synthetic polypeptide
  source 1..1691: mol_type = other DNA

SEQ ID NO: 12763 - DNA, 1541 bp, synthetic construct; identical to SEQ ID NO: 7688
  misc_feature 1..1541: note = Synthetic polypeptide
  source 1..1541: mol_type = other DNA

SEQ ID NO: 12764 - DNA, 379 bp, synthetic construct
  misc_feature 1..379: note = Synthetic polypeptide
  source 1..379: mol_type = other DNA
ccaggcgcggtggctcacgcctgtaatcccagcactttgggaggccgaggcaggcagatcacctgagtctcacaccattttgctggtacagcctaccaagaggccagaaggcagaacttatgctgactacgaatctgtgaatgaatgcatggaaggtgtttgtaaaatgtatgaagaacatctgaaaagaatgaatcccaacagtccctctatcacatatgacatcagtcagttgtttgatttcatcgatgatctggcagacctcagctgcctggtttaccgagctgatacccagacataccagccttataacaaagactggattaaagagaagatctacgtgctccttcgtcggcaggcccaacaggctgggaaataa

SEQ ID NO: 12765 - DNA, 280 bp, synthetic construct
  misc_feature 1..280: note = Synthetic polypeptide
  source 1..280: mol_type = other DNA
ccaggcgcggtggctcacgcctgtaatcccagcactttgggaggccgaggcaggcagatcacctgagtctcacaccattttgctggtacagcctaccaagaggccagaaggcagaacttatgctgactacgaatctgtgaatgaatgcatggaaggtgtttgtaaaatgtatgaagaacatctgaaaagaatgaatcccaacagtccctctatcacatatgacatcagtcagttgtttgatttcatcgatgatctggcagacctcagctgcctggtgtaa

SEQ ID NO: 12766 - DNA, 496 bp, synthetic construct; identical to SEQ ID NO: 11226
  misc_feature 1..496: note = Synthetic polypeptide
  source 1..496: mol_type = other DNA

SEQ ID NO: 12767 - DNA, 385 bp, synthetic construct; identical to SEQ ID NO: 11229
  misc_feature 1..385: note = Synthetic polypeptide
  source 1..385: mol_type = other DNA

SEQ ID NO: 12768 - DNA, 385 bp, synthetic construct; identical to SEQ ID NO: 11229
  misc_feature 1..385: note = Synthetic polypeptide
  source 1..385: mol_type = other DNA

SEQ ID NO: 12769 - DNA, 386 bp, synthetic construct; identical to SEQ ID NO: 11224
  misc_feature 1..386: note = Synthetic polypeptide
  source 1..386: mol_type = other DNA

SEQ ID NO: 12770 - DNA, 457 bp, synthetic construct; identical to SEQ ID NO: 11225
  misc_feature 1..457: note = Synthetic polypeptide
  source 1..457: mol_type = other DNA

SEQ ID NO: 12771 - DNA, 1154 bp, synthetic construct; identical to SEQ ID NO: 8078
  misc_feature 1..1154: note = Synthetic polypeptide
  source 1..1154: mol_type = other DNA

SEQ ID NO: 12772 - DNA, 385 bp, synthetic construct; identical to SEQ ID NO: 11229
  misc_feature 1..385: note = Synthetic polypeptide
  source 1..385: mol_type = other DNA

SEQ ID NO: 12773 - DNA, 418 bp, synthetic construct; identical to SEQ ID NO: 11223
  misc_feature 1..418: note = Synthetic polypeptide
  source 1..418: mol_type = other DNA

SEQ ID NO: 12774 - DNA, 418 bp, synthetic construct; identical to SEQ ID NO: 11223
  misc_feature 1..418: note = Synthetic polypeptide
  source 1..418: mol_type = other DNA

SEQ ID NO: 12775 - DNA, 418 bp, synthetic construct; identical to SEQ ID NO: 11223
  misc_feature 1..418: note = Synthetic polypeptide
  source 1..418: mol_type = other DNA

SEQ ID NO: 12776 - DNA, 418 bp, synthetic construct; identical to SEQ ID NO: 11223
  misc_feature 1..418: note = Synthetic polypeptide
  source 1..418: mol_type = other DNA

SEQ ID NO: 12777 - DNA, 418 bp, synthetic construct; identical to SEQ ID NO: 11223
  misc_feature 1..418: note = Synthetic polypeptide
  source 1..418: mol_type = other DNA

SEQ ID NO: 12778 - DNA, 851 bp, synthetic construct
  misc_feature 1..851: note = Synthetic polypeptide
  source 1..851: mol_type = other DNA
ggaggcaggtgtgtggggggaagcgggtgtgtgtctgaggaagcgggtgtgtgtggggggaagcgggtgtgtggaggcgggcgtgtgggggaggcgggtgtgtgtgtgagaggaaggtgtgtgggaggaggcagatttgtggggggaggcgggcgtgtgggggaggcgggtgtgaggcgggtgtccgggaggcaggtgttggagcgcgggcaggtgttggagcgcgggcaggtgttggagcgcgggcaggtgttggagcgcgggcagccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtccagccctag

SEQ ID NO: 12779 - DNA, 943 bp, synthetic construct; identical to SEQ ID NO: 9889
  misc_feature 1..943: note = Synthetic polypeptide
  source 1..943: mol_type = other DNA

SEQ ID NO: 12780 - DNA, 418 bp, synthetic construct; identical to SEQ ID NO: 11223
  misc_feature 1..418: note = Synthetic polypeptide
  source 1..418: mol_type = other DNA

SEQ ID NO: 12781 - DNA, 833 bp, synthetic construct
  misc_feature 1..833: note = Synthetic polypeptide
  source 1..833: mol_type = other DNA
ggaggcaggtgtgtggggggaagcgggtgtgtgtctgaggaagcgggtgtgtgtggggggaagcgggtgtgtggaggcgggcgtgtgggggaggcgggtgtgtgtgtgagaggaaggtgtgtgggaggaggcagatttgtggggggaggcgggcgtgtgggggaggcgggtgtgaggcgggtgtccgggaggcaggtgttggagcgcgggcaggtgttggagcgcgggcaggtgttggagcgcgggcagccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtccagccctag

SEQ ID NO: 12782 - DNA, 815 bp, synthetic construct
  misc_feature 1..815: note = Synthetic polypeptide
  source 1..815: mol_type = other DNA
ggaggcaggtgtgtggggggaagcgggtgtgtgtctgaggaagcgggtgtgtgtggggggaagcgggtgtgtggaggcgggcgtgtgggggaggcgggtgtgtgtgtgagaggaaggtgtgtgggaggaggcagatttgtggggggaggcgggcgtgtgggggaggcgggtgtgaggcgggtgtccgggaggcaggtgttggagcgcgggcaggtgttggagcgcgggcagccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtccagccctag

SEQ ID NO: 12783 - DNA, 320 bp, synthetic construct; identical to SEQ ID NO: 8218
  misc_feature 1..320: note = Synthetic polypeptide
  source 1..320: mol_type = other DNA

SEQ ID NO: 12784 - DNA, 485 bp, synthetic construct; identical to SEQ ID NO: 8219
  misc_feature 1..485: note = Synthetic polypeptide
  source 1..485: mol_type = other DNA

SEQ ID NO: 12785 - DNA, 1516 bp, synthetic construct; identical to SEQ ID NO: 534
  misc_feature 1..1516: note = Synthetic polypeptide
  source 1..1516: mol_type = other DNA

SEQ ID NO: 12786 - DNA, 591 bp, synthetic construct; identical to SEQ ID NO: 539
  misc_feature 1..591: note = Synthetic polypeptide
  source 1..591: mol_type = other DNA

SEQ ID NO: 12787 - DNA, 482 bp, synthetic construct; identical to SEQ ID NO: 540
  misc_feature 1..482: note = Synthetic polypeptide
  source 1..482: mol_type = other DNA

SEQ ID NO: 12788 - DNA, 444 bp, synthetic construct; identical to SEQ ID NO: 541
  misc_feature 1..444: note = Synthetic polypeptide
  source 1..444: mol_type = other DNA

SEQ ID NO: 12789 - DNA, 334 bp, synthetic construct; identical to SEQ ID NO: 533
  misc_feature 1..334: note = Synthetic polypeptide
  source 1..334: mol_type = other DNA

SEQ ID NO: 12790 - DNA, 38 bp, synthetic construct; identical to SEQ ID NO: 543
  misc_feature 1..38: note = Synthetic polypeptide
  source 1..38: mol_type = other DNA

SEQ ID NO: 12791 - DNA, 245 bp, synthetic construct; identical to SEQ ID NO: 542
  misc_feature 1..245: note = Synthetic polypeptide
  source 1..245: mol_type = other DNA

SEQ ID NO: 12792 - DNA, 330 bp, synthetic construct; identical to SEQ ID NO: 6490
  misc_feature 1..330: note = Synthetic polypeptide
  source 1..330: mol_type = other DNA

SEQ ID NO: 12793 - DNA, 1629 bp, synthetic construct; identical to SEQ ID NO: 8070
  misc_feature 1..1629: note = Synthetic polypeptide
  source 1..1629: mol_type = other DNA

SEQ ID NO: 12794 - DNA, 1500 bp, synthetic construct; identical to SEQ ID NO: 8071
  misc_feature 1..1500: note = Synthetic polypeptide
  source 1..1500: mol_type = other DNA

SEQ ID NO: 12795 - DNA, 370 bp, synthetic construct; identical to SEQ ID NO: 6522
  misc_feature 1..370: note = Synthetic polypeptide
  source 1..370: mol_type = other DNA

SEQ ID NO: 12796 - DNA, 568 bp, synthetic construct; identical to SEQ ID NO: 6787
  misc_feature 1..568: note = Synthetic polypeptide
  source 1..568: mol_type = other DNA

SEQ ID NO: 12797 - DNA, 181 bp, synthetic construct; identical to SEQ ID NO: 6788
  misc_feature 1..181: note = Synthetic polypeptide
  source 1..181: mol_type = other DNA

SEQ ID NO: 12798 - DNA, 871 bp, synthetic construct; identical to SEQ ID NO: 437
  misc_feature 1..871: note = Synthetic polypeptide
  source 1..871: mol_type = other DNA

SEQ ID NO: 12799 - DNA, 421 bp, synthetic construct; identical to SEQ ID NO: 441
  misc_feature 1..421: note = Synthetic polypeptide
  source 1..421: mol_type = other DNA

SEQ ID NO: 12800 - DNA, 638 bp, synthetic construct; identical to SEQ ID NO: 442
  misc_feature 1..638: note = Synthetic polypeptide
  source 1..638: mol_type = other DNA

SEQ ID NO: 12801 - DNA, 337 bp, synthetic construct; identical to SEQ ID NO: 443
  misc_feature 1..337: note = Synthetic polypeptide
  source 1..337: mol_type = other DNA

SEQ ID NO: 12802 - DNA, 1089 bp, synthetic construct; identical to SEQ ID NO: 8115
  misc_feature 1..1089: note = Synthetic polypeptide
  source 1..1089: mol_type = other DNA

SEQ ID NO: 12803 - DNA, 408 bp, synthetic construct; identical to SEQ ID NO: 6882
  misc_feature 1..408: note = Synthetic polypeptide
  source 1..408: mol_type = other DNA

SEQ ID NO: 12804 - DNA, 401 bp, synthetic construct; identical to SEQ ID NO: 6883
  misc_feature 1..401: note = Synthetic polypeptide
  source 1..401: mol_type = other DNA

SEQ ID NO: 12805 - DNA, 510 bp, synthetic construct; identical to SEQ ID NO: 6884
  misc_feature 1..510: note = Synthetic polypeptide
  source 1..510: mol_type = other DNA

SEQ ID NO: 12806 - DNA, 648 bp, synthetic construct
  misc_feature 1..648: note = Synthetic polypeptide
  source 1..648: mol_type = other DNA
gctgggggtagtggctcacgcctgtgatcctagcactttgggaggccgaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggatgaaaacatggacctcttggaaggtataactggctttgaagactctgtccgaaagtttatctgccatgttgtgggtatcacttaccagcacattgaccgctggctgctggccgagatgctcggggatctgtcggacagccagctaaaggtgtggatgagcaaatacggctggagtgccgacgagtcggggcagatcttcatctgtagccaagaagagagcattaaacccaagaacattgtggagaagattgactttgacagtgtgtccagcatcatggcctcctcccagtaa

SEQ ID NO: 12807 - DNA, 405 bp, synthetic construct
  misc_feature 1..405: note = Synthetic polypeptide
  source 1..405: mol_type = other DNA
gctgggggtagtggctcacgcctgtgatcctagcactttgggaggccgaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctgggtgtgtccagcatcatggcctcctcccagtaacttcaggtgtttaataaagatgtgttga

SEQ ID NO: 12808 - DNA, 627 bp, synthetic construct
  misc_feature 1..627: note = Synthetic polypeptide
  source 1..627: mol_type = other DNA
gctgggggtagtggctcacgcctgtgatcctagcactttgggaggccgaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggatgaaaacatggacctcttggaaggtataactggctttgaagactctgtccgaaagtttatctgccatgttgtgggtatcacttaccagcacattgaccgctggctgctggccgagatgctcggggatctgtcggacagccagctaaaggtgtggatgagcaaatacggctggagtgccgacgagtcggggcagatcttcatctgtagccaagaagagagcattaaacccaagaacattgtggagaagattgactttgacagtgagtggtga

SEQ ID NO: 12809 - DNA, 411 bp, synthetic construct
  misc_feature 1..411: note = Synthetic polypeptide
  source 1..411: mol_type = other DNA
gctgggggtagtggctcacgcctgtgatcctagcactttgggaggccgaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctgggcttctctgttccgcttccttctcttaaatcgcatgtgctggctgggcatggtggctcacacctgt

SEQ ID NO: 12810 - DNA, 570 bp, synthetic construct
  misc_feature 1..570: note = Synthetic polypeptide
  source 1..570: mol_type = other DNA
gctgggggtagtggctcacgcctgtgatcctagcactttgggaggccgaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggatgaaaacatggacctcttggaaggtataactggctttgaagactctgtccgaaagtacagccagctaaaggtgtggatgagcaaatacggctggagtgccgacgagtcggggcagatcttcatctgtagccaagaagagagcattaaacccaagaacattgtggagaagattgactttgacagtgtgtccagcatcatggcctcctcccagtaa

SEQ ID NO: 12811 - DNA, 2254 bp, synthetic construct; identical to SEQ ID NO: 8053
  misc_feature 1..2254: note = Synthetic polypeptide
  source 1..2254: mol_type = other DNA

SEQ ID NO: 12812 - DNA, 2044 bp, synthetic construct; identical to SEQ ID NO: 8054
  misc_feature 1..2044: note = Synthetic polypeptide
  source 1..2044: mol_type = other DNA

SEQ ID NO: 12813 - DNA, 1735 bp, synthetic construct; identical to SEQ ID NO: 8055
  misc_feature 1..1735: note = Synthetic polypeptide
  source 1..1735: mol_type = other DNA

SEQ ID NO: 12814 - DNA, 206 bp, synthetic construct; identical to SEQ ID NO: 6759
  misc_feature 1..206: note = Synthetic polypeptide
  source 1..206: mol_type = other DNA

SEQ ID NO: 12815 - DNA, 450 bp, synthetic construct
  misc_feature 1..450: note = Synthetic polypeptide
  source 1..450: mol_type = other DNA
gtgcctgaggtcccagctactcgggaggatcacttgggcctgggagttcaaggctgcagtgagctgtgatcacatcactgcactccagctttggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctga

SEQ ID NO: 12816 - DNA, 186 bp, synthetic construct; identical to SEQ ID NO: 7638
  misc_feature 1..186: note = Synthetic polypeptide
  source 1..186: mol_type = other DNA

SEQ ID NO: 12817 - DNA, 3458 bp, synthetic construct
  misc_feature 1..3458: note = Synthetic polypeptide
  source 1..3458: mol_type = other DNA
tttggtgccgtgactcagaccgggggacctcccttgggagatcaatccctgtcctcctgttctttgctccatgagaaagatccacctatgacctcaggtcctcagacccaccagcccaaggaacatctcaccaattttaaatccggtaagcggcctcttcttactctcttctccaacctctctcactatccctcaaccactttctcctttccactcttccatctctcccttctcttaatttcaattcctttcattttctgatagagacaaaggagacctgttttatccgtggacccaaaactccagcaccagtcacggactgggaaggcagccttcccttggtgtttaatcattgcagggacacctctctgattattcacccacgtttcagaggtgtcagaccatgcagggacacctgccttggtccttcacccttagtggcaagtcccgcttttctgggggaggggcaagtaccccaaccccttctctccatgtctctactccttctccacctttctggggggcaagaaacccccaaccccttctccttcacccttagtggcaagtcctgcttttctaggggaggggcaagtagcccaacctcgtatctctgtgccccgaacccttatttccacgccccaacaccttatatctctgtgccccaatcccttatttctgtgccccaacctcttatacctctgcgccccaatcccttatttccatgcccctatcttgtatctctgtgcccctacccctttcccacttttctggagggtaagaacccccgaaccccttccctccgtgtctctactctcttctctgggcttgcctccttcactatgggcaaccttccaccttccattcctccttctccctcagcctatgttcttaagaacttaaatcctcttcaactctcacctgacctaaaatccaagtgtcttattttcttctgtaatgccgcttgaccccaatacaaactcgacagtagttccaaatagccagaaaatggcactttcaatttttccatcctacaagatctaaataattcttgtcgtaaaataggcaaatggtctgaggtgcctgacagccaggcattcttttacacatcagtccctctctagtctctgttcccaatgcagcttatcccaaatcttccttctttctctcccacctgccccctcagtcccaaccccaagcgcctctgagtcttcctaatcttccttttctacagacccatctgacctctcccctcctccccaggctgctccttgccaggccaagctaggtcccaattcttcctcagcctctgctcctccaccctataatccttttatcacctctcctcctcacacctggtctggcttacagttttgttccgtgactagccctcccccacctgcccagcaatttactcttaaaaaggtggctgaagctaaaggcatagtcaagattaatgctcctttttctttatcagacctctcccaaatcagtgagcatttaggctctttcatcaaatatgaaaaacccagcccagttcatgacttgtttggcagcaaccctgagacgctttacagcctagaccctaaaaggtcaaaaggccatcttattctcaatatacactttattgcccaatctgctcccgacattaaataaaactccaaaaattaaattccggccctcaaaccccacaacaggatttaattaacctcgccttcaaggtgtacaataatagaaaacagttgcaattccttgcctccactgtgagacaaaccccagtcacatctccagcacacaagaacttccaaacgcctgaaccgcagtggccaggtgttcctccagaacctcctcccccaggagcttgctacaagtgccagaaatctggccaccaggccaaagaatgcctgcagcccaggtttcctcctaagccacatcccatctgtgcgggaccccactggaaatcagactgtccaactcacctggcagccactcccagagcccctggaactctggcccaaggctctctgactccttcccagatcttcttggcttagcggctgaagactgacgctgcccgattgccttgcaagccccctcgaccatcacggacgctgagcttcgggtaactctcacagtggagggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacattatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactga

SEQ ID NO: 12818 - DNA, 921 bp, synthetic construct
  misc_feature 1..921: note = Synthetic polypeptide
  source 1..921: mol_type = other DNA
cgaggcggttggatcacctgaggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaagggagttgctgctgggagctccagctcagtgaaatggacagaagggcagagcaaccacagcacagggtacgagagcgataaccacacaacgcccatcctctgcggagcccaatacagaatacacacgcacggtgtcttcagaggcattcaggatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactggtgagaaaccataccagtgtgacttcaaggactgtgaacgaaggttttctcgttcagaccagctcaaaagacaccaaaggagacatacaggtgtgaaaccattccagtgtaaaacttgtcagcgaaagttctcccggtccgaccacctgaagacccacaccaggactcatacaggtgaaaagcccttcagctgtcggtggccaagttgtcagaaaaagtttgcccggtcagatgaattagtccgccatcacaacatgcatcagagaaacatgaccaaactccagctggcgctttga

SEQ ID NO: 12819 - DNA, 330 bp, synthetic construct
  misc_feature 1..330: note = Synthetic polypeptide
  source 1..330: mol_type = other DNA
cgaggcggttggatcacctgaggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaaggggtaa

SEQ ID NO: 12820 - DNA, 930 bp, synthetic construct
  misc_feature 1..930: note = Synthetic polypeptide
  source 1..930: mol_type = other DNA
cgaggcggttggatcacctgaggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaagggagttgctgctgggagctccagctcagtgaaatggacagaagggcagagcaaccacagcacagggtacgagagcgataaccacacaacgcccatcctctgcggagcccaatacagaatacacacgcacggtgtcttcagaggcattcaggatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactggtgagaaaccataccagtgtgacttcaaggactgtgaacgaaggttttctcgttcagaccagctcaaaagacaccaaaggagacatacaggtgtgaaaccattccagtgtaaaacttgtcagcgaaagttctcccggtccgaccacctgaagacccacaccaggactcatacaggtaaaacaagtgaaaagcccttcagctgtcggtggccaagttgtcagaaaaagtttgcccggtcagatgaattagtccgccatcacaacatgcatcagagaaacatgaccaaactccagctggcgctttga

SEQ ID NO: 12821 - DNA, 879 bp, synthetic construct
  misc_feature 1..879: note = Synthetic polypeptide
  source 1..879: mol_type = other DNA
cgaggcggttggatcacctgaggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaagggccacagcacagggtacgagagcgataaccacacaacgcccatcctctgcggagcccaatacagaatacacacgcacggtgtcttcagaggcattcaggatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactggtgagaaaccataccagtgtgacttcaaggactgtgaacgaaggttttctcgttcagaccagctcaaaagacaccaaaggagacatacaggtgtgaaaccattccagtgtaaaacttgtcagcgaaagttctcccggtccgaccacctgaagacccacaccaggactcatacaggtaaaacaagtgaaaagcccttcagctgtcggtggccaagttgtcagaaaaagtttgcccggtcagatgaattagtccgccatcacaacatgcatcagagaaacatgaccaaactccagctggcgctttga

SEQ ID NO: 12822 - DNA, 870 bp, synthetic construct
  misc_feature 1..870: note = Synthetic polypeptide
  source 1..870: mol_type = other DNA
cgaggcggttggatcacctgaggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaagggccacagcacagggtacgagagcgataaccacacaacgcccatcctctgcggagcccaatacagaatacacacgcacggtgtcttcagaggcattcaggatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactggtgagaaaccataccagtgtgacttcaaggactgtgaacgaaggttttctcgttcagaccagctcaaaagacaccaaaggagacatacaggtgtgaaaccattccagtgtaaaacttgtcagcgaaagttctcccggtccgaccacctgaagacccacaccaggactcatacaggtgaaaagcccttcagctgtcggtggccaagttgtcagaaaaagtttgcccggtcagatgaattagtccgccatcacaacatgcatcagagaaacatgaccaaactccagctggcgctttga

SEQ ID NO: 12823 - DNA, 752 bp, synthetic construct
  misc_feature 1..752: note = Synthetic polypeptide
  source 1..752: mol_type = other DNA
cctccaggtgagatggccctgctgtggcaccagtgaccaacgggaacacaacggtgccacccctgaacgatgatctggacatctttggaccgatgatttctaatcccttacctgcaactgtcatgcccccagctcaggggacaccctctgcaccagcagctgcaaccctgtctacagtaacatctggggatctagatttattcactgagcaaactacaaaatcagaagaagtggcaaagaaacaactttccaaagactccatcttatctctgtatggcacaggaaccattcaacagcaaagtactcctggtgtatttatgggacccacaaatataccatttacctcacaagcaccagctgcatttcagggctttccatcgatgggcgtgcctgtgcctgcagctcctggccttataggaaatgtgatgggacagagtccaagcatgatggtgggcatgcccatgcccaatgggtttatgggaaatgcacaaactggtgtgatgccacttcctcagaacgttgttggcccccaaggaggaatggtgggacaaatgggtgcaccccagagtaagtttggcctgccgcaagctcagcagccccagtggagcctctcacagatgaatcagcagatggctggcatgagtatcagtagtgcaacccctactgcaggttttggccagccctccagcacaacagcaggatggtctggaagctcatcaggtcagactctcagcacacaactgtggaaatga

SEQ ID NO: 12824 - DNA, 740 bp, synthetic construct
  misc_feature 1..740: note = Synthetic polypeptide
  source 1..740: mol_type = other DNA
cctccaggtgagatggccctgctgtggcaccagtgaccaacgggaacacaacggtgccacccctgaacgatgatctggacatctttggaccgatgatttctaatcccttacctgcaactgtcatgcccccagctcaggggacaccctctgcaccagcagctgcaaccctgtctacagtaacatctggggatctagatttattcactgagcaaactacaaaatcagaagaagtggcaaagaaacaactttccaaagactccatcttatctctgtatggcacaggaaccattcaacagcaaagtactcctggtgtatttatgggacccacaaatataccatttacctcacaagcaccagctgcatttcagggctttccatcgatgggcgtgcctgtgcctgcagctcctggccttataggaaatgtgatgggacagagtccaagcatgatggtgggcatgcccatgcccaatgggtttatgggaaatgcacaaactggtgtgatgccacttcctcagaacgttgttggcccccaaggaggaatggtgggacaaatgggtgcaccccagagtaagtttggcctgccgcaagctcagcagccccagtggagcctctcacagataatgcagaagggtgatgctgttctccagcactccatcagtgcaatctactggccaatgacaaggtggttaaaatgtcctttagtagatgaatcagcagatggctggcatgagtatcagtag

SEQ ID NO: 12825 - DNA, 2157 bp, synthetic construct; identical to SEQ ID NO: 6426
  misc_feature 1..2157: note = Synthetic polypeptide
  source 1..2157: mol_type = other DNA

SEQ ID NO: 12826 - DNA, 799 bp, synthetic construct; identical to SEQ ID NO: 6427
  misc_feature 1..799: note = Synthetic polypeptide
  source 1..799: mol_type = other DNA

SEQ ID NO: 12827 - DNA, 336 bp, synthetic construct; identical to SEQ ID NO: 6428
  misc_feature 1..336: note = Synthetic polypeptide
  source 1..336: mol_type = other DNA

SEQ ID NO: 12828 - DNA, 374 bp, synthetic construct; identical to SEQ ID NO: 8117
  misc_feature 1..374: note = Synthetic polypeptide
  source 1..374: mol_type = other DNA

SEQ ID NO: 12829 - DNA, 595 bp, synthetic construct
  misc_feature 1..595: note = Synthetic polypeptide
  source 1..595: mol_type = other DNA
agaggggatgatttgaggaggcagaattgaccacgggcaccatgaaggaaaagccaagcaggccctgcatgaggcggtggagatggaccgggccatcgggcaggcaggcagcttgacctcctcggaagacactctgaccgtggtcactgcggaccattcccacgtcttcacatttggtggatacaccccccgtggcaactctatctttggtctggcccccatgctgagtgacacagacaagaagcccttcactgccatcctgtatggcaatgggcctggctacaaggtggtgggcggtgaacgagagaatgtctccatggtggactatgctcacaacaactaccaggcgcagtctgctgtgcccctgcgccacgagacccacggcggggaggacgtggccgtcttctccaagggccccatggcgcacctgctgcacggcgtccacgagcagaactacgtcccccacgtgatggcgtatgcagcctgcatcggggccaacctcggccactgtgctcctgccagctcggcaggcagccttgctgcaggccccctgctgctcgcgctggccctctaccccctgagcgtcctgttctga

SEQ ID NO: 12830 - DNA, 618 bp, synthetic construct
  misc_feature 1..618: note = Synthetic polypeptide
  source 1..618: mol_type = other DNA
ttccagtgtcagccctgcccttctagccgaatcacctctgggcaagtctcgtgaccttcctaacctcatttatctcacctgtataatgggctaataatacctagtaccctgggaagtctggcagggttgcttcgaggagacgccgtggtggagctgggcctcaacgattacctagacattgtctgcccccactacgaaggcccagggccccctgagggccccgagacgtttgctttgtacatggtggactggccaggctatgagtcctgccaggcagagggcccccgggcctacaagcgctgggtgtgctccctgccctttggccatgttcaattctcagagaagattcagcgcttcacacccttctccctcggctttgagttcttacctggagagacttactactacatctcggtgcccactccagagagttctggccagtgcttgaggctccaggtgtctgtctgctgcaaggagaggaagtctgagtcagcccatcctgttgggagccctggagagagtggcacatcagggtggcgagggggggacactcccagccccctctgtctcttgctattactgctgcttctgattcttcgtcttctgcgaattctgtga

SEQ ID NO: 12831 - DNA, 594 bp, synthetic construct
  misc_feature 1..594: note = Synthetic polypeptide
  source 1..594: mol_type = other DNA
ttccagtgtcagccctgcccttctagccgaatcacctctgggcaagtctcgtgaccttcctaacctcatttatctcacctgtataatgggctaataatacctagtaccctgggaagtctggcagggttgcttcgaggagacgccgtggtggagctgggcctcaacgattacctagacattgtctgcccccactacgaaggcccagggccccctgagggccccgagacgtttgctttgtacatggtggactggccaggctatgagtcctgccaggcagagggcccccgggcctacaagcgctgggtgtgctccctgccctttggccatgttcaattctcagagaagattcagcgcttcacacccttctccctcggctttgagttcttacctggagagacttactactacatctcggtgcccactccagagagttctggccagtgcttgaggctccaggtgtctgtctgctgcaaggagaggaaccttccctctcatcccaaggagccagagtcctcccaagatcccctggaggaggagggatccctgctgcctgcactgggggtgccaattcagaccgacaagatggagcattga

SEQ ID NO: 12832 - DNA, 636 bp, synthetic construct
  misc_feature 1..636: note = Synthetic polypeptide
  source 1..636: mol_type = other DNA
ttccagtgtcagccctgcccttctagccgaatcacctctgggcaagtctcgtgaccttcctaacctcatttatctcacctgtataatgggctaataatacctagtaccctgggaagtctggcagggttgcttcgaggagacgccgtggtggagctgggcctcaacgattacctagacattgtctgcccccactacgaaggcccagggccccctgagggccccgagacgtttgctttgtacatggtggactggccaggctatgagtcctgccaggcagagggcccccgggcctacaagcgctgggtgtgctccctgccctttggccatgttcaattctcagagaagattcagcgcttcacacccttctccctcggctttgagttcttacctggagagacttactactacatctcggtgcccactccagagagttctggccagtgcttgaggctccaggtgtctgtctgctgcaaggagaggagagccagagtcctcccaagatcccctggaggaggagggatccctgctgcctgcactgggggtgccaattcagaccgacaagatggagcattgatgggggagatcagagggtctgaggtgactcttgcaggagcctgtcccctcatcacaggctaa

SEQ ID NO: 12833 - DNA, 471 bp, synthetic construct
  misc_feature 1..471: note = Synthetic polypeptide
  source 1..471: mol_type = other DNA
ggccaggtgcggtggctcacgcctgtaatcccagcactccgggaggccgaggcaggcggatcacttgaggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaccgcatcagccacgcccagaagttccgtaagggggcagggaagggccgcgttggaggccgctggaagtga

SEQ ID NO: 12834 - DNA, 519 bp, synthetic construct
  misc_feature 1..519: note = Synthetic polypeptide
  source 1..519: mol_type = other DNA
ggccaggtgcggtggctcacgcctgtaatcccagcactccgggaggccgaggcaggcggatcacttgaggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggcccggtctgcctggctgcctccatcacagccctcctgccctgccagggagaaagcccaggagctgtcggactggatccaccagctggagtctgagaagttcgacctgatggcgaagctgaaacagcagaaatatgagatcaacgtgctgtacaaccgcatcagccacgcccagaagttccgtaagggggcagggaagggccgcgttggaggccgctggaagtga

SEQ ID NO: 12835 - DNA, 293 bp, synthetic construct
  misc_feature 1..293: note = Synthetic polypeptide
  source 1..293: mol_type = other DNA
ggccaggtgcggtggctcacgcctgtaatcccagcactccgggaggccgaggcaggcggatcacttgaggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccg

SEQ ID NO: 12836 - DNA, 168 bp, synthetic construct
  misc_feature 1..168: note = Synthetic polypeptide
  source 1..168: mol_type = other DNA
ggccaggtgcggtggctcacgcctgtaatcccagcactccgggaggccgaggcaggcggatcacttgaggaggagaagatgaggaaggaagaggaagaggccaagaagcgggcagaggatgatgccaagaaaaagaaggtgctgtccaacatgggggcccattttggc

SEQ ID NO: 12837 - DNA, 126 bp, synthetic construct
  misc_feature 1..126: note = Synthetic polypeptide
  source 1..126: mol_type = other DNA
ggccaggtgcggtggctcacgcctgtaatcccagcactccgggaggccgaggcaggcggatcacttgaggaggagaagatgaggaaggaagaggaagaggccaagaagcgggcagaggatgatgcc

SEQ ID NO: 12838 - DNA, 1089 bp, synthetic construct; identical to SEQ ID NO: 8101
  misc_feature 1..1089: note = Synthetic polypeptide
  source 1..1089: mol_type = other DNA

SEQ ID NO: 12839 - DNA, 1224 bp, synthetic construct; identical to SEQ ID NO: 6690
  misc_feature 1..1224: note = Synthetic polypeptide
  source 1..1224: mol_type = other DNA

SEQ ID NO: 12840 - DNA, 588 bp, synthetic construct; identical to SEQ ID NO: 6349
  misc_feature 1..588: note = Synthetic polypeptide
  source 1..588: mol_type = other DNA

SEQ ID NO: 12841 - DNA, 1376 bp, synthetic construct; identical to SEQ ID NO: 6350
  misc_feature 1..1376: note = Synthetic polypeptide
  source 1..1376: mol_type = other DNA

SEQ ID NO: 12842 - DNA, 1280 bp, synthetic construct; identical to SEQ ID NO: 6351
  misc_feature 1..1280: note = Synthetic polypeptide
  source 1..1280: mol_type = other DNA

SEQ ID NO: 12843 - DNA, 1259 bp, synthetic construct; identical to SEQ ID NO: 6352
  misc_feature 1..1259: note = Synthetic polypeptide
  source 1..1259: mol_type = other DNA

SEQ ID NO: 12844 - DNA, 981 bp, synthetic construct; identical to SEQ ID NO: 6353
  misc_feature 1..981: note = Synthetic polypeptide
  source 1..981: mol_type = other DNA

SEQ ID NO: 12845 - DNA, 691 bp, synthetic construct; identical to SEQ ID NO: 6354
  misc_feature 1..691: note = Synthetic polypeptide
  source 1..691: mol_type = other DNA

SEQ ID NO: 12846 - DNA, 382 bp, synthetic construct; identical to SEQ ID NO: 434
  misc_feature 1..382: note = Synthetic polypeptide
  source 1..382: mol_type = other DNA

SEQ ID NO: 12847 - DNA, 295 bp, synthetic construct; identical to SEQ ID NO: 8323
  misc_feature 1..295: note = Synthetic polypeptide
  source 1..295: mol_type = other DNA

SEQ ID NO: 12848 - DNA, 1117 bp, synthetic construct; identical to SEQ ID NO: 8324
  misc_feature 1..1117: note = Synthetic polypeptide
  source 1..1117: mol_type = other DNA

SEQ ID NO: 12849 - DNA, 931 bp, synthetic construct; identical to SEQ ID NO: 8325
  misc_feature 1..931: note = Synthetic polypeptide
  source 1..931: mol_type = other DNA

SEQ ID NO: 12850 - DNA, 220 bp, synthetic construct; identical to SEQ ID NO: 7991
  misc_feature 1..220: note = Synthetic polypeptide
  source 1..220: mol_type = other DNA

SEQ ID NO: 12851 - DNA, 334 bp, synthetic construct; identical to SEQ ID NO: 7992
  misc_feature 1..334: note = Synthetic polypeptide
  source 1..334: mol_type = other DNA

SEQ ID NO: 12852 - DNA, 828 bp, synthetic construct
  misc_feature 1..828: note = Synthetic polypeptide
  source 1..828: mol_type = other DNA
tgataatgttgacttttacccaagccctgtgatcctggaaaactaaggcttaagaaatgccttcccactgttttgtgttctggaacacagcatattgcaaaaaaacatccttccccaagtgagttaggtaagactggtgtatgcccctctggttcaccaatgacaaagccagacacagactccatattccaaatctcctcatgaaagctttgaggaacttcttgtccccactgatcagttggaacaaactttggttaaaacttctctccttcccccagcttcccgaactttggcttaccctcagcttgagccagcgcacatctcctccttaacagcctctcctgagaataggctggcttcaagcttgtgaacaccttcttcagcttccttcgacgcaaaacagactttttcattggaggagaagaagggatggcagagaagcttatcacacagactttcagccaccacaatcagctggcacagaagacccggcgggagaagagagcccggcaggaggccgagcggcgggagaaggcggagcgggcggccagactggccaaggaagccaagtcagagacctcagggccccagatcaaggagctaactgatgaagaggcagagaggctgcagctagagattgaccagaaaaaggatgcagagaatcatgaggcccagctcaagaacggcagccttgactccccagggaagcaggatactgaggaagatgaggaggaagatgagaaggacaaaggaaaactgaagcccaacctaggcaacggggcagacctgcccaattaccgctggacccagaccctgtcggagctggac

SEQ ID NO: 12853 - DNA, 1278 bp, synthetic construct
  misc_feature 1..1278: note = Synthetic polypeptide
  source 1..1278: mol_type = other DNA
tgataatgttgacttttacccaagccctgtgatcctggaaaactaaggcttaagaaatgccttcccactgttttgtgttctggaacacagcatattgcaaaaaaacatccttccccaagtgagttaggtaagactggtgtatgcccctctggttcaccaatgacaaagccagacacagactccatattccaaatctcctcatgaaagctttgaggaacttcttgtccccactgatcagttggaacaaactttggttaaaacttctctccttcccccagcttcccgaactttggcttaccctcagcttgagccagcgcacatctcctccttaacagcctctcctgagaataggctggcttcaagcttgtgaacaccttcttcagcttccttcgacgcaaaacagactttttcattggaggagaagaagggatggcagagaagcttatcacacagactttcagccaccacaatcagctggcacagaagacccggcgggagaagagagcccggcaggaggccgagcggcgggagaaggcggagcgggcggccagactggccaaggaagccaagtcagagacctcagggccccagatcaaggagctaactgatgaagaggcagagaggctgcagctagagattgaccagaaaaaggatgcagagaatcatgaggcccagctcaagaacggcagccttgactccccagggaagcaggatactgaggaagatgaggaggaagatgagaaggacaaaggaaaactgaagcccaacctaggcaacggggcagacctgcccaattaccgctggacccagaccctgtcggagctggacctggcggtccctttctgtgtgaacttccggctgaaagggaaggacatggtggtggacatccagcggcggcacctccgggtggggctcaaggggcagccagcgatcattgatggggagctctacaatgaagtgaaggtggaggagagctcgtggctcattgaggacggcaaggtggtgactgtgcatctggagaagatcaataagatggagtggtggagccgcttggtgtccagtgaccctgagatcaacaccaagaagattaaccctgagaattccaagctgtcagacctggacagtgagactcgcagcatggtggaaaagatgatgtatgaccagcgacagaagtccatggggctgccaacttcagacgaacagaagaaacaggagattctgaagaagttcatggatcaacatccggagatggatttttccaaggctaaattcaactag

SEQ ID NO: 12854 - DNA, 443 bp, synthetic construct
  misc_feature 1..443: note = Synthetic polypeptide
  source 1..443: mol_type = other DNA
gctgggcacagtggctcacacctgtaatcccagcactctgggaggccaagtctattgcgtctgcagacatggatttcaaccagctggaggcattcttgactgctcaaaccaaaaagcaaggtgggatcacatctgaccaagctgctgtcatttccaaattctggaagagccacaagacaaaaatccgtgagagcctcatgaaccagagccgctggaatagcgggcttcggggcctgagctggagagttgatggcaagtctcagtcaaggcactcagctcaaatacacacacctgttgccattatagagctggaattaggcaaatatggacaggaatctgaatttctgtgtttggaatttgatgaggtcaaagtcaaccaaattctgaagacgctgtcagaggtagaagaaagtatcagcacactgatcagccagcctaactga

SEQ ID NO: 12855 - DNA, 350 bp, synthetic construct
  misc_feature 1..350: note = Synthetic polypeptide
  source 1..350: mol_type = other DNA
gctgggcacagtggctcacacctgtaatcccagcactctgggaggccaagtctattgcgtctgcagacatggatttcaaccagctggaggcattcttgactgctcaaaccaaaaagcaaggtgggatcacatctgaccaagctgctgtcatttccaaattctggaagagccacaagacaaaaatccgtgagagcctcatgaaccagagccgctggaatagcgggcttcggggcctgagctggagagttgatggcaagtctcagtcaaggcactcagctcaaatacacacacctgttgccattatagagctggaattaggcaaatatggacaggttcattgcaaccagtga

SEQ ID NO: 12856 - DNA, 272 bp, synthetic construct; identical to SEQ ID NO: 8166
  misc_feature 1..272: note = Synthetic polypeptide
  source 1..272: mol_type = other DNA

SEQ ID NO: 12857 - DNA, 89 bp, synthetic construct; identical to SEQ ID NO: 8167
  misc_feature 1..89: note = Synthetic polypeptide
  source 1..89: mol_type = other DNA

SEQ ID NO: 12858 - DNA, 223 bp, synthetic construct; identical to SEQ ID NO: 8168
  misc_feature 1..223: note = Synthetic polypeptide
  source 1..223: mol_type = other DNA

SEQ ID NO: 12859 - DNA, 427 bp, synthetic construct; identical to SEQ ID NO: 573
  misc_feature 1..427: note = Synthetic polypeptide
  source 1..427: mol_type = other DNA

SEQ ID NO: 12860 - DNA, 1004 bp, synthetic construct; identical to SEQ ID NO: 8920
  misc_feature 1..1004: note = Synthetic polypeptide
  source 1..1004: mol_type = other DNA

SEQ ID NO: 12861 - DNA, 887 bp, synthetic construct; identical to SEQ ID NO: 8921
  misc_feature 1..887: note = Synthetic polypeptide
  source 1..887: mol_type = other DNA

SEQ ID NO: 12862 - DNA, 1138 bp, synthetic construct; identical to SEQ ID NO: 7655
  misc_feature 1..1138: note = Synthetic polypeptide
  source 1..1138: mol_type = other DNA

SEQ ID NO: 12863 - DNA, 418 bp, synthetic construct; identical to SEQ ID NO: 8331
  misc_feature 1..418: note = Synthetic polypeptide
  source 1..418: mol_type = other DNA

SEQ ID NO: 12864 - DNA, 488 bp, synthetic construct; identical to SEQ ID NO: 8332
  misc_feature 1..488: note = Synthetic polypeptide
  source 1..488: mol_type = other DNA

SEQ ID NO: 12865 - DNA, 563 bp, synthetic construct; identical to SEQ ID NO: 8333
  misc_feature 1..563: note = Synthetic polypeptide
  source 1..563: mol_type = other DNA

SEQ ID NO: 12866 - DNA, 739 bp, synthetic construct; identical to SEQ ID NO: 8334
  misc_feature 1..739: note = Synthetic polypeptide
  source 1..739: mol_type = other DNA

SEQ ID NO: 12867 - DNA, 415 bp, synthetic construct; identical to SEQ ID NO: 8335
  misc_feature 1..415: note = Synthetic polypeptide
  source 1..415: mol_type = other DNA

SEQ ID NO: 12868 - DNA, 478 bp, synthetic construct; identical to SEQ ID NO: 8336
  misc_feature 1..478: note = Synthetic polypeptide
  source 1..478: mol_type = other DNA

SEQ ID NO: 12869 - DNA, 609 bp, synthetic construct; identical to SEQ ID NO: 8108
  misc_feature 1..609: note = Synthetic polypeptide
  source 1..609: mol_type = other DNA

SEQ ID NO: 12870 - DNA, 320 bp, synthetic construct; identical to SEQ ID NO: 8109
  misc_feature 1..320: note = Synthetic polypeptide
  source 1..320: mol_type = other DNA

SEQ ID NO: 12871 - DNA, 1047 bp, synthetic construct; identical to SEQ ID NO: 8738
  misc_feature 1..1047: note = Synthetic polypeptide
  source 1..1047: mol_type = other DNA

SEQ ID NO: 12872 - DNA, 1926 bp, synthetic construct; identical to SEQ ID NO: 9669
  misc_feature 1..1926: note = Synthetic polypeptide
  source 1..1926: mol_type = other DNA

SEQ ID NO: 12873 - DNA, 2439 bp, synthetic construct; identical to SEQ ID NO: 9670
  misc_feature 1..2439: note = Synthetic polypeptide
  source 1..2439: mol_type = other DNA

SEQ ID NO: 12874 - DNA, 2481 bp, synthetic construct; identical to SEQ ID NO: 9671
  misc_feature 1..2481: note = Synthetic polypeptide
  source 1..2481: mol_type = other DNA

SEQ ID NO: 12875 - DNA, 32 bp, synthetic construct
  misc_feature 1..32: note = Synthetic polypeptide
  source 1..32: mol_type = other DNA
agtgcttggcctctggggcctgcagaggctga

SEQ ID NO: 12876 - DNA, 331 bp, synthetic construct
  misc_feature 1..331: note = Synthetic polypeptide
  source 1..331: mol_type = other DNA
agtgcttggcctctggggcctgcagaggctgaccccgcactacatctacccaccagccatcgtgcagcccagcgtggtgatcccagccgcccctgtcccgtcgctgtcctcgccctacattgagtacacgccggccagcccggcctacgcccagtacccaccggccacctatgaccagtacccatacgccgcctcgcctgccacggctgccagcttcgtgggctacagctaccctgccgccgtgccccaggccctctcagccgcagcacccgcgggcaccactttcgtgcagtaccaggcgccgcagctgcagcctgacaggatgcagtga

SEQ ID NO: 12877 - DNA, 299 bp, synthetic construct; identical to SEQ ID NO: 485
  misc_feature 1..299: note = Synthetic polypeptide
  source 1..299: mol_type = other DNA

SEQ ID NO: 12878 - DNA, 682 bp, synthetic construct; identical to SEQ ID NO: 9078
  misc_feature 1..682: note = Synthetic polypeptide
  source 1..682: mol_type = other DNA

SEQ ID NO: 12879 - DNA, 78 bp, synthetic construct; identical to SEQ ID NO: 9079
  misc_feature 1..78: note = Synthetic polypeptide
  source 1..78: mol_type = other DNA

SEQ ID NO: 12880 - DNA, 481 bp, synthetic construct; identical to SEQ ID NO: 9080
  misc_feature 1..481: note = Synthetic polypeptide
  source 1..481: mol_type = other DNA

SEQ ID NO: 12881 - DNA, 292 bp, synthetic construct; identical to SEQ ID NO: 9081
  misc_feature 1..292: note = Synthetic polypeptide
  source 1..292: mol_type = other DNA

SEQ ID NO: 12882 - DNA, 236 bp, synthetic construct; identical to SEQ ID NO: 9082
  misc_feature 1..236: note = Synthetic polypeptide
  source 1..236: mol_type = other DNA

SEQ ID NO: 12883 - DNA, 682 bp, synthetic construct; identical to SEQ ID NO: 9083
  misc_feature 1..682: note = Synthetic polypeptide
  source 1..682: mol_type = other DNA

SEQ ID NO: 12884 - DNA, 347 bp, synthetic construct; identical to SEQ ID NO: 9084
  misc_feature 1..347: note = Synthetic polypeptide
  source 1..347: mol_type = other DNA

SEQ ID NO: 12885 - DNA, 273 bp, synthetic construct; identical to SEQ ID NO: 9085
  misc_feature 1..273: note = Synthetic polypeptide
  source 1..273: mol_type = other DNA

SEQ ID NO: 12886 - DNA, 317 bp, synthetic construct; identical to SEQ ID NO: 9086
  misc_feature 1..317: note = Synthetic polypeptide
  source 1..317: mol_type = other DNA

SEQ ID NO: 12887 - DNA, 369 bp, synthetic construct; identical to SEQ ID NO: 9087
  misc_feature 1..369: note = Synthetic polypeptide
  source 1..369: mol_type = other DNA

SEQ ID NO: 12888 - DNA, 175 bp, synthetic construct; identical to SEQ ID NO: 9088
  misc_feature 1..175: note = Synthetic polypeptide
  source 1..175: mol_type = other DNA

SEQ ID NO: 12889 - DNA, 493 bp, synthetic construct; identical to SEQ ID NO: 12530
  misc_feature 1..493: note = Synthetic polypeptide
  source 1..493: mol_type = other DNA

SEQ ID NO: 12890 - DNA, 2672 bp, synthetic construct; identical to SEQ ID NO: 6621
  misc_feature 1..2672: note = Synthetic polypeptide
  source 1..2672: mol_type = other DNA

SEQ ID NO: 12891 - DNA, 1767 bp, synthetic construct; identical to SEQ ID NO: 6622
  misc_feature 1..1767: note = Synthetic polypeptide
  source 1..1767: mol_type = other DNA

SEQ ID NO: 12892 - DNA, 1692 bp, synthetic construct; identical to SEQ ID NO: 6623
  misc_feature 1..1692: note = Synthetic polypeptide
  source 1..1692: mol_type = other DNA

SEQ ID NO: 12893 - DNA, 3243 bp, synthetic construct
  misc_feature 1..3243: note = Synthetic polypeptide
  source 1..3243: mol_type = other DNA
gaagcaaatggcttagtggtcagcagtgtggatttgcaaatcagaccacctgggttcagatcttagatgtccagctcgccgctgtccaagaaacgtcgcgtgtccgggcctgatccaaagccgggttctaactgctcccctgcccagtccgtgttgtccgaagtgccctcggtgccaaccaacggaatggccaagaacggcagtgaagcagacatagacgagggcctttactcccggcagctgtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccagttctacctgcgggaggaggacatcggtaaaaaccgggccgaggtatcacagccccgcctcgctgagctcaacagctatgtgcctgtcactgcctacactggacccctcgttgaggacttccttagtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgggtccttatacctttagcatctgtgacacctccaacttctccgactacatccgtggaggcatcgtcagtcaggtcaaagtacctaagaagattagctttaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcagtgggctcgggatgagtttgaaggcctcttcaagcagccagcagaaaatgtcaaccagtacctcacagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccagctcacaagctcaggagcgccgttctggtctgggcccaaacgctgtccacacccgctcacctttgatgtcaacaatcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagacagagcacaaattagagatcaccatgctgtcccagggcgtgtccatgctctattccttcttcatgccagctgccaagctcaaggaacggttggatcagccgatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctga

SEQ ID NO: 12894 - DNA, 878 bp, synthetic construct
  misc_feature 1..878: note = Synthetic polypeptide
  source 1..878: mol_type = other DNA
gaagcaaatggcttagtggtcagcagtgtggatttgcaaatcagaccacctgggttcagatcttagatgtccagctcgccgctgtccaagaaacgtcgcgtgtccgggcctgatccaaagccgggttctaactgctcccctgcccagtccgtgttgtccgaagtgccctcggtgccaaccaacggaatggccaagaacggcagtgaagcagacatagacgagggcctttactcccggcagctgtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccagttctacctgcgggaggaggacatcggtaaaaaccgggccgaggtatcacagccccgcctcgctgagctcaacagctatgtgcctgtcactgcctacactggacccctcgttgaggacttccttagtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctggg

SEQ ID NO: 12895 - DNA, 545 bp, synthetic construct
  misc_feature 1..545: note = Synthetic polypeptide
  source 1..545: mol_type = other DNA
gaagcaaatggcttagtggtcagcagtgtggatttgcaaatcagaccacctgggttcagatcttagatgtccagctcgccgctgtccaagaaacgtcgcgtgtccgggcctgatccaaagccgggttctaactgctcccctgcccagtccgtgttgtccgaagtgccctcggtgccaaccaacggaatggccaagaacggcagtgaagcagacatagacgagggcctttactcccggcagctgtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccagttctacctgcgggaggaggacatcggtaaaaaccgggccgaggtatcacagccccgcctcgctgagctcaacagctatgtgcctgtcactgcctacactggacccctcgttgaggacttccttagtggtttcca

SEQ ID NO: 12896 - DNA, 877 bp, synthetic construct
  misc_feature 1..877: note = Synthetic polypeptide
  source 1..877: mol_type = other DNA
gaagcaaatggcttagtggtcagcagtgtggatttgcaaatcagaccacctgggttcagatcttagatgtccagctcgccgctgtccaagaaacgtcgcgtgtccgggcctgatccaaagccgggttctaactgctcccctgcccagtccgtgttgtccgaagtgccctcggtgccaaccaacggaatggccaagaacggcagtgaagcagacatagacgagggcctttactcccggcagctgtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccagttctacctgcgggaggaggacatcggtaaaaaccgggccgaggtatcacagccccgcctcgctgagctcaacagctatgtgcctgtcactgcctacactggacccctcgttgaggacttccttagtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgg

SEQ ID NO: 12897 - DNA, 498 bp, synthetic construct
  misc_feature 1..498: note = Synthetic polypeptide
  source 1..498: mol_type = other DNA
gaagcaaatggcttagtggtcagcagtgtggatttgcaaatcagaccacctgggttcagatcttagatgtccagctcgccgctgtccaagaaacgtcgcgtgtccgggcctgatccaaagccgggttctaactgctcccctgcccagtccgtgttgtccgaagtgccctcggtgccaaccaacggaatggccaagaacggcagtgaagcagacatagacgagggcctttactcccggcagctgtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccagttctacctgcgggaggaggacatcggtaaaaaccgggccgaggtatcacagccccgcctcgctgagctcaacagctatgtgcctgtc

SEQ ID NO: 12898 - DNA, 615 bp, synthetic construct
  misc_feature 1..615: note = Synthetic polypeptide
  source 1..615: mol_type = other DNA
gaagcaaatggcttagtggtcagcagtgtggatttgcaaatcagaccacctgggttcagatcttagatgtccagctcgccgctgtccaagaaacgtcgcgtgtccgggcctgatccaaagccgggttctaactgctcccctgcccagtccgtgttgtccgaagtgccctcggtgccaaccaacggaatggccaagaacggcagtgaagcagacatagacgagggcctttactcccggcagctgtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccagttctacctgcgggaggaggacatcggtaaaaaccgggccgaggtatcacagccccgcctcgctgagctcaacagctatgtgcctgtcactgcctacactggacccctcgttgaggacttccttagtggtttccaggtggtggtgctcaccaacacccccctggaggaccagctgcgagtgggtgagttctgtcacaaccgtggc

SEQ ID NO: 12899 - DNA, 773 bp, synthetic construct; identical to SEQ ID NO: 10251
  misc_feature 1..773: note = Synthetic polypeptide
  source 1..773: mol_type = other DNA

SEQ ID NO: 12900 - DNA, 171 bp, synthetic construct; identical to SEQ ID NO: 6873
  misc_feature 1..171: note = Synthetic polypeptide
  source 1..171: mol_type = other DNA

SEQ ID NO: 12901 - DNA, 633 bp, synthetic construct; identical to SEQ ID NO: 6874
  misc_feature 1..633: note = Synthetic polypeptide
  source 1..633: mol_type = other DNA

SEQ ID NO: 12902 - DNA, 636 bp, synthetic construct; identical to SEQ ID NO: 6875
  misc_feature 1..636: note = Synthetic polypeptide
  source 1..636: mol_type = other DNA

SEQ ID NO: 12903 - DNA, 480 bp, synthetic construct; identical to SEQ ID NO: 6876
  misc_feature 1..480: note = Synthetic polypeptide
  source 1..480: mol_type = other DNA

SEQ ID NO: 12904 - DNA, 254 bp, synthetic construct; identical to SEQ ID NO: 6870
  misc_feature 1..254: note = Synthetic polypeptide
  source 1..254: mol_type = other DNA

SEQ ID NO: 12905 - DNA, 415 bp, synthetic construct; identical to SEQ ID NO: 6871
  misc_feature 1..415: note = Synthetic polypeptide
  source 1..415: mol_type = other DNA

SEQ ID NO: 12906 - DNA, 580 bp, synthetic construct; identical to SEQ ID NO: 6872
  misc_feature 1..580: note = Synthetic polypeptide
  source 1..580: mol_type = other DNA

SEQ ID NO: 12907 - DNA, 1267 bp, synthetic construct; identical to SEQ ID NO: 463
  misc_feature 1..1267: note = Synthetic polypeptide
  source 1..1267: mol_type = other DNA

SEQ ID NO: 12908 - DNA, 104 bp, synthetic construct
  misc_feature 1..104: note = Synthetic polypeptide
  source 1..104: mol_type = other DNA
ggccgggcacggtggctcacgcctgtaatcccagccctttgagaggctgaggcagccacctggcccagtgcttggccgaaagcacagaagacgtgacgtggtga

SEQ ID NO: 12909 - DNA, 149 bp, synthetic construct
  misc_feature 1..149: note = Synthetic polypeptide
  source 1..149: mol_type = other DNA
ggccgggcacggtggctcacgcctgtaatcccagccctttgagaggctgaggcagccacctggcccagtgcttggccgaaagcacagaagacgtgacgtgtctttcatggatgtgcaagactttgaatgaccctggcagtcaagggtga

SEQ ID NO: 12910 - DNA, 413 bp, synthetic construct
  misc_feature 1..413: note = Synthetic polypeptide
  source 1..413: mol_type = other DNA
ggccgagtagtggagaaagagtgcctgggagtcaggagtcctgggcgctgccgctgacttcctggcgtccctgagtgagtccatttccctcccaggaaaagaggaggcgagaggctatcactgcagcgacctgcctgacagaagctttggtggatcacctcaatgtgggtgtggcccaggcctacatgaaccagagaaagctggaccatgaggtgaagaccctacaggtccaggctgcccaatttgccaagcagacaggccagtggatcggaatggtggagaacttcaaccaggcactcaaggaaattggggatgtggagaactgggctcggagcatcgagctggacatgcgcaccattgccactgcactggaatatgtctacaaagggcagctgcagtctgccccttcctag

SEQ ID NO: 12911 - DNA, 320 bp, synthetic construct
  misc_feature 1..320: note = Synthetic polypeptide
  source 1..320: mol_type = other DNA
ggccgagtagtggagaaagagtgcctgggagtcaggagtcctgggcgctgccgctgacttcctggcgtccctgagtgagtccatttccctcccaggaaaagaggaggcgagaggctatcactgcagcgacctgcctgacagaagctttggtggatcacctcaatgtgggtgtggcccaggcctacatgaaccagagaaagctggaccatgaggtgaagaccctacaggtccaggctgcccaatttgccaagcagacaggccagtggatcggaatggtggagaacttcaaccaggcactcaagggctttttggtctggtga

SEQ ID NO: 12912 - DNA, 380 bp, synthetic construct
  misc_feature 1..380: note = Synthetic polypeptide
  source 1..380: mol_type = other DNA
ggccgagtagtggagaaagagtgcctgggagtcaggagtcctgggcgctgccgctgacttcctggcgtccctgagtgagtccatttccctcccaggaaaagaggaggcgagaggctatcactgcagcgacctgcctgacagaagctttggtggatcacctcaatgtgggtgtggcccaggcctacatgaaccagagaaagctggaccatgaggtgaagaccctacaggtccaggctgcccaatttgccaagcagacaggccagtggatcggaatggtggagaacttcaaccaggcactcaaggtgggccatactccctacctcaccaccccaatcctgggcccccattggctgcctccagtcaggttacctcaggtttag

SEQ ID NO: 12913 - DNA, 259 bp, synthetic construct; identical to SEQ ID NO: 7895
  misc_feature 1..259: note = Synthetic polypeptide
  source 1..259: mol_type = other DNA

SEQ ID NO: 12914 - DNA, 310 bp, synthetic construct; identical to SEQ ID NO: 7896
  misc_feature 1..310: note = Synthetic polypeptide
  source 1..310: mol_type = other DNA

SEQ ID NO: 12915 - DNA, 343 bp, synthetic construct
  misc_feature 1..343: note = Synthetic polypeptide
  source 1..343: mol_type = other DNA
aaggcagagggcctggggacaagccagcctggacatgactcctctgctgcttattaattccttacctgaactactcttgggacctcgattccttcatgggcaaaatggtcacataatagcaccatcacaagacttgccaggaatctagagcaagaggataacgtctaaagcatctagctcaggtcctcacatctggaagggtgaaacttcctacatccgagtttatcctgagagaagcaccagctatggctactcacggtctcggtctgggtcaaggggccgtgactctccataccaaagcaggggttccccacactacttctctcctttcaggccctactga

SEQ ID NO: 12916 - DNA, 1473 bp, synthetic construct
  misc_feature 1..1473: note = Synthetic polypeptide
  source 1..1473: mol_type = other DNA
aatttgaagctccaggcttaattttaaaggctttgatttaagagcaaataaaaagcaggtgtaatagaatggtgaatcaacctgtggaatttactccccaggaagccaaaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggttattcgctctataggagtctatgatgtggtggagttgaaatttgcagagaatcgagcaaatggccagtccaaagggtatgctgaggtggtggtagcctctgaaaactctgtccacaaattgttggaactcctaccagggaaagttcttaatggagaaaaagtggacgtgaggccggccacccggcagaacctgtcacagtttgaggcacaggctcggaaacgtgagtgtgtccgagtcccaagagggggaatacctccacgggcccattcccgagattctagtgattctgctgatggacgggccacaccctctgagaaccttgtaccctcatctgctcgtgtggataagccccccagtgtgctgccctacttcaatcgtcctccttcggcccttcccctgatgggtctgcccccaccaccaattccacccccaccacctctctcctcaagctttggggtccctcctcctcctcctggtatccactaccagcatctcatgcccccacctcctcgattacctcctcatcttgctgtacctccccctggggccatcccacctgcccttcacctcaatccagccttcttccccccaccaaacgctacagtggggcctccaccagatacttacatgaaggcctctgccccctataaccaccatggcagccgagattcgggccctccaccctctacagtgagtgaagccgaatttgaagatatcatgaagcgaaacagagcaatttccagcagtgccatttccaaagcagtatctggagccagtgcaggggattacagtgacgcaattgagacgctgctcacagccattgcggttatcaaacagtcccgggttgccaatgatgagcgttgccgtgtcctcatctcctctcttaaggactgtcttcatggcatcgaagccaagtcctacagtgtgggtgccagtgggagctcttccaggaaaagacatcgctcccgggaaaggtcacctagccggtcccgggagagcagcaggaggcaccgggatctgcttcataatgaagatcggcatgatgattatttccaagaaaggaaccgggagcatgagagacaccgggatagagaacgggaccggcaccactga

SEQ ID NO: 12917 - DNA, 1446 bp, synthetic construct
  misc_feature 1..1446: note = Synthetic polypeptide
  source 1..1446: mol_type = other DNA
aatttgaagctccaggcttaattttaaaggctttgatttaagagcaaataaaaagcaggtgtaatagaatggtgaatcaacctgtggaatttactccccaggaagccaaaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggttattcgctctataggagtctatgatgtggtggagttgaaatttgcagagaatcgagcaaatggccagtccaaagggtatgctgaggtggtggtagcctctgaaaactctgtccacaaattgttggaactcctaccagggaaagttcttaatggagaaaaagtggacgtgaggccggccacccggcagaacctgtcacagtttgaggcacaggctcggaaacgaatacctccacgggcccattcccgagattctagtgattctgctgatggacgggccacaccctctgagaaccttgtaccctcatctgctcgtgtggataagccccccagtgtgctgccctacttcaatcgtcctccttcggcccttcccctgatgggtctgcccccaccaccaattccacccccaccacctctctcctcaagctttggggtccctcctcctcctcctggtatccactaccagcatctcatgcccccacctcctcgattacctcctcatcttgctgtacctccccctggggccatcccacctgcccttcacctcaatccagccttcttccccccaccaaacgctacagtggggcctccaccagatacttacatgaaggcctctgccccctataaccaccatggcagccgagattcgggccctccaccctctacagtgagtgaagccgaatttgaagatatcatgaagcgaaacagagcaatttccagcagtgccatttccaaagcagtatctggagccagtgcaggggattacagtgacgcaattgagacgctgctcacagccattgcggttatcaaacagtcccgggttgccaatgatgagcgttgccgtgtcctcatctcctctcttaaggactgtcttcatggcatcgaagccaagtcctacagtgtgggtgccagtgggagctcttccaggaaaagacatcgctcccgggaaaggtcacctagccggtcccgggagagcagcaggaggcaccgggatctgcttcataatgaagatcggcatgatgattatttccaagaaaggaaccgggagcatgagagacaccgggatagagaacgggaccggcaccactga

SEQ ID NO: 12918 - DNA, 1181 bp, synthetic construct
  misc_feature 1..1181: note = Synthetic polypeptide
  source 1..1181: mol_type = other DNA
aatttgaagctccaggcttaattttaaaggctttgatttaagagcaaataaaaagcaggtgtaatagaatggtgaatcaacctgtggaatttactccccaggaagccaaaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggttattcgctctataggagtctatgatgtggtggagttgaaatttgcagagaatcgagcaaatggccagtccaaagggtatgctgaggtggtggtagcctctgaaaactctgtccacaaattgttggaactcctaccagggaaagttcttaatggagaaaaagtggacgtgaggccggccacccggcagaacctgtcacagtttgaggcacaggctcggaaacgaatacctccacgggcccattcccgagattctagtgattctgctgatggacgggccacaccctctgagaaccttgtaccctcatctgctcgtgtggataagccccccagtgtgctgccctacttcaatcgtcctccttcggcccttcccctgatggtggggcctccaccagatacttacatgaaggcctctgccccctataaccaccatggcagccgagattcgggccctccaccctctacagtgagtgaagccgaatttgaagatatcatgaagcgaaacagagcaatttccagcagtgccatttccaaagcagtatctggagccagtgcaggggattacagtgacgcaattgagacgctgctcacagccattgcggttatcaaacagtcccgggttgccaatgatgagcgttgccgtgtcctcatctcctctcttaaggactgtcttcatggcatcgaagccaagtcctacagtgtgggtgccagtgggagctcttccaggaaaagacatcgctcccgggaaaggtcacctagccggtcccgggagagcagcaggaggcaccgggatctgcttcataatgaagatcggcatgatgatta

SEQ ID NO: 12919 - DNA, 921 bp, synthetic construct
  misc_feature 1..921: note = Synthetic polypeptide
  source 1..921: mol_type = other DNA
aatttgaagctccaggcttaattttaaaggctttgatttaagagcaaataaaaagcaggtgtaatagaatggtgaatcaacctgtggaatttactccccaggaagccaaaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggttattcgctctataggagtctatgatgtggtggagttgaaatttgcagagaatcgagcaaatggccagtccaaagggtatgctgaggtggtggtagcctctgaaaactctgtccacaaattgttggaactcctaccagggaaagttcttaatggagaaaaagtggacgtgaggccggccacccggcagaacctgtcacagtttgaggcacaggctcggaaacgaatacctccacgggcccattcccgagattctagtgattctgctgatggacgggccacaccctctgagaaccttgtaccctcatctgctcgtgtggataagccccccagtgtgctgccctacttcaatcgtcctccttcggcccttcccctgatgggtctgcccccaccaccaattccacccccaccacctctctcctcaagctttggggtccctcctcctcctcctggtatccactaccagcatctcatgcccccacctcctcgattacctcctcatcttgctgtacctccccctggggccatcccacctgcccttcacctcaatccagccttcttcccc

SEQ ID NO: 12920 - DNA, 360 bp, synthetic construct
  misc_feature 1..360: note = Synthetic polypeptide
  source 1..360: mol_type = other DNA
aatttgaagctccaggcttaattttaaaggctttgatttaagagcaaataaaaagcaggtgtaatagaatggtgaatcaacctgtggaatttactccccaggaagccaaaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggggtcatctgagggacgagatttcagagtga

SEQ ID NO: 12921 - DNA, 366 bp, synthetic construct
  misc_feature 1..366: note = Synthetic polypeptide
  source 1..366: mol_type = other DNA
aatttgaagctccaggcttaattttaaaggctttgatttaagagcaaataaaaagcaggtgtaatagaatggtgaatcaacctgtggaatttactccccaggaagccaaaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggtatgctga

SEQ ID NO: 12922 - DNA, 715 bp, synthetic construct
  misc_feature 1..715: note = Synthetic polypeptide
  source 1..715: mol_type = other DNA
aatttgaagctccaggcttaattttaaaggctttgatttaagagcaaataaaaagcaggtgtaatagaatggtgaatcaacctgtggaatttactccccaggaagccaaaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggttattcgctctataggagtctatgatgtggtggagttgaaatttgcagagaatcgagcaaatggccagtccaaagggtatgctgaggtggtggtagcctctgaaaactctgtccacaaattgttggaactcctaccagggaaagttcttaatggagaaaaagtggacgtgaggccggccacccggcagaacctgtcacagtttgaggcacaggctcggaaacgaatacctccacgggcccattcccgagattctagtgattctgctgatggacgggccacaccctctgagaaccttgtaccctcatctgctcgtgtggataagccccccagtgtgctgccctacttcaatcgtcctc

SEQ ID NO: 12923 - DNA, 671 bp, synthetic construct
  misc_feature 1..671: note = Synthetic polypeptide
  source 1..671: mol_type = other DNA
aatttgaagctccaggcttaattttaaaggctttgatttaagagcaaataaaaagcaggtgtaatagaatggtgaatcaacctgtggaatttactccccaggaagccaaaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggttattcgctctataggagtctatgatgtggtggagttgaaatttgcagagaatcgagcaaatggccagtccaaagggtatgctgaggtggtggtagcctctgaaaactctgtccacaaattgttggaactcctaccagggaaagttcttaatggagaaaaagtggacgtgaggccggccacccggcagaacctgtcacagtttgaggcacaggctcggaaacgaatacctccacgggcccattcccgagattctagtgattctgctgatggacgggccacaccctctgagaaccttgtaccctcatctgctcg

SEQ ID NO: 12924 - DNA, 363 bp, synthetic construct
  misc_feature 1..363: note = Synthetic polypeptide
  source 1..363: mol_type = other DNA
aatttgaagctccaggcttaattttaaaggctttgatttaagagcaaataaaaagcaggtgtaatagaatggtgaatcaacctgtggaatttactccccaggaagccaaaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctgggttggattgatctctgaaagagaactatcctga

SEQ ID NO: 12925 - DNA, 339 bp, synthetic construct
  misc_feature 1..339: note = Synthetic polypeptide
  source 1..339: mol_type = other DNA
aatttgaagctccaggcttaattttaaaggctttgatttaagagcaaataaaaagcaggtgtaatagaatggtgaatcaacctgtggaatttactccccaggaagccaaaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctgggtatgctga

SEQ ID NO: 12926 - DNA, 354 bp, synthetic construct
  misc_feature 1..354: note = Synthetic polypeptide
  source 1..354: mol_type = other DNA
aatttgaagctccaggcttaattttaaaggctttgatttaagagcaaataaaaagcaggtgtaatagaatggtgaatcaacctgtggaatttactccccaggaagccaaaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctgggagtctatgatgtggtggagttga

SEQ ID NO: 12927 - DNA, 494 bp, synthetic construct
  misc_feature 1..494: note = Synthetic polypeptide
  source 1..494: mol_type = other DNA
aatttgaagctccaggcttaattttaaaggctttgatttaagagcaaataaaaagcaggtgtaatagaatggtgaatcaacctgtggaatttactccccaggaagccaaaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggttattcgctctataggagtctatgatgtggtggagttgaaatttgcagagaatcgagcaaatggccagtccaaagggtatgctgaggtggtggtagcctctgaaaactctgtccacaaattgttggaactcctacc

SEQ ID NO: 12928 - DNA, 488 bp, synthetic construct
  misc_feature 1..488: note = Synthetic polypeptide
  source 1..488: mol_type = other DNA
aatttgaagctccaggcttaattttaaaggctttgatttaagagcaaataaaaagcaggtgtaatagaatggtgaatcaacctgtggaatttactccccaggaagccaaaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggttattcgctctataggagtctatgatgtggtggagttgaaatttgcagagaatcgagcaaatggccagtccaaagggtatgctgaggtggtggtagcctctgaaaactctgtccacaaattgttggaact

SEQ ID NO: 12929 - DNA, 472 bp, synthetic construct
  misc_feature 1..472: note = Synthetic polypeptide
  source 1..472: mol_type = other DNA
aatttgaagctccaggcttaattttaaaggctttgatttaagagcaaataaaaagcaggtgtaatagaatggtgaatcaacctgtggaatttactccccaggaagccaaaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggttattcgctctataggagtctatgatgtggtggagttgaaatttgcagagaatcgagcaaatggccagtccaaagggtatgctgaggtggtggtagcctctgaaaactctgtcc

SEQ ID NO: 12930 - DNA, 363 bp, synthetic construct
  misc_feature 1..363: note = Synthetic polypeptide
  source 1..363: mol_type = other DNA
aatttgaagctccaggcttaattttaaaggctttgatttaagagcaaataaaaagcaggtgtaatagaatggtgaatcaacctgtggaatttactccccaggaagccaaaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggcagggtcatctgagggacgagatttcagagtga

SEQ ID NO: 12931 - DNA, 289 bp, synthetic construct; identical to SEQ ID NO: 7343
  misc_feature 1..289: note = Synthetic polypeptide
  source 1..289: mol_type = other DNA

SEQ ID NO: 12932 - DNA, 246 bp, synthetic construct; identical to SEQ ID NO: 7344
  misc_feature 1..246: note = Synthetic polypeptide
  source 1..246: mol_type = other DNA

SEQ ID NO: 12933 - DNA, 149 bp, synthetic construct; identical to SEQ ID NO: 7345
  misc_feature 1..149: note = Synthetic polypeptide
  source 1..149: mol_type = other DNA

SEQ ID NO: 12934 - DNA, 89 bp, synthetic construct; identical to SEQ ID NO: 7346
  misc_feature 1..89: note = Synthetic polypeptide
  source 1..89: mol_type = other DNA

SEQ ID NO: 12935 - DNA, 80 bp, synthetic construct; identical to SEQ ID NO: 7347
  misc_feature 1..80: note = Synthetic polypeptide
  source 1..80: mol_type = other DNA

SEQ ID NO: 12936 - DNA, 1185 bp, synthetic construct; identical to SEQ ID NO: 8800
  misc_feature 1..1185: note = Synthetic polypeptide
  source 1..1185: mol_type = other DNA

SEQ ID NO: 12937 - DNA, 550 bp, synthetic construct; identical to SEQ ID NO: 8801
  misc_feature 1..550: note = Synthetic polypeptide
  source 1..550: mol_type = other DNA

SEQ ID NO: 12938 - DNA, 387 bp, synthetic construct; identical to SEQ ID NO: 8802
  misc_feature 1..387: note = Synthetic polypeptide
  source 1..387: mol_type = other DNA

SEQ ID NO: 12939 - DNA, 1713 bp, synthetic construct; identical to SEQ ID NO: 8803
  misc_feature 1..1713: note = Synthetic polypeptide
  source 1..1713: mol_type = other DNA

SEQ ID NO: 12940 - DNA, 1950 bp, synthetic construct; identical to SEQ ID NO: 8804
  misc_feature 1..1950: note = Synthetic polypeptide
  source 1..1950: mol_type = other DNA

SEQ ID NO: 12941 - DNA, 80 bp, synthetic construct; identical to SEQ ID NO: 6364
  misc_feature 1..80: note = Synthetic polypeptide
  source 1..80: mol_type = other DNA

SEQ ID NO: 12942 - DNA, 217 bp, synthetic construct; identical to SEQ ID NO: 6365
  misc_feature 1..217: note = Synthetic polypeptide
  source 1..217: mol_type = other DNA

SEQ ID NO: 12943 - DNA, 2309 bp, synthetic construct; identical to SEQ ID NO: 7608
  misc_feature 1..2309: note = Synthetic polypeptide
  source 1..2309: mol_type = other DNA

SEQ ID NO: 12944 - DNA, 2389 bp, synthetic construct; identical to SEQ ID NO: 7609
  misc_feature 1..2389: note = Synthetic polypeptide
  source 1..2389: mol_type = other DNA

SEQ ID NO: 12945 - DNA, 742 bp, synthetic construct; identical to SEQ ID NO: 8179
  misc_feature 1..742: note = Synthetic polypeptide
  source 1..742: mol_type = other DNA

SEQ ID NO: 12946 - DNA, 430 bp, synthetic construct; identical to SEQ ID NO: 8180
  misc_feature 1..430: note = Synthetic polypeptide
  source 1..430: mol_type = other DNA

SEQ ID NO: 12947 - DNA, 1329 bp, synthetic construct
  misc_feature 1..1329: note = Synthetic polypeptide
  source 1..1329: mol_type = other DNA
gaaatgactagtctgatagaacagtgaatgacttactgaagattctgttacaataccagttatgagacaatatcatgaaatgtttggtttctcccttacaggctaccataagccatgaatcaatgaccagtatggtgtcatttctcacaagccagaatagatgggtccagaaatcatcaaaggcagtctctggtcccagcccaccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccatatgggaaaatagtctccacaaaggcaattttggataagacaacgaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggatgagcaagaactagaaaatatgctcaaaccatttggacaagttatttctacaaggatactacgtgattccagtggtacaagtcgtggtgttggctttgctaggatggaatcaacagaaaaatgtgaagctgttattggtcattttaatggaaaatttattaagacaccaccaggagtttctgcccccacagaacctttattgtgtaagtttgctgatggaggacagaaaaagagacagaacccaaacaaatacatccctaatggaagaccatggcatagagaaggagaggtgagacttgctggaatgacacttacttacgacccaactacagctgctatacagaacggattttatccttcaccatacagtattgctacaaaccgaatgatcactcaaacttctattacaccctatattgcatctcctgtatctgcctaccaggtgcaaagtccttcgtggatgcaacctcaaccatatattctacagcaccctggtgccgtgttaactccctcaatggagcacaccatgtcactacagcccgcatcaatgatcagccctctggcccagcagatgagtcatctgtcactaggcagcaccggaacatacatgcctgcaacgtcagctatgcaaggagcctacttgccacagtatgcacatatgcagacgacagcggttcctgttgaggaggcaagtggtcaacagcaggtggctgtcgagacgtctaatgaccattctccatatacctttcaacctaataagtaa

SEQ ID NO: 12948 - DNA, 1368 bp, synthetic construct
  misc_feature 1..1368: note = Synthetic polypeptide
  source 1..1368: mol_type = other DNA
gaaatgactagtctgatagaacagtgaatgacttactgaagattctgttacaataccagttatgagacaatatcatgaaatgtttggtttctcccttacaggctaccataagccatgaatcaatgaccagtatggtgtcatttctcacaagccagaatagatgggtccagaaatcatcaaaggcagtctctggtcccagcccaccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccatatgggaaaatagtctccacaaaggcaattttggataagacaacgaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggatgagcaagaactagaaaatatgctcaaaccatttggacaagttatttctacaaggatactacgtgattccagtggtacaagtcgtggtgttggctttgctaggatggaatcaacagaaaaatgtgaagctgttattggtcattttaatggaaaatttattaagacaccaccaggagtttctgcccccacagaacctttattgtgtaagtttgctgatggaggacagaaaaagagacagaacccaaacaaatacatccctaatggaagaccatggcatagagaaggagaggctggaatgacacttacttacgacccaactacagctgctatacagaacggattttatccttcaccatacagtattgctacaaaccgaatgatcactcaaacttctattacaccctatattgcatctcctgtatctgcctaccaggtggcaaaggaaaccagagaaaacaagtatcggggctctgctatcaaggtgcaaagtccttcgtggatgcaacctcaaccatatattctacagcaccctggtgccgtgttaactccctcaatggagcacaccatgtcactacagcccgcatcaatgatcagccctctggcccagcagatgagtcatctgtcactaggcagcaccggaacatacatgcctgcaacgtcagctatgcaaggagcctacttgccacagtatgcacatatgcagacgacagcggttcctgttgaggaggcaagtggtcaacagcaggtggctgtcgagacgtctaatgaccattctccatatacctttcaacctaataagtaa

SEQ ID NO: 12949 - DNA, 2582 bp, synthetic construct; identical to SEQ ID NO: 12600
  misc_feature 1..2582: note = Synthetic polypeptide
  source 1..2582: mol_type = other DNA

SEQ ID NO: 12950 - DNA, 353 bp, synthetic construct; identical to SEQ ID NO: 12601
  misc_feature 1..353: note = Synthetic polypeptide
  source 1..353: mol_type = other DNA

SEQ ID NO: 12951 - DNA, 142 bp, synthetic construct; identical to SEQ ID NO: 12602
  misc_feature 1..142: note = Synthetic polypeptide
  source 1..142: mol_type = other DNA

SEQ ID NO: 12952 - DNA, 66 bp, synthetic construct; identical to SEQ ID NO: 12603
  misc_feature 1..66: note = Synthetic polypeptide
  source 1..66: mol_type = other DNA

SEQ ID NO: 12953 - DNA, 2448 bp, synthetic construct; identical to SEQ ID NO: 6618
  misc_feature 1..2448: note = Synthetic polypeptide
  source 1..2448: mol_type = other DNA

SEQ ID NO: 12954 - DNA, 1543 bp, synthetic construct; identical to SEQ ID NO: 6619
  misc_feature 1..1543: note = Synthetic polypeptide
  source 1..1543: mol_type = other DNA

SEQ ID NO: 12955 - DNA, 1468 bp, synthetic construct; identical to SEQ ID NO: 6620
  misc_feature 1..1468: note = Synthetic polypeptide
  source 1..1468: mol_type = other DNA

SEQ ID NO: 12956 - DNA, 1023 bp, synthetic construct; identical to SEQ ID NO: 611
  misc_feature 1..1023: note = Synthetic polypeptide
  source 1..1023: mol_type = other DNA

SEQ ID NO: 12957 - DNA, 893 bp, synthetic construct
  misc_feature 1..893: note = Synthetic polypeptide
  source 1..893: mol_type = other DNA
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaaggggtatgttgctcttattatttataa

SEQ ID NO: 12958 - DNA, 959 bp, synthetic construct
  misc_feature 1..959: note = Synthetic polypeptide
  source 1..959: mol_type = other DNA
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaagggattcccagcctgcagcaacatgctggtcaccatagagacctgagaagcaccctcatctcattggtatcatatttacaaaccaccccttaa

SEQ ID NO: 12959 - DNA, 1028 bp, synthetic construct
  misc_feature 1..1028: note = Synthetic polypeptide
  source 1..1028: mol_type = other DNA
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaagggggtgacttgggttggatgaccagagggtccatggtgggaccatttcaagaagcagcatttgccttgcctgtaagtgggatggataagcctgtgtttacagacccaccggttaagacaaaatttggatatcatattattatggtcgaaggaagaaaataa

SEQ ID NO: 12960 - DNA, 887 bp, synthetic construct
  misc_feature 1..887: note = Synthetic polypeptide
  source 1..887: mol_type = other DNA
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaaggggccttcagactccgatga

SEQ ID NO: 12961 - DNA, 920 bp, synthetic construct; identical to SEQ ID NO: 8111
  misc_feature 1..920: note = Synthetic polypeptide
  source 1..920: mol_type = other DNA

SEQ ID NO: 12962 - DNA, 597 bp, synthetic construct
  misc_feature 1..597: note = Synthetic polypeptide
  source 1..597: mol_type = other DNA
taggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtga

SEQ ID NO: 12963 - DNA, 543 bp, synthetic construct
  misc_feature 1..543: note = Synthetic polypeptide
  source 1..543: mol_type = other DNA
taggacttgaaagaggagattgatattcgactctccagggttcaggatatcaagtatgagccccagctccttgcagatgatgatgctagactactacaactggaaacccagggaaatcaaaagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtga

SEQ ID NO: 12964 - DNA, 405 bp, synthetic construct
  misc_feature 1..405: note = Synthetic polypeptide
  source 1..405: mol_type = other DNA
taggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcgtga

SEQ ID NO: 12965 - DNA, 1101 bp, synthetic construct; identical to SEQ ID NO: 8142
  misc_feature 1..1101: note = Synthetic polypeptide
  source 1..1101: mol_type = other DNA

SEQ ID NO: 12966 - DNA, 1896 bp, synthetic construct; identical to SEQ ID NO: 8143
  misc_feature 1..1896: note = Synthetic polypeptide
  source 1..1896: mol_type = other DNA

SEQ ID NO: 12967 - DNA, 1662 bp, synthetic construct; identical to SEQ ID NO: 8144
  misc_feature 1..1662: note = Synthetic polypeptide
  source 1..1662: mol_type = other DNA

SEQ ID NO: 12968 - DNA, 1848 bp, synthetic construct
  misc_feature 1..1848: note = Synthetic polypeptide
  source 1..1848: mol_type = other DNA
ggaatacttcttccccactcctgatgtttcctgtggctagagggaatactttggtgtaacacccgggctctcttcaccctccctgatgggcgtgtttgggagcaggaactcacgtgtgtagctgtgttccttcccccttttcctcttggacagagctgccctgagggtggtctcctgtgcagttaagtctcacctgagcagctccatgggagggggcttgcccctggcccgcactgcctgtgactgggtgggtccaaactgaagacggtacatgagcggatccccttggctggactgagcaagcttcccagtgtccctcagattgcaaaggctttctgtgatgatgcagtgggactgagattcaatcctgtcctgtaccccaaggcctcccaaatgattgtgtcctatgatgagcatgaagtcaacaacacattcaaattcggagtcatttatcaaaaagccaggcagaccctggaggaggagctatttgggaacaatgaggagagcccagcttttaaggagttcttggacctgctgggggacacgatcacactgcaggatttcaaaggtttccgaggaggcctggacgtgacccacggacagacaggggtggaatcagtgtacacaacattccgggacagggagatcatgtttcacgtttccacaaagctgccatttaccgacggagacgcccagcagctccagagaaagagacacattggaaatgacatcgtggccatcatcttccaagaggaaaacacgccgtttgtcccagacatgatagcctccaatttcttacatgcctacatcgtcgtgcaggtcgagaccccaggcacagagaccccatcctacaaggtctctgtcactgcgcgggaagatgtgcccacctttggtccacctctgcccagtccccccgttttccagaagggcccggaattcagggagtttctgctcaccaagctcaccaatgccgagaacgcctgctgcaagtcggacaagtttgcaaagctggaggaccggaccagggctgccctcctggacaaccttcacgatgagctccacgcccacacacaggccatgctgggactgggcccagaggaggacaagtttgagaatggaggccacggggggttcctggagtcttttaagagggccatccgcgtacgcagccactccatggagaccatggtgggcggccagaagaagtcgcacagtgggggcatccctggcagcctcagcgggggcatctcccacaacagcatggaggtcaccaagaccaccttctcgcctccagtggtggcggcaacggtgaagaaccagtcacggagtcccatcaagcgacgctcggggctcttcccccgcctgcacacgggctcagaaggccagggcgacagccgggcacgatgtgacagcacatccagcacacccaagaccccagatggtggacactcctctcaggagataaagtctgagacctcatccaatcccagctctccggaaatctgccccaacaaggagaagcccttcatgaagttgaaggaaaacggccgtgccatctcccgctcctcctccagcaccagcagcgtcagcagcactgcaggggagggcgaggccatggaggagggcgacagtgggggcagccagccgtccacgacctcacccttcaagcaggaggtgtttgtctacagcccgtccccgagcagcgagagccccagcctgggggcagctgccaccccgatcatcatgagccggagtcccacagatgccaaaagcagaaactccccgagatcgaacctgaaattccgctttgacaagctcagccatgccagctctggtgcgggtcactaa

SEQ ID NO: 12969 - DNA, 629 bp, synthetic construct; identical to SEQ ID NO: 7943
  misc_feature 1..629: note = Synthetic polypeptide
  source 1..629: mol_type = other DNA

SEQ ID NO: 12970 - DNA, 472 bp, synthetic construct; identical to SEQ ID NO: 7944
  misc_feature 1..472: note = Synthetic polypeptide
  source 1..472: mol_type = other DNA

SEQ ID NO: 12971 - DNA, 348 bp, synthetic construct
  misc_feature 1..348: note = Synthetic polypeptide
  source 1..348: mol_type = other DNA
taaatttactgtagcctaagtgtacagtacttatgaagtctgtagtagtatagtaatgcattaggccttcacattcactcaccactcacttaccaactcacacagagcaatttccagtcctgcagactccattcatcgtgagtgccctatacagatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccagacatggtctccactatgttgcccaggctgaagtgcagtggctgttcatag

SEQ ID NO: 12972 - DNA, 489 bp, synthetic construct
  misc_feature 1..489: note = Synthetic polypeptide
  source 1..489: mol_type = other DNA
taaatttactgtagcctaagtgtacagtacttatgaagtctgtagtagtatagtaatgcattaggccttcacattcactcaccactcacttaccaactcacacagagcaatttccagtcctgcagactccattcatcgtgagtgccctatacagatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaa

SEQ ID NO: 12973 - DNA, 419 bp, synthetic construct
  misc_feature 1..419: note = Synthetic polypeptide
  source 1..419: mol_type = other DNA
taaatttactgtagcctaagtgtacagtacttatgaagtctgtagtagtatagtaatgcattaggccttcacattcactcaccactcacttaccaactcacacagagcaatttccagtcctgcagactccattcatcgtgagtgccctatacagatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagat

SEQ ID NO: 12974 - DNA, 518 bp, synthetic construct
  misc_feature 1..518: note = Synthetic polypeptide
  source 1..518: mol_type = other DNA
gttgcgccgccccggccaagcctcagcctttctgggccttagcttcttcacgtgtagtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaa

SEQ ID NO: 12975 - DNA, 419 bp, synthetic construct
  misc_feature 1..419: note = Synthetic polypeptide
  source 1..419: mol_type = other DNA
gttgcgccgccccggccaagcctcagcctttctgggccttagcttcttcacgtgtagtatacctgaggtgcaccggaggtgaagtcggtgccacttctgccctggcccccaagatcggccccctgggtctgattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaa

SEQ ID NO: 12976 - DNA, 330 bp, synthetic construct; identical to SEQ ID NO: 7604
  misc_feature 1..330: note = Synthetic polypeptide
  source 1..330: mol_type = other DNA

SEQ ID NO: 12977 - DNA, 1133 bp, synthetic construct; identical to SEQ ID NO: 7332
  misc_feature 1..1133: note = Synthetic polypeptide
  source 1..1133: mol_type = other DNA

SEQ ID NO: 12978 - DNA, 1172 bp, synthetic construct; identical to SEQ ID NO: 7333
  misc_feature 1..1172: note = Synthetic polypeptide
  source 1..1172: mol_type = other DNA

SEQ ID NO: 12979 - DNA, 207 bp, synthetic construct; identical to SEQ ID NO: 7693
  misc_feature 1..207: note = Synthetic polypeptide
  source 1..207: mol_type = other DNA

SEQ ID NO: 12980 - DNA, 268 bp, synthetic construct; identical to SEQ ID NO: 7694
  misc_feature 1..268: note = Synthetic polypeptide
  source 1..268: mol_type = other DNA

SEQ ID NO: 12981 - DNA, 336 bp, synthetic construct; identical to SEQ ID NO: 7520
  misc_feature 1..336: note = Synthetic polypeptide
  source 1..336: mol_type = other DNA

SEQ ID NO: 12982 - DNA, 346 bp, synthetic construct; identical to SEQ ID NO: 7521
  misc_feature 1..346: note = Synthetic polypeptide
  source 1..346: mol_type = other DNA

SEQ ID NO: 12983 - DNA, 266 bp, synthetic construct
  misc_feature 1..266: note = Synthetic polypeptide
  source 1..266: mol_type = other DNA
ggctgggcccagtagctcgtgcctgtaatcccagcattttggtaggctgaggcgggtggatggctcgagctcaggagttcgagagcagcctggaatacgctgccatcaactccatgctggaccagatcaactcctgtctggaccacctggaggagaagaatgaccacctccacgcccgcctccaggagctgctggagtccaaccggcagacacgcctggagttccagcagcagctcggggaggcccccagtgatgccagcccctag

SEQ ID NO: 12984 - DNA, 491 bp, synthetic construct
  misc_feature 1..491: note = Synthetic polypeptide
  source 1..491: mol_type = other DNA
ggaggggaggttaagggaaggagagggatgctgcagccggagggcccccaggcctcggaggaggggggcccccggaggagaggacagactgcatcatctgctgctcggcctatgacctctccgggcacctgccccgccgcctctactgtggacacaccttctgccaggcgtgtgtgcggcggctggacacaccggcgcccgagcagcgctggatcccctgtccgcagtgccgtcagagcacgcccacgcctcgcggaggggtggccatgctagacctggacctggctgctttcctggcggtcaaggctgagcgggagccggcaagactagaacccctgcccctcacctccctcaaaggcagcgccatcactcggcagccagctgggctgtgccctgccctgggaccccagccccacttcccccagcccagatactgctgctggggctgtggcagcctctgctgcccacccctaggcagccccgaggtctga

SEQ ID NO: 12985 - DNA, 887 bp, synthetic construct
  misc_feature 1..887: note = Synthetic polypeptide
  source 1..887: mol_type = other DNA
agggaggctcagcagatttgaacatggaattcaatccttcagatcatcctcgggccagcacaatattcctcagtaaatctcagacggacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgtgtcgctcttgcaatatattatcacatcaaaaacagggacccagatggaaggatgctcttagatatttttgatgaaaatcttcaccctctttcgaaatccgaagtgccaccagattatgacaaacacaacccagagcagaagcagatttaccggttcgttcggacactgttcagtgctgctcagctgacggctgaatgtgccatcgtcaccctggtgtaccttgaaagacttttaacatacgcagagatagatatctgtccggccaactggaagcggattgttttaggggcgatcctgctggcctccaaggtgtgggatgaccaggctgtatggaatgtggattactgccagatcctgaaagacatcacggtggaggacatgaacgagctagagcgacagtttcttgaattgctgcagttcaacatcaatgttccttccagtgtctatgccaagtattattttgatcttcgttctctggcagaagcgaacaacctgagctttcccttggagcccctgagcagggagagggctcacaagcttgaggccatctctcgcctctgcgaggacaagtacaaggacctaagaagatccgcgaggaagcgctcagccagtgcagacaacctgactctgccccggtggtccccagccatcatctcttaa

SEQ ID NO: 12986 - DNA, 544 bp, synthetic construct
  misc_feature 1..544: note = Synthetic polypeptide
  source 1..544: mol_type = other DNA
accctgtttttgttccctgcctcatgcctgactgatcatcttgcccttctgccaacataacttatcttgccagctaggcagggagctccctgcagcctggaactgtgaggctgtcttgtttcacttggcatttcccatgcctggcagagacatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaa

SEQ ID NO: 12987 - DNA, 393 bp, synthetic construct
  misc_feature 1..393: note = Synthetic polypeptide
  source 1..393: mol_type = other DNA
accctgtttttgttccctgcctcatgcctgactgatcatcttgcccttctgccaacataacttatcttgccagctaggcagggagctccctgcagcctggaactgtgaggctgtcttgtttcacttggcatttcccatgcctggcagagacatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgca

SEQ ID NO: 12988 - DNA, 544 bp, synthetic construct; identical to SEQ ID NO: 12986
  misc_feature 1..544: note = Synthetic polypeptide
  source 1..544: mol_type = other DNA

SEQ ID NO: 12989 - DNA, 526 bp, synthetic construct; identical to SEQ ID NO: 10237
  misc_feature 1..526: note = Synthetic polypeptide
  source 1..526: mol_type = other DNA

SEQ ID NO: 12990 - DNA, 1314 bp, synthetic construct; identical to SEQ ID NO: 10238
  misc_feature 1..1314: note = Synthetic polypeptide
  source 1..1314: mol_type = other DNA

SEQ ID NO: 12991 - DNA, 1218 bp, synthetic construct; identical to SEQ ID NO: 10239
  misc_feature 1..1218: note = Synthetic polypeptide
  source 1..1218: mol_type = other DNA

SEQ ID NO: 12992 - DNA, 1197 bp, synthetic construct; identical to SEQ ID NO: 10240
  misc_feature 1..1197: note = Synthetic polypeptide
  source 1..1197: mol_type = other DNA

SEQ ID NO: 12993 - DNA, 919 bp, synthetic construct; identical to SEQ ID NO: 10241
  misc_feature 1..919: note = Synthetic polypeptide
  source 1..919: mol_type = other DNA

SEQ ID NO: 12994 - DNA, 629 bp, synthetic construct; identical to SEQ ID NO: 10242
  misc_feature 1..629: note = Synthetic polypeptide
  source 1..629: mol_type = other DNA

SEQ ID NO: 12995 - DNA, 809 bp, synthetic construct; identical to SEQ ID NO: 8505
  misc_feature 1..809: note = Synthetic polypeptide
  source 1..809: mol_type = other DNA

SEQ ID NO: 12996 - DNA, 809 bp, synthetic construct; identical to SEQ ID NO: 8506
  misc_feature 1..809: note = Synthetic polypeptide
  source 1..809: mol_type = other DNA

SEQ ID NO: 12997 - DNA, 564 bp, synthetic construct; identical to SEQ ID NO: 8405
  misc_feature 1..564: note = Synthetic polypeptide
  source 1..564: mol_type = other DNA

SEQ ID NO: 12998 - DNA, 74 bp, synthetic construct; identical to SEQ ID NO: 7010
  misc_feature 1..74: note = Synthetic polypeptide
  source 1..74: mol_type = other DNA

SEQ ID NO: 12999 - DNA, 602 bp, synthetic construct
  misc_feature 1..602: note = Synthetic polypeptide
  source 1..602: mol_type = other DNA
gggggaggagccaagatggccgaataggaacagctccggtctacagctcccagcgtgagcgacgcagaagacgggtgatttctgcatttccatctgagtttgatgccatcctggacgtcctgtcatcggcgattgtcctgtggcgttacagcaacgcggccgctgtgcactctgcccatagggagtacatagcctgtgtcatcttgggggtgatattccttctgtcatccatatgtatagtggtcaaagccatccatgacctctcaactaggctgctcccagaagtggacgatttcctgttcagtgtctccattttaagtgggattctttgcagcatcctggccgtgttgaagttcatgctggggaaggttctgaccagtagagcactcataacagatgggtttaactccctcgtgggtggcgtgatgggcttctccattcttctgagcgcggaagtgttcaagcatgactcggcggtctggtacctggacggcagcataggcgttctgatcggcctcaccatatttgcctatggggtcaaactcctcatcgacatggtgccgagggtgaggcagacacgtcactacgagatgtttgagtga

SEQ ID NO: 13000 - DNA, 569 bp, synthetic construct
  misc_feature 1..569: note = Synthetic polypeptide
  source 1..569: mol_type = other DNA
ggccggacgcggtggctcacgcctgtaatcccagcactttgggagaccgaggcgggcagatcacgaggtcaggagatcgagaccatcctggctaacaagcactgtccatctatgccttgctacttttcgagatcgagacaggcgcagcagctgcttccatcctcggctcgggcaccctggttctggtggctgtgctgacccacactctcctccgggctgcccgggctgcccgccgtgggctccatgagttgtccccgccatcctttgaagacgacctcgcccgccctgccgaagtctccaaggccagccccagagctcagcctcagcagggtatccatcgtcggaccccctattcaacctgtccagagcctggggacccctttgggtccatggccactgccacagcacctgcagccctggagggaggctgggagagcagcctgcctgcatccagaatgcaccggacactgtcggctggcctggggcactgggacggggttacgcacgagatgcgtcgaatgctgggccacagaccagggagcatggggaaggactccacactggtgtga

SEQ ID NO: 13001 - DNA, 416 bp, synthetic construct
  misc_feature 1..416: note = Synthetic polypeptide
  source 1..416: mol_type = other DNA
ggccggacgcggtggctcacgcctgtaatcccagcactttgggagaccgaggcgggcagatcacgaggtcaggagatcgagaccatcctggctaacaagcactgtccatctatgccttgctacttttcgagatcgagacaggcgcagcagctgcttccatcctcggctcgggcaccctggttctggtggctgtgctgacccacactctcctccgggctgcccgggctgcccgccgtgggctccatgagttgtccccgccatcctttgaagacgacctcgcccgccctgccgaagtctccaaggccagccccagagctcagcctcagcagggtatccatcgtcggaccccctattcaacctgtccagagcctggggacccctttgggtccatggccactgccacagcacctgcagcc

SEQ ID NO: 13002 - DNA, 795 bp, synthetic construct; identical to SEQ ID NO: 8525
  misc_feature 1..795: note = Synthetic polypeptide
  source 1..795: mol_type = other DNA

SEQ ID NO: 13003 - DNA, 194 bp, synthetic construct; identical to SEQ ID NO: 8526
  misc_feature 1..194: note = Synthetic polypeptide
  source 1..194: mol_type = other DNA

SEQ ID NO: 13004 - DNA, 462 bp, synthetic construct; identical to SEQ ID NO: 8527
  misc_feature 1..462: note = Synthetic polypeptide
  source 1..462: mol_type = other DNA

SEQ ID NO: 13005 - DNA, 66 bp, synthetic construct; identical to SEQ ID NO: 8528
  misc_feature 1..66: note = Synthetic polypeptide
  source 1..66: mol_type = other DNA

SEQ ID NO: 13006 - DNA, 268 bp, synthetic construct; identical to SEQ ID NO: 8529
  misc_feature 1..268: note = Synthetic polypeptide
  source 1..268: mol_type = other DNA

SEQ ID NO: 13007 - DNA, 132 bp, synthetic construct; identical to SEQ ID NO: 8530
  misc_feature 1..132: note = Synthetic polypeptide
  source 1..132: mol_type = other DNA

SEQ ID NO: 13008 - DNA, 2497 bp, synthetic construct
  misc_feature 1..2497: note = Synthetic polypeptide
  source 1..2497: mol_type = other DNA
aggaatacttcttacaactgagtatcagaaagaaaatggccacccctgaagaactgccctggaacagctgctgacagagttggatgacttcctcaagattcttgaccaggagaacctgagcagcacagcactggtgaagaagagctgcctggcggagctcctccggctttacaccaaaagcagcagctctgatgaggagtacatttatatgaacaaagtgaccatcaacaagcaacagaatgcagagtctcaaggcaaagcgcctgaggagcagggcctgctacccaatggggagcccagccagcactcctcggcccctcagaagagccttccagacctcccgccacccaagatgattccagaacggaaacagcttgccatcccaaagacggagtctccagagggctactatgaagaggctgagccatatgacacatccctcaatgaggacggagaggctgtgagcagctcctacgagtcctacgatgaagaggacggcagcaagggcaagtcggccccttaccagtggccctcgccggaggccggcatcgagctgatgcgtgacgcccgcatctgcgccttcctgtggcgcaagaagtggctgggacagtgggccaagcagctctgtgtcatcaaggacaacaggcttctgtgctacaaatcctccaaggaccacagccctcagctggacgtgaacctactgggcagcagcgtcattcacaaggagaagcaagtgcggaagaaggagcacaagctgaagatcacgccgatgaatgccgatgtgattgtgctgggcctgcagagcaaggaccaggctgagcagtggctcagggtcatccaggaagtgagcggcctgccttccgaaggagcatctgaaggaaaccagtacaccccggatgcccagcgctttaactgccagaaaccagatatagctgagaagtacctgtcggcttcagagtatgggagctccgtggatggccaccctgaggtcccagaaaccaaagacgtcaagaagaaatgttctgctggcctcaaactgagcaacctaatgaatctgggcaggaagaaatccacctcactggagcctgtggagaggtccctcgagacatccagttacctgaacgtgctggtgaacagccagtggaagtctcgctggtgctctgtcagggacaatcacctgcacttctaccaggaccggaaccggagcaaggtggcccagcaacccctcagcctggtgggctgcgaggtggtcccagaccccagccccgaccacctctactccttccgcatcctccacaagggcgaggagctggccaagcttgaggccaagtcttccgaggaaatgggccactggctgggtctcctgctctctgagtcaggctccaagacagacccagaagagttcacctacgactatgtggatgccgatagggtctcctgtattgtgagtgcggccaaaaactctctcttactgatgcagagaaagttctcagagcccaacacttacatcgatggcctgcctagccaggaccgccaggaggagctgtatgacgacgtggacctgtcagagctcacagctgcggtggagcctaccgaggaagccacccctgttgcagatgacccaaatgagagagaatctgaccgagtgtacctggacctcacacctgtcaagtcctttctgcatggccccagcagtgcacaggcccaggcctcctccccgacgttgtcctgcctggacaatgcaactgaggccctcccggcagactcaggcccaggtcccaccccagatgagccctgcataaagtgtccagagaacctgggagaacagcagctggagagtttggagccagaggatccttccctgagaatcaccaccgtcaaaatccagacggaacagcagagaatctccttcccaccgagctgcccggatgccgtggtggccaccccacctggtgccagcccacctgtgaaggacaggttgcgcgtgaccagtgcagagatcaagcttggcaagaatcggacagaagctgaggtgaagcggtacacagaggagaaggagaggcttgaaaagaagaaggaagaaatccgggggcacctggctcagctccggaaagagaaacgggagctaaaggaaaccctactgaaatgcacagacaaggaagtcctggcgagcctggagcagaagctgaaggaaattgacgaggagtgccggggcgaggagagcaggcgcgtggacctggagctcagcatcatggaggtgaaggacaacctgaagaaggctgaggcagggcctgtgacgttaggcaccaccgtggacaccacccacctggagaatgtgagcccccgccccaaagctgtcacacctgcctctgccccagactgtaccccagtcaactctgcaaccacactcaagaacaggcctctctcggtcgtggtcacaggcaaaggcactgtactccagaaagccaaggaatgggagaagaaaggagcaagttag

SEQ ID NO: 13009 - DNA, 2485 bp, synthetic construct
  misc_feature 1..2485: note = Synthetic polypeptide
  source 1..2485: mol_type = other DNA
aggaatacttcttacaactgagtatcagaaagaaaatggccacccctgaagaactgccctggaacagctgctgacagagttggatgacttcctcaagattcttgaccaggagaacctgagcagcacagcactggtgaagaagagctgcctggcggagctcctccggctttacaccaaaagcagcagctctgatgaggagtacatttatatgaacaaagtgaccatcaacaagcaacagaatgcagagtctcaaggcaaagcgcctgaggagcagggcctgctacccaatggggagcccagccagcactcctcggcccctcagaagagccttccagacctcccgccacccaagatgattccagaacggaaacagcttgccatcccaaagacggagtctccagagggctactatgaagaggctgagccatatgacacatccctcaatgaggacggagaggctgtgagcagctcctacgagtcctacgatgaagaggacggcagcaagggcaagtcggccccttaccagtggccctcgccggaggccggcatcgagctgatgcgtgacgcccgcatctgcgccttcctgtggcgcaagaagtggctgggacagtgggccaagcagctctgtgtcatcaaggacaacaggcttctgtgctacaaatcctccaaggaccacagccctcagctggacgtgaacctactgggcagcagcgtcattcacaaggagaagcaagtgcggaagaaggagcacaagctgaagatcacgccgatgaatgccgatgtgattgtgctgggcctgcagagcaaggaccaggctgagcagtggctcagggtcatccaggaagtgagcggcctgccttccgaaggagcatctgaaggaaaccagtacaccccggatgcccagcgctttaactgccagaaaccagatatagctgagaagtacctgtcggcttcagagtatgggagctccgtggatggccaccctgaggtcccagaaaccaaagacgtcaagaagaaatgttctgctggcctcaaactgagcaacctaatgaatctgggcaggaagaaatccacctcactggagcctgtggagaggtccctcgagacatccagttacctgaacgtgctggtgaacagccagtggaagtctcgctggtgctctgtcagggacaatcacctgcacttctaccaggaccggaaccggagcaaggtggcccagcaacccctcagcctggtgggctgcgaggtggtcccagaccccagccccgaccacctctactccttccgcatcctccacaagggcgaggagctggccaagcttgaggccaagtcttccgaggaaatgggccactggctgggtctcctgctctctgagtcaggctccaagacagacccagaagagttcacctacgactatgtggatgccgatagggtctcctgtattgtgagtgcggccaaaaactctctcttactgatgcagagaaagttctcagagcccaacacttacatcgatggcctgcctagccaggaccgccaggaggagctgtatgacgacgtggacctgtcagagctcacagctgcggtggagcctaccgaggaagccacccctgttgcagatgacccaaatgagagagaatctgaccgagtgtacctggacctcacacctgtcaagtcctttctgcatggccccagcagtgcacaggcccaggcctcctccccgacgttgtcctgcctggacaatgcaactgaggccctcccggcagactcaggcccaggtcccaccccagatgagccctgcataaagtgtccagagaacctgggagaacagcagctggagagtttggagccagaggatccttccctgagaatcaccaccgtcaaaatccagacggaacagcagagaatctccttcccaccgagctgcccggatgccgtggtggccaccccacctggtgccagcccacctgtgaaggacaggttgcgcgtgaccagtgcagagatcaagcttggcaagaatcggacagaagctgaggtgaagcggtacacagaggagaaggagaggcttgaaaagaagaaggaagaaatccgggggcacctggctcagctccggaaagagaaacgggagctaaaggaaaccctactgaaatgcacagacaaggaagtcctggcgagcctggagcagaagctgaaggaaattgacgaggagtgccggggcgaggagagcaggcgcgtggacctggagctcagcatcatggaggtgaaggacaacctgaagaaggctgaggcagggcctgtgacgttaggcaccaccgtggacaccacccacctggagaatcccaaagctgtcacacctgcctctgccccagactgtaccccagtcaactctgcaaccacactcaagaacaggcctctctcggtcgtggtcacaggcaaaggcactgtactccagaaagccaaggaatgggagaagaaaggagcaagttag

SEQ ID NO: 13010 - DNA, 2656 bp, synthetic construct
  misc_feature 1..2656: note = Synthetic polypeptide
  source 1..2656: mol_type = other DNA
aggaatacttcttacaactgagtatcagaaagaaaatggccacccctgaagaactgccctggaacagctgctgacagagttggatgacttcctcaagattcttgaccaggagaacctgagcagcacagcactggtgaagaagagctgcctggcggagctcctccggctttacaccaaaagcagcagctctgatgaggagtacatttatatgaacaaagtgaccatcaacaagcaacagaatgcagagtctcaaggcaaagcgcctgaggagcagggcctgctacccaatggggagcccagccagcactcctcggcccctcagaagagccttccagacctcccgccacccaagatgagaatcctgaccttgggccagatctcgggtgcccagagcttttctccagatgggacccacctgacgggaacggagtttcttggaggctggagctggaggcccagccagatcaggctgatgagccctgggacccactggggagaccttactgccacagagattccagaacggaaacagcttgccatcccaaagacggagtctccagagggctactatgaagaggctgagccatatgacacatccctcaatgaggacggagaggctgtgagcagctcctacgagtcctacgatgaagaggacggcagcaagggcaagtcggccccttaccagtggccctcgccggaggccggcatcgagctgatgcgtgacgcccgcatctgcgccttcctgtggcgcaagaagtggctgggacagtgggccaagcagctctgtgtcatcaaggacaacaggcttctgtgctacaaatcctccaaggaccacagccctcagctggacgtgaacctactgggcagcagcgtcattcacaaggagaagcaagtgcggaagaaggagcacaagctgaagatcacgccgatgaatgccgatgtgattgtgctgggcctgcagagcaaggaccaggctgagcagtggctcagggtcatccaggaagtgagcggcctgccttccgaaggagcatctgaaggaaaccagtacaccccggatgcccagcgctttaactgccagaaaccagatatagctgagaagtacctgtcggcttcagagtatgggagctccgtggatggccaccctgaggtcccagaaaccaaagacgtcaagaagaaatgttctgctggcctcaaactgagcaacctaatgaatctgggcaggaagaaatccacctcactggagcctgtggagaggtccctcgagacatccagttacctgaacgtgctggtgaacagccagtggaagtctcgctggtgctctgtcagggacaatcacctgcacttctaccaggaccggaaccggagcaaggtggcccagcaacccctcagcctggtgggctgcgaggtggtcccagaccccagccccgaccacctctactccttccgcatcctccacaagggcgaggagctggccaagcttgaggccaagtcttccgaggaaatgggccactggctgggtctcctgctctctgagtcaggctccaagacagacccagaagagttcacctacgactatgtggatgccgatagggtctcctgtattgtgagtgcggccaaaaactctctcttactgatgcagagaaagttctcagagcccaacacttacatcgatggcctgcctagccaggaccgccaggaggagctgtatgacgacgtggacctgtcagagctcacagctgcggtggagcctaccgaggaagccacccctgttgcagatgacccaaatgagagagaatctgaccgagtgtacctggacctcacacctgtcaagtcctttctgcatggccccagcagtgcacaggcccaggcctcctccccgacgttgtcctgcctggacaatgcaactgaggccctcccggcagactcaggcccaggtcccaccccagatgagccctgcataaagtgtccagagaacctgggagaacagcagctggagagtttggagccagaggatccttccctgagaatcaccaccgtcaaaatccagacggaacagcagagaatctccttcccaccgagctgcccggatgccgtggtggccaccccacctggtgccagcccacctgtgaaggacaggttgcgcgtgaccagtgcagagatcaagcttggcaagaatcggacagaagctgaggtgaagcggtacacagaggagaaggagaggcttgaaaagaagaaggaagaaatccgggggcacctggctcagctccggaaagagaaacgggagctaaaggaaaccctactgaaatgcacagacaaggaagtcctggcgagcctggagcagaagctgaaggaaattgacgaggagtgccggggcgaggagagcaggcgcgtggacctggagctcagcatcatggaggtgaaggacaacctgaagaaggctgaggcagggcctgtgacgttaggcaccaccgtggacaccacccacctggagaatgtgagcccccgccccaaagctgtcacacctgcctctgccccagactgtaccccagtcaactctgcaaccacactcaagaacaggcctctctcggtcgtggtcacaggcaaaggcactgtactccagaaagccaaggaatgggagaagaaaggagcaagttag

SEQ ID NO: 13011 - DNA, 922 bp, synthetic construct
  misc_feature 1..922: note = Synthetic polypeptide
  source 1..922: mol_type = other DNA
aggaatacttcttacaactgagtatcagaaagaaaatggccacccctgaagaactgccctggaacagctgctgacagagttggatgacttcctcaagattcttgaccaggagaacctgagcagcacagcactggtgaagaagagctgcctggcggagctcctccggctttacaccaaaagcagcagctctgatgaggagtacatttatatgaacaaagtgaccatcaacaagcaacagaatgcagagtctcaaggcaaagcgcctgaggagcagggcctgctacccaatggggagcccagccagcactcctcggcccctcagaagagccttccagacctcccgccacccaagatgattccagaacggaaacagcttgccatcccaaagacggagtctccagagggctactatgaagaggctgagccatatgacacatccctcaatgaggacggagaggctgtgagcagctcctacgagtcctacgatgaagaggacggcagcaagggcaagtcggccccttaccagtggccctcgccggaggccggcatcgagctgatgcgtgacgcccgcatctgcgccttcctgtggcgcaagaagtggctgggacagtgggccaagcagctctgtgtcatcaaggacaacaggcttctgtgctacaaatcctccaaggaccacagccctcagctggacgtgaacctactgggcagcagcgtcattcacaaggagaagcaagtgcggaagaaggagcacaagctgaagatcacgccgatgaatgccgatgtgattgtgctgggcctgcagagcaaggaccaggctgagcagtggctcagggtcatccaggaagtgagcggcctgccttccgaaggagcatctgaaggaaaccagtacaccccggatgcccagcgctttaactgccagaaa

SEQ ID NO: 13012 - DNA, 303 bp, synthetic construct; identical to SEQ ID NO: 6723
  misc_feature 1..303: note = Synthetic polypeptide
  source 1..303: mol_type = other DNA

SEQ ID NO: 13013 - DNA, 189 bp, synthetic construct; identical to SEQ ID NO: 6724
  misc_feature 1..189: note = Synthetic polypeptide
  source 1..189: mol_type = other DNA

SEQ ID NO: 13014 - DNA, 318 bp, synthetic construct; identical to SEQ ID NO: 6725
  misc_feature 1..318: note = Synthetic polypeptide
  source 1..318: mol_type = other DNA

SEQ ID NO: 13015 - DNA, 138 bp, synthetic construct; identical to SEQ ID NO: 6726
  misc_feature 1..138: note = Synthetic polypeptide
  source 1..138: mol_type = other DNA

SEQ ID NO: 13016 - DNA, 809 bp, synthetic construct; identical to SEQ ID NO: 8586
  misc_feature 1..809: note = Synthetic polypeptide
  source 1..809: mol_type = other DNA

SEQ ID NO: 13017 - DNA, 809 bp, synthetic construct; identical to SEQ ID NO: 8587
  misc_feature 1..809: note = Synthetic polypeptide
  source 1..809: mol_type = other DNA

SEQ ID NO: 13018 - DNA, 809 bp, synthetic construct; identical to SEQ ID NO: 8613
  misc_feature 1..809: note = Synthetic polypeptide
  source 1..809: mol_type = other DNA

SEQ ID NO: 13019 - DNA, 174 bp, synthetic construct; identical to SEQ ID NO: 8969
  misc_feature 1..174: note = Synthetic polypeptide
  source 1..174: mol_type = other DNA

SEQ ID NO: 13020 - DNA, 861 bp, synthetic construct; identical to SEQ ID NO: 8970
  misc_feature 1..861: note = Synthetic polypeptide
  source 1..861: mol_type = other DNA

SEQ ID NO: 13021 - DNA, 846 bp, synthetic construct; identical to SEQ ID NO: 8971
  misc_feature 1..846: note = Synthetic polypeptide
  source 1..846: mol_type = other DNA

SEQ ID NO: 13022 - DNA, 690 bp, synthetic construct; identical to SEQ ID NO: 8972
  misc_feature 1..690: note = Synthetic polypeptide
  source 1..690: mol_type = other DNA

SEQ ID NO: 13023 - DNA, 879 bp, synthetic construct; identical to SEQ ID NO: 8973
  misc_feature 1..879: note = Synthetic polypeptide
  source 1..879: mol_type = other DNA

SEQ ID NO: 13024 - DNA, 154 bp, synthetic construct; identical to SEQ ID NO: 8974
  misc_feature 1..154: note = Synthetic polypeptide
  source 1..154: mol_type = other DNA

SEQ ID NO: 13025 - DNA, 1533 bp, synthetic construct; identical to SEQ ID NO: 8543
  misc_feature 1..1533: note = Synthetic polypeptide
  source 1..1533: mol_type = other DNA

SEQ ID NO: 13026 - DNA, 1267 bp, synthetic construct; identical to SEQ ID NO: 6631
  misc_feature 1..1267: note = Synthetic polypeptide
  source 1..1267: mol_type = other DNA

SEQ ID NO: 13027 - DNA, 263 bp, synthetic construct; identical to SEQ ID NO: 6632
  misc_feature 1..263: note = Synthetic polypeptide
  source 1..263: mol_type = other DNA

SEQ ID NO: 13028 - DNA, 809 bp, synthetic construct; identical to SEQ ID NO: 8643
  misc_feature 1..809: note = Synthetic polypeptide
  source 1..809: mol_type = other DNA

SEQ ID NO: 13029 - DNA, 2983 bp, synthetic construct; identical to SEQ ID NO: 8169
  misc_feature 1..2983: note = Synthetic polypeptide
  source 1..2983: mol_type = other DNA

SEQ ID NO: 13030 - DNA, 3010 bp, synthetic construct; identical to SEQ ID NO: 8170
  misc_feature 1..3010: note = Synthetic polypeptide
  source 1..3010: mol_type = other DNA

SEQ ID NO: 13031 - DNA, 588 bp, synthetic construct; identical to SEQ ID NO: 7495
  misc_feature 1..588: note = Synthetic polypeptide
  source 1..588: mol_type = other DNA

SEQ ID NO: 13032 - DNA, 454 bp, synthetic construct
  misc_feature 1..454: note = Synthetic polypeptide
  source 1..454: mol_type = other DNA
gagtgtgggcgcgaggcagctgagcgacctccagagcatcctggccacgatgaacgtaccagccgggccagcaggcggccagcaagtggacctggccagtgtgctgacgccggagataatggctcccatcctcgccaacgcggatgtccaggagcgcctgcttccctacttgccatctggggagtcgctgccgcagaccgcggatgagatccagaataccctgacctcgccccagttccagcaggccctgggcatgttcagcgcagccttggcctcggggcagctgggccccctcatgtgccagttcggtctgcctgcagaggctgtggaggccgccaacaagggcgatgtggaagcgtttgccaaagccatgcagaacaacgccaagcccgagcagaaagagggcgacacgaaggacaagaaggacgaagaggaggacatgagcctggactga

SEQ ID NO: 13033 - DNA, 7988 bp, synthetic construct; identical to SEQ ID NO: 8551
  misc_feature 1..7988: note = Synthetic polypeptide
  source 1..7988: mol_type = other DNA

SEQ ID NO: 13034 - DNA, 1301 bp, synthetic construct; identical to SEQ ID NO: 8552
  misc_feature 1..1301: note = Synthetic polypeptide
  source 1..1301: mol_type = other DNA

SEQ ID NO: 13035 - DNA, 1808 bp, synthetic construct; identical to SEQ ID NO: 8393
  misc_feature 1..1808: note = Synthetic polypeptide
  source 1..1808: mol_type = other DNA

SEQ ID NO: 13036 - DNA, 809 bp, synthetic construct; identical to SEQ ID NO: 8699
  misc_feature 1..809: note = Synthetic polypeptide
  source 1..809: mol_type = other DNA

SEQ ID NO: 13037 - DNA, 207 bp, synthetic construct
  misc_feature 1..207: note = Synthetic polypeptide
  source 1..207: mol_type = other DNA
ggccgggcgcagtggctcacgcctgtaatcccagcactttgggaggctgaagggggtggatcacctgaggtcaggagttcgagaccagcctggccaacatggaatgatgagaagacagcagctgattacaagattttagtgatggaactgtacgagataggcggggccaagacgtccgactgtacccagaggtgcctgaggtcctaa

SEQ ID NO: 13038 - DNA, 198 bp, synthetic construct
  misc_feature 1..198: note = Synthetic polypeptide
  source 1..198: mol_type = other DNA
ggccgggcgcagtggctcacgcctgtaatcccagcactttgggaggctgaagggggtggatcacctgaggtcaggagttcgagaccagcctggccaacatggaatgatgagaagacagcagctgattacaagattttaggtggttcagtccttcacctggtgttggctctgagaggaggaggtggtcttaggcagtga

SEQ ID NO: 13039 - DNA, 962 bp, synthetic construct
  misc_feature 1..962: note = Synthetic polypeptide
  source 1..962: mol_type = other DNA
ggctggccgtggtttctcatacctgtaatcccagcgctttgggaggctgagagctgatgccttcctccagactgtggagcctctcctataccaaatggaagtgcctcctgtattgcaatggtgtcctggagcctctgtacctgtgcccaaatggtgcccgctgtgccacctggtttcaagaccctacccgcttcactggcaccatggatgccttcgtgaagatcgtgaggcacgagggcaccaggaccctctggagcggcctccccgccaccctggtgatgactgtgccagctaccgccatctacttcactgcctatgaccaactgaaggccttcctgtgtggtcgagccctgacctctgacctctacgcacccatggtggctggcgcgctggcccgcctgggcaccgtgactgtgatcagccccctggagcttatgcggacaaagctgcaggctcagcatgtgtcgtaccgggagctgggtgcctgtgttcgaactgcagtggctcagggtggctggcgctcactgtggctgggctggggccccactgcccttcgagatgtgcccttctcagccctgtactggttcaactatgagctggtgaagagctggctcaatgggttcaggccgaaggaccagacttctgtgggcatgagctttgtggctggtggcatctcagggacggtggctgcagtgctgactctaccctttgacgtggtaaagacccaacgccaggtcgctctgggagcgatggaggctgtgagagtgaaccccctgcatgtggactccacctggctgctgctgcggaggatccgggccgagtcgggcaccaagggactctttgcaggcttccttcctcggatcatcaaggctgccccctcctgtgccatcatgatcagcacctatgagttcggcaaaagcttcttccagaggctgaaccaggaccggcttctgggcggctga

SEQ ID NO: 13040 - DNA, 986 bp, synthetic construct
  misc_feature 1..986: note = Synthetic polypeptide
  source 1..986: mol_type = other DNA
ggctggccgtggtttctcatacctgtaatcccagcgctttgggaggctgagagctgatgccttcctccagactgtggagcctctcctataccaaattgccctcctctctccaatccacagggaagtgcctcctgtattgcaatggtgtcctggagcctctgtacctgtgcccaaatggtgcccgctgtgccacctggtttcaagaccctacccgcttcactggcaccatggatgccttcgtgaagatcgtgaggcacgagggcaccaggaccctctggagcggcctccccgccaccctggtgatgactgtgccagctaccgccatctacttcactgcctatgaccaactgaaggccttcctgtgtggtcgagccctgacctctgacctctacgcacccatggtggctggcgcgctggcccgcctgggcaccgtgactgtgatcagccccctggagcttatgcggacaaagctgcaggctcagcatgtgtcgtaccgggagctgggtgcctgtgttcgaactgcagtggctcagggtggctggcgctcactgtggctgggctggggccccactgcccttcgagatgtgcccttctcagccctgtactggttcaactatgagctggtgaagagctggctcaatgggttcaggccgaaggaccagacttctgtgggcatgagctttgtggctggtggcatctcagggacggtggctgcagtgctgactctaccctttgacgtggtaaagacccaacgccaggtcgctctgggagcgatggaggctgtgagagtgaaccccctgcatgtggactccacctggctgctgctgcggaggatccgggccgagtcgggcaccaagggactctttgcaggcttccttcctcggatcatcaaggctgccccctcctgtgccatcatgatcagcacctatgagttcggcaaaagcttcttccagaggctgaaccaggaccggcttctgggcggctga

SEQ ID NO: 13041 - DNA, 399 bp, synthetic construct
  misc_feature 1..399: note = Synthetic polypeptide
  source 1..399: mol_type = other DNA
ggctggccgtggtttctcatacctgtaatcccagcgctttgggaggctgagagctgatgccttcctccagactgtggagcctctcctataccaaatggaagtgcctcctgtattgcaatggtgtcctggagcctctgtacctgtgcccaaatggtgcccgctgtgccacctggtttcaagaccctacccgcttcactggcaccatggatgccttcgtgaagatcgtgaggcacgagggcaccaggaccctctggagcggcctccccgccaccctggtgatgactgtgccagctaccgccatctacttcactgcctatgaccaactgaaggccttcctgtgtggtcgagccctgacctctgacctctacgcacccatggtggctggcgcgctggcccgcc

SEQ ID NO: 13042 - DNA, 203 bp, synthetic construct
  misc_feature 1..203: note = Synthetic polypeptide
  source 1..203: mol_type = other DNA
ggctggccgtggtttctcatacctgtaatcccagcgctttgggaggctgagagctgatgccttcctccagactgtggagcctctcctataccaaatggaagtgcctcctgtattgcaatggtgtcctggagcctctgtacctgtgcccaaatggtgcccgctgtgccacctggtttcaagaccctacccgcttcactggcacc

SEQ ID NO: 13043 - DNA, 186 bp, synthetic construct
  misc_feature 1..186: note = Synthetic polypeptide
  source 1..186: mol_type = other DNA
ggctggccgtggtttctcatacctgtaatcccagcgctttgggaggctgagagctgatgccttcctccagactgtggagcctctcctataccaaatggaagtgcctcctgtattgcaatggtgtcctggagcctctgtacctgtgcccaaatggtgcccgctgtgccacctggtttcaagacccta

SEQ ID NO: 13044 - DNA, 122 bp, synthetic construct
  misc_feature 1..122: note = Synthetic polypeptide
  source 1..122: mol_type = other DNA
ggctggccgtggtttctcatacctgtaatcccagcgctttgggaggctgagagctgatgccttcctccagactgtggagcctctcctataccaaattgccctcctctctccaatccacaggg

SEQ ID NO: 13045 - DNA, 809 bp, synthetic construct; identical to SEQ ID NO: 8699
  misc_feature 1..809: note = Synthetic polypeptide
  source 1..809: mol_type = other DNA

SEQ ID NO: 13046 - DNA, 763 bp, synthetic construct; identical to SEQ ID NO: 606
  misc_feature 1..763: note = Synthetic polypeptide
  source 1..763: mol_type = other DNA

SEQ ID NO: 13047 - DNA, 1447 bp, synthetic construct; identical to SEQ ID NO: 9968
  misc_feature 1..1447: note = Synthetic polypeptide
  source 1..1447: mol_type = other DNA

SEQ ID NO: 13048 - DNA, 1828 bp, synthetic construct; identical to SEQ ID NO: 9969
  misc_feature 1..1828: note = Synthetic polypeptide
  source 1..1828: mol_type = other DNA

SEQ ID NO: 13049 - DNA, 1443 bp, synthetic construct
  misc_feature 1..1443: note = Synthetic polypeptide
  source 1..1443: mol_type = other DNA
cttctagaagaaaacatctccatgatcttgaggagtgccagcttctctcagggcaccagagcctcttttctcatgaggagtgacacagctgtacaaaaacttgcccagggcaatggacactgtgtcaacgggatcagtggtcaagtccatggcttctatagccttcccaagccgagccggcacaatacagaattcagagacagtacctacgacctcccccgcagcctggcctcccatggccacaccaagggcagcctcacaggctccgagacagataatgaggatgtgtacaccttcaagacgcccagcaacaccctgtgcagggagttcggggacctcctggtagacaatatggatgttccggccaccccactctcagcctaccagatccctaggacattcactctggacaaaaaccacaatgccatgacagtggccactcctggggactcagccatagctcccccaccccgcccccccaagccaagtcaggcagaaacacctcgatggggcagtcctcagcagagaccgccaatcagtgaaaatagcagatctgtcgctgccaccatccccagacgcaacaccctccctgcaatggacaacagccgacttcaccgagcttcttcctgtgagacctacgagtacccacagcgtggtggagagagtgcaggccggtctgctgaatccatgagtgatggagttggctctttcctgccagggaaaatgattgtgggccgatcggacagcaccaattctgaagacaactatgtgcccatgaatccaggttcttccaccctgttggccatggaacgagcaggtgataattcccagagcgtctacatcccaatgagcccaggggcccatcactttgactcacttggctacccatcaacaacccttcctgtgcaccgaggccccagcagaggaagtgagattcagccaccccctgtcaaccgcaacctcaaacctgatcggaaagcaaagccaacaccacttgacctgaggaacaacaccgtcatcgatgaactccccttcaagtcacctatcaccaagtcttggtctagggccaaccacaccttcaactccagctcctcccagtactgccgccccatctccacccagagcatcaccagcacagactcaggagacagcgaagagaactatgtccctatgcaaaacccagtgtctgcatctcccgttcccagtggcacgaacagtcctgcccctaagaagagcaccggcagcgttgattatctggccctggacttccagccgagctccccaagcccccaccgcaagccatctacttcatccgtcacctctgatgagaaggtggactacgttcaggtggacaaggagaagacccaggccctgcagaacaccatgcaggagtggacagacgtgcggcagtcctcagagccttccaagggtgccaagctgtga

SEQ ID NO: 13050 - DNA, 809 bp, synthetic construct; identical to SEQ ID NO: 8505
  misc_feature 1..809: note = Synthetic polypeptide
  source 1..809: mol_type = other DNA

SEQ ID NO: 13051 - DNA, 1987 bp, synthetic construct
  misc_feature 1..1987: note = Synthetic polypeptide
  source 1..1987: mol_type = other DNA
tgctggaggtggggctggtgggaggtggttggatcgtgcgggtggagtgctcgtgaagggtttagcaccatcctctacttgggactgtatagtgagtgagttcttgtgaggcctggttgttgaaaagtgtgtggcacctgccccctctctccctttctcttgttctggccagcaacagtatcaaagtgctctattttgggcagataaagtagcttcactctctcgtgaagaaccccaggacatctattggttggctcagtgtctttacctgacagcacaatatcacagagccgcccatgcacttcggtcacgaaaactggacaaattgtatgaagcatgtcgttaccttgcagctaggtgccattatgctgcaaaagagcaccagcaggcccttgatgttcttgacatggaagagcccatcaataaaagattatttgaaaaatacttgaaggacgaaagtggcttcaaagatccttccagcgactgggaaatgtcacagtcttcaataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaagaaaaagaacttcttgaatcactaccccttagcaagctgtgtaatgaagaacaggaattgctgcgttttctatttgagaacaaattgaaaaaatataataagcctagtgaaacggtcatccctgaatctgtagatggcttgcaagagaatctggatgtggtagtgtctttagctgagagacattattataactgtgattttaaaatgtgctacaagcttacttctgtagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttgcggtggagagtgagcacgaccaagcgatggctgcttacttcacagcagcacagctgatgaaagggtgtcatttgcctatgctgtatattggattagaatatggtttgaccaataactcaaaactagctgaaaggttcttcagccaagctctgagcattgcaccggaagacccttttgttatgcatgaggtcggcgtggttgcatttcagaatggagaatggaaaacagccgaaaaatggtttcttgatgctttggaaaaaattaaagcaattgggaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatattggagcagacattaaagacaaattaaaatgttatgactttgatgtgcatacaatgaagacactaaaaaacattatttcacctccgtgggatttcagggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagcacgtga

SEQ ID NO: 13052 - DNA, 1984 bp, synthetic construct
  misc_feature 1..1984: note = Synthetic polypeptide
  source 1..1984: mol_type = other DNA
tgctggaggtggggctggtgggaggtggttggatcgtgcgggtggagtgctcgtgaagggtttagcaccatcctctacttgggactgtatagtgagtgagttcttgtgaggcctggttgttgaaaagtgtgtggcacctgccccctctctccctttctcttgttctggccagcaacagtatcaaagtgctctattttgggcagataaagtagcttcactctctcgtgaaccccaggacatctattggttggctcagtgtctttacctgacagcacaatatcacagagccgcccatgcacttcggtcacgaaaactggacaaattgtatgaagcatgtcgttaccttgcagctaggtgccattatgctgcaaaagagcaccagcaggcccttgatgttcttgacatggaagagcccatcaataaaagattatttgaaaaatacttgaaggacgaaagtggcttcaaagatccttccagcgactgggaaatgtcacagtcttcaataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaagaaaaagaacttcttgaatcactaccccttagcaagctgtgtaatgaagaacaggaattgctgcgttttctatttgagaacaaattgaaaaaatataataagcctagtgaaacggtcatccctgaatctgtagatggcttgcaagagaatctggatgtggtagtgtctttagctgagagacattattataactgtgattttaaaatgtgctacaagcttacttctgtagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttgcggtggagagtgagcacgaccaagcgatggctgcttacttcacagcagcacagctgatgaaagggtgtcatttgcctatgctgtatattggattagaatatggtttgaccaataactcaaaactagctgaaaggttcttcagccaagctctgagcattgcaccggaagacccttttgttatgcatgaggtcggcgtggttgcatttcagaatggagaatggaaaacagccgaaaaatggtttcttgatgctttggaaaaaattaaagcaattgggaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatattggagcagacattaaagacaaattaaaatgttatgactttgatgtgcatacaatgaagacactaaaaaacattatttcacctccgtgggatttcagggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagcacgtga

SEQ ID NO: 13053 - DNA, 3238 bp, synthetic construct; identical to SEQ ID NO: 8118
  misc_feature 1..3238: note = Synthetic polypeptide
  source 1..3238: mol_type = other DNA

SEQ ID NO: 13054 - DNA, 1163 bp, synthetic construct; identical to SEQ ID NO: 7268
  misc_feature 1..1163: note = Synthetic polypeptide
  source 1..1163: mol_type = other DNA

SEQ ID NO: 13055 - DNA, 893 bp, synthetic construct; identical to SEQ ID NO: 7269
  misc_feature 1..893: note = Synthetic polypeptide
  source 1..893: mol_type = other DNA

SEQ ID NO: 13056 - DNA, 1235 bp, synthetic construct; identical to SEQ ID NO: 7270
  misc_feature 1..1235: note = Synthetic polypeptide
  source 1..1235: mol_type = other DNA

SEQ ID NO: 13057 - DNA, 392 bp, synthetic construct; identical to SEQ ID NO: 7271
  misc_feature 1..392: note = Synthetic polypeptide
  source 1..392: mol_type = other DNA

SEQ ID NO: 13058 - DNA, 902 bp, synthetic construct; identical to SEQ ID NO: 7272
  misc_feature 1..902: note = Synthetic polypeptide
  source 1..902: mol_type = other DNA

SEQ ID NO: 13059 - DNA, 785 bp, synthetic construct; identical to SEQ ID NO: 7273
  misc_feature 1..785: note = Synthetic polypeptide
  source 1..785: mol_type = other DNA

SEQ ID NO: 13060 - DNA, 2502 bp, synthetic construct
  misc_feature 1..2502: note = Synthetic polypeptide
  source 1..2502: mol_type = other DNA
ggccaggcgcagtggctcatgcctgtaatcccagcactttgggaggccgaggcaggtggataacctgaggtcgggagtttgagaccagcctggccaacatggagaaaccccgtctctactgaaaatacaaaaattagctgggcgcgatggcacatgcctgtagtcccagtcccagctacttgggaagctaaggtttctaatgatctattactaaaaattaaagatactgttcttcagaggacagtggatggcatgcagcaagagggtactccatatacaggtattctctatgctggaataatgctgaccaagaatggcccaaaagttctagagtttaattgccgttttggtgatccagagtgccaagtaatcctcccacttcttaaaagtgatctttatgaagtgattcagtccaccttagatggactgctctgcacatctctgcctgtttggctagaaaaccacaccgccctaactgttgtcatggcaagtaaaggttatcctggagactacaccaagggtgtagagataacagggtttcctgaggctcaagctctaggactggaggtgttccatgcaggcactgccctcaaaaatggcaaagtagtaactcatgggggtagagttcttgcagtcacagccatccgggaaaatctcatatcagcccttgaggaagccaagaaaggactagctgctataaagtttgagggagcaatttataggaaagacgtcggctttcgtgccatagctttcctccagcagcccaggagtttgacttacaaggaatctggagtagatatcgcagctggaaatatgctggtcaagaaaattcagcctttagcaaaagccacttccagatcaggctgtaaagttgatcttggaggttttgctggtctttttgatttaaaagcagctggtttcaaagatccccttctggcctctggaacagatggcgttggaactaaactaaagattgcccagctatgcaataaacatgataccattggtcaagatttggtagcaatgtgtgttaatgatattctggcacaaggagcagagcccctcttcttccttgattacttttcctgtggaaaacttgacctcagtgtaactgaagctgttgttgctggaattgctaaagcttgtggaaaagctggatgtgctctccttggaggtgaaacagcagaaatgcctgacatgtatccccctggagagtatgacctagctgggtttgccgttggtgccatggagcgagatcagaaactccctcacctggaaagaatcactgagggtgatgttgttgttggaatagcttcatctggtcttcatagcaatggatttagccttgtgaggaaaatcgtggcaaaatcttccctccagtactcctctccagcacctgatggttgtggtgaccagactttaggggacttacttctcacgcctaccagaatctacagccattcactgttacctgtcctacgttcaggacatgtcaaagcctttgcccatattactggtggaggattactagagaacatccccagagtcctccctgagaaacttggggtagatttagatgcccagacctggaggatccccagggtcttctcatggttgcagcaggaaggacacctctctgaggaagagatggccagaacatttaactgtggggttggcgctgtccttgtggtatcaaaggagcagacagagcagattctgagggatatccagcagcacaaggaagaagcctgggtgattggcagtgtggttgcacgagctgaaggttccccacgtgtgaaagtcaagaatctgattgaaagcatgcaaataaatgggtcagtgttgaagaatggctccctgacaaatcatttctcttttgaaaaaaaaaaggccagagtggctgtcttaatatctggaacaggatcgaacctgcaagcacttatagacagtactcgggaaccaaatagctctgcacaaattgatattgttatctccaacaaagccgcagtagctgggttagataaagcggaaagagctggtattcccactagagtaattaatcataaactgtataaaaatcgtgtagaatttgacagtgcaattgacctagtccttgaagagttctccatagacatagtctgtcttgcaggattcatgagaattctttctggcccctttgtccaaaagtggaatggaaaaatgctcaatatccacccatccttgctcccttcttttaagggttcaaatgcccatgagcaagccctggaaaccggagtcacagttactgggtgcactgtacactttgtagctgaagatgtggatgctggacagattattttgcaagaagctgttcccgtgaagaggggtgatactgtcgcaactctttctgaaagagtaaaattagcagaacataaaatatttcctgcagcccttcagctggtggccagtggaactgtacagcttggagaaaatggcaagatctgttgggttaaagaggaatga

SEQ ID NO: 13061 - DNA, 390 bp, synthetic construct
  misc_feature 1..390: note = Synthetic polypeptide
  source 1..390: mol_type = other DNA
ggccaggcgcagtggctcatgcctgtaatcccagcactttgggaggccgaggcaggtggataacctgaggtcgggagtttgagaccagcctggccaacatggagaaaccccgtctctactgaaaatacaaaaattagctgggcgcgatggcacatgcctgtagtcccagtcccagctacttgggaagctaaggtttctaatgatctattactaaaaattaaagatactgttcttcagaggacagtggatggcatgcagcaagagggtactccatatacaggtattctctatgctggaataatgctgaccaagaatggcccaaaagttctagagtttaattgccgttttggtgatccagagtgccaagtgggtaatcctcccacttcttaa

SEQ ID NO: 13062 - DNA, 771 bp, synthetic construct
  misc_feature 1..771: note = Synthetic polypeptide
  source 1..771: mol_type = other DNA
ggccaggcgcagtggctcatgcctgtaatcccagcactttgggaggccgaggcaggtggataacctgaggtcgggagtttgagaccagcctggccaacatggagaaaccccgtctctactgaaaatacaaaaattagctgggcgcgatggcacatgcctgtagtcccagtcccagctacttgggaagctaaggtttctaatgatctattactaaaaattaaagatactgttcttcagaggacagtggatggcatgcagcaagagggtactccatatacaggtattctctatgctggaataatgctgaccaagaatggcccaaaagttctagagtttaattgccgttttggtgatccagagtgccaagtaatcctcccacttcttaaaagtgatctttatgaagtgattcagtccaccttagatggactgctctgcacatctctgcctgtttggctagaaaaccacaccgccctaactgttgtcatggcaagtaaaggttatcctggagactacaccaagggtgtagagataacagggtttcctgaggctcaagctctaggactggaggtgttccatgcaggcactgccctcaaaaatggcaaagtagtaactcatgggggtagagttcttgcagtcacagccatccgggaaaatctcatatcagcccttgaggaagccaagaaaggactagctgctataaagtttgagggagcaatttataggaaagacgtcggctttcgtgccatagctttcctccagcagcccaggtaa

SEQ ID NO: 13063 - DNA, 657 bp, synthetic construct; identical to SEQ ID NO: 8366
  misc_feature 1..657: note = Synthetic polypeptide
  source 1..657: mol_type = other DNA

SEQ ID NO: 13064 - DNA, 310 bp, synthetic construct; identical to SEQ ID NO: 8367
  misc_feature 1..310: note = Synthetic polypeptide
  source 1..310: mol_type = other DNA

SEQ ID NO: 13065 - DNA, 718 bp, synthetic construct; identical to SEQ ID NO: 821
  misc_feature 1..718: note = Synthetic polypeptide
  source 1..718: mol_type = other DNA

SEQ ID NO: 13066 - DNA, 809 bp, synthetic construct; identical to SEQ ID NO: 8643
  misc_feature 1..809: note = Synthetic polypeptide
  source 1..809: mol_type = other DNA

SEQ ID NO: 13067 - DNA, 959 bp, synthetic construct; identical to SEQ ID NO: 7258
  misc_feature 1..959: note = Synthetic polypeptide
  source 1..959: mol_type = other DNA

SEQ ID NO: 13068 - DNA, 649 bp, synthetic construct; identical to SEQ ID NO: 7259
  misc_feature 1..649: note = Synthetic polypeptide
  source 1..649: mol_type = other DNA

SEQ ID NO: 13069 - DNA, 252 bp, synthetic construct; identical to SEQ ID NO: 8153
  misc_feature 1..252: note = Synthetic polypeptide
  source 1..252: mol_type = other DNA

SEQ ID NO: 13070 - DNA, 561 bp, synthetic construct; identical to SEQ ID NO: 6592
  misc_feature 1..561: note = Synthetic polypeptide
  source 1..561: mol_type = other DNA

SEQ ID NO: 13071 - DNA, 196 bp, synthetic construct; identical to SEQ ID NO: 6593
  misc_feature 1..196: note = Synthetic polypeptide
  source 1..196: mol_type = other DNA

SEQ ID NO: 13072 - DNA, 423 bp, synthetic construct; identical to SEQ ID NO: 6594
  misc_feature 1..423: note = Synthetic polypeptide
  source 1..423: mol_type = other DNA

SEQ ID NO: 13073 - DNA, 554 bp, synthetic construct; identical to SEQ ID NO: 12679
  misc_feature 1..554: note = Synthetic polypeptide
  source 1..554: mol_type = other DNA

SEQ ID NO: 13074 - DNA, 473 bp, synthetic construct; identical to SEQ ID NO: 12680
  misc_feature 1..473: note = Synthetic polypeptide
  source 1..473: mol_type = other DNA

SEQ ID NO: 13075 - DNA, 479 bp, synthetic construct; identical to SEQ ID NO: 12681
  misc_feature 1..479: note = Synthetic polypeptide
  source 1..479: mol_type = other DNA

SEQ ID NO: 13076 - DNA, 676 bp, synthetic construct
  misc_feature 1..676: note = Synthetic polypeptide
  source 1..676: mol_type = other DNA
ggcggggcgaggtggctcacgcctgtaatcccagcactttgggaggccgaggcaagtggatcatcaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccggggtagagatcaagaagacagcggtacaagatctgagcttcaacaagaacctgagggctgtggtgtcagtgctgggctcctggctgcaggaccaccctcaggatttccgagacccccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggacctcccagagttgcccaaacttctgacccagactcttcagaggcctgcgcggaggaagaggaagggctcatgcctcaaggtccccagctcctggacttcagcgtggacgaggtggccgagcagctga

SEQ ID NO: 13077 - DNA, 466 bp, synthetic construct
  misc_feature 1..466: note = Synthetic polypeptide
  source 1..466: mol_type = other DNA
ggcggggcgaggtggctcacgcctgtaatcccagcactttgggaggccgaggcaagtggatcatcaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccggagatcaagaagacagcggtacaagatctgagcttcaacaagaacctgagggctgtggtgtcagtgctgggctcctggctgcaggaccaccctcaggatttccgagacccccctgcccattcggacctgggcagtgtccgaacctttctgggctgggcggccccagggagtgctga

SEQ ID NO: 13078 - DNA, 2053 bp, synthetic construct
  misc_feature 1..2053: note = Synthetic polypeptide
  source 1..2053: mol_type = other DNA
ggcggggcgaggtggctcacgcctgtaatcccagcactttgggaggccgaggcaagtggatcatcaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccggggtagagatcaagaagacagcggtacaagatctgagcttcaacaagaacctgagggctgtggtgtcagtgctgggctcctggctgcaggaccaccctcaggatttccgagacccccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctacaccctgagcccccacccgcccatcctggctgccctgcatgcccagaaccagctcaccgaggagcagagctaccggctctcccgggtcattgagccaccagctgcctcctgccccagctccccacgcatccgacggcggatcagcctcaccaagcgtctcagtgcgaagcttgcccgagagaaaagctcatcacctagtgggagtcccggggacccctcatcccccacctccagtgtgtccccagggtcacccccctcaagtcctagaagcagagatgctcctgctggcagtcccccggcctctccagggccccagggccccagcaccaagctgcccctgagcctggacctgcccagcccccggcccttcgctttgcctctgggcagccctcgaatccccctcccggcgcagcagagctcggaggcccgtgtcatccgcgtcagcatcgacaatgaccacgggaacctgtatcgaagcatcttgctgaccagtcaggacaaagcccccagcgtggtccggcgagccttgcagaagcacaatgtgccccagccctgggcctgtgactatcagctctttcaagtccttcctggggaccgggtgctcctgattcctgacaatgccaacgtcttctatgccatgagtccagtcgcccccagagacttcatgctgcggcggaaagaggggacccggaacactctgtctgtctccccaagctga

SEQ ID NO: 13079 - DNA, 2071 bp, synthetic construct
  misc_feature 1..2071: note = Synthetic polypeptide
  source 1..2071: mol_type = other DNA
ggcggggcgaggtggctcacgcctgtaatcccagcactttgggaggccgaggcaagtggatcatcaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccggggtagagatcaagaagacagcggtacaagatctgagcttcaacaagaacctgagggctgtggtgtcagtgctgggctcctggctgcaggaccaccctcaggatttccgagacccccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctacaccctgagcccccacccgcccatcctggctgccctgcatgcccagaaccagctcaccgaggagcagagctaccggctctcccgggtcattgagccaccagctgcctcctgccccagctccccacgcatccgacggcggatcagcctcaccaagcgtctcagtgcgaagcttgcccgagagaaaagctcatcacctagtgggagtcccggggacccctcatcccccacctccagcctctgcatctcccccagtgtgtccccagggtcacccccctcaagtcctagaagcagagatgctcctgctggcagtcccccggcctctccagggccccagggccccagcaccaagctgcccctgagcctggacctgcccagcccccggcccttcgctttgcctctgggcagccctcgaatccccctcccggcgcagcagagctcggaggcccgtgtcatccgcgtcagcatcgacaatgaccacgggaacctgtatcgaagcatcttgctgaccagtcaggacaaagcccccagcgtggtccggcgagccttgcagaagcacaatgtgccccagccctgggcctgtgactatcagctctttcaagtccttcctggggaccgggtgctcctgattcctgacaatgccaacgtcttctatgccatgagtccagtcgcccccagagacttcatgctgcggcggaaagaggggacccggaacactctgtctgtctccccaagctga

SEQ ID NO: 13080 - DNA, 558 bp, synthetic construct
  misc_feature 1..558: note = Synthetic polypeptide
  source 1..558: mol_type = other DNA
ggcggggcgaggtggctcacgcctgtaatcccagcactttgggaggccgaggcaagtggatcatcaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccggggtagagatcaagaagacagcggtacaagatctgagcttcaacaagaacctgagggctgtggtgtcagtgctgggctcctggctgcaggaccaccctcaggatttccgagacccccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacagg

SEQ ID NO: 13081 - DNA, 421 bp, synthetic construct
  misc_feature 1..421: note = Synthetic polypeptide
  source 1..421: mol_type = other DNA
ggcggggcgaggtggctcacgcctgtaatcccagcactttgggaggccgaggcaagtggatcatcaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccggggtagagatcaagaagacagcggtacaagatctgagcttcaacaagaacctgaggaccaccctcaggatttccgagacccccctgcccattcggacctgggcagtgtccgaacctttctgggctgggcgg

SEQ ID NO: 13082 - DNA, 1795 bp, synthetic construct; identical to SEQ ID NO: 879
  misc_feature 1..1795: note = Synthetic polypeptide
  source 1..1795: mol_type = other DNA

SEQ ID NO: 13083 - DNA, 1171 bp, synthetic construct; identical to SEQ ID NO: 880
  misc_feature 1..1171: note = Synthetic polypeptide
  source 1..1171: mol_type = other DNA

SEQ ID NO: 13084 - DNA, 701 bp, synthetic construct; identical to SEQ ID NO: 658
  misc_feature 1..701: note = Synthetic polypeptide
  source 1..701: mol_type = other DNA

SEQ ID NO: 13085 - DNA, 139 bp, synthetic construct
  misc_feature 1..139: note = Synthetic polypeptide
  source 1..139: mol_type = other DNA
ctgggtgcagtggctcatacctttaatcccagcactttgggaggccaagacctcccacagcccagtgtgccaggacgtgctgaaattcatcagtcagtggtgtggagggctccccagcaccagcttttcctttcagtag

SEQ ID NO: 13086 - DNA, 1283 bp, synthetic construct
  misc_feature 1..1283: note = Synthetic polypeptide
  source 1..1283: mol_type = other DNA
tttaacgtatttaaagcactcagaacagcacctgacacatggtaaccacagtaaccaggatggccgagcctcgatttaacaacccctacttctggccccctcctcccaccatgcccagccagctggacaacctggttctgattaacaagatcaaggagcagctgatggccgagaagatcaggccgcctcacctgccgcccacgtcggcctcgtcgcagcagccgttgctagtgccgccggcacccgccgagagcagccaggccgtcatgtcgctgcccaagctgcagcaggtgccggggctgcatccacaggcggtgccgcagcccgacgtggcgctgcacgcacggccggccaccagcaccgtcacaggtctggggctgtccacccggaccccgtctgtgagcacttctgagtcaagcgcgggcgcgggcacgggcacgggtaccagcaccccgtccacacccaccaccaccagccagagccgcctcatcgcctcgtcccccaccctcatctcagggatcaccagcccccctctcctggactccatcaagacaatccagggccacggcctgcttggcccccccaagtccgaacgcggccgcaaaaagatcaaggcggagaacccggggggtccgcctgtccttgtagtcccctatcccatcctggcctcgggcgagactgccaaggagggcaagacgtacaggtgtaaggtatgcccactgacctttttcaccaagtcagagatgcagatccactccaagtcgcacacagaggccaagccccacaagtgcccgcactgctccaagtcctttgccaacgcctcctacctggcccagcacctgcgcatccacctgggcgtcaagccctaccactgctcctactgtgataagtccttccggcagctctcccacctccagcagcacaccagaatccacacaggcgacagaccctacaagtgcccacatcctggctgcgagaaggctttcactcagctctccaacctccagtctcaccagcgccagcacaacaaggacaagccctacaagtgtcccaactgctaccgggcctattcggactccgcttctttgcagatccacctctcggcccacgccatcaagcacgccaaggcctactgctgcagcatgtgtgggcgggcctacacctcggagacctacctgatgaagcacatgtccaaacacacggtggtggagcacctggtgagccatcactcgccccagaggacggagtcccccggcatcccggtgcgaatctctctcatctga

SEQ ID NO: 13087 - DNA, 1859 bp, synthetic construct
  misc_feature 1..1859: note = Synthetic polypeptide
  source 1..1859: mol_type = other DNA
ggccagtcacggtggctcacgcctgtaatcccagcactttgggaggctgaggcgggtggatcacttgaggtcaggagttagaaaccagcctggccaacatggcgaaaccccgtctctactaaaaatatgaaagttagccaggcgtcgtgacaggtgcccataatcccagctattcgagtgaagatgtctggctggaagcagccaggttgcagcctggggacacagccaaggccgtggtagcccaagctgtccgtcatctcccacagtctgtcaggatttacatcagagccgcagagctggaaacggacattcgtgcaaagaagcgggttcttcggaaagccctcgagcatgttccaaactcggttcgcttgtggaaagcagccgttgagctggaagaacctgaagatgctagaatcatgctgagccgagctgtggagtgctgccccaccagcgtggagctctggcttgctctggcaaggctggagacctatgaaaatgcccgcaaggtcttgaacaaggcgcgggagaacattcctacagaccgacatatctggatcacggctgctaagctggaggaagccaatgggaacacgcagatggtggagaagatcatcgaccgagccatcacctcgctgcgggccaacggtgtggagatcaaccgtgagcagtggatccaggatgccgaggaatgtgacagggctgggagtgtggccacctgccaggccgtcatgcgtgccgtgattgggattgggattgaggaggaagatcggaagcatacctggatggaggatgctgacagttgtgtagcccacaatgccctggagtgtgcacgagccatctacgcctacgccctgcaggtgttccccagcaagaagagtgtgtggctgcgcgccgcgtacttcgagaagaaccatggcactcgggagtccctggaagcactcctgcagagggctgtggcccactgccccaaagcagaggtgctgtggctcatgggcgccaagtccaagtggctggcaggggatgtgcctgcagcaaggagcatcctggccctggccttccaggtgttcatgaagtctgtgaagctggagtgggtgcaagacaacatcagggcagcccaagatctgtgcgaggaggccctgcggcactatgaggacttccccaagctgtggatgatgaaggggcagatcgaggagcagaaggagatgatggagaaggcgcgggaagcctataaccaggggttgaagaagtgtccccactccacacccctgtggcttttgctctctcggctggaggagaagattgggcagcttactcgagcacgggccattttggaaaagtctcgtctgaagaacccaaagaaccctgggctgtggttggagtccgtgcggctggagtaccgtgcggggctgaagaacatcgcaaatacactcatggccaaggcgctgcaggagtgccccaactccggtatcctgtggtctgaggccatcttcctcgaggcaaggccccagaggaggaccaagagcgtggatgccctgaagaagtgtgagcatgacccccatgtgctcctggccgtggccaagctgttttggagtcagcggaagatcaccaaggccagggagtggttccaccgcactgtgaagattgactcggacctgggggatgcctgggccttcttctacaagtttgagctgcagcatggcactgaggagcagcaggaggaggtgaggaagcgctgtgagagtgcagagcctcggcatggggagctgtggtgcgccgtgtccaaggacatcgccaactggcagaagaagatcggggacatccttaggctggtggccggccgcatcaagaacaccttctga

SEQ ID NO: 13088 - DNA, 1979 bp, synthetic construct
  misc_feature 1..1979: note = Synthetic polypeptide
  source 1..1979: mol_type = other DNA
ggccagtcacggtggctcacgcctgtaatcccagcactttgggaggctgaggcgggtggatcacttgaggtcaggagttagaaaccagcctggccaacatggcgaaaccccgtctctactaaaaatatgaaagttagccaggcgtcgtgacaggtgcccataatcccagctattcgagtgaagatgtctggctggaagcagccaggttgcagcctggggacacagccaaggccgtggtagcccaagctgtccgtcatctcccacagtctgtcaggatttacatcagagccgcagagctggaaacggacattcgtgcaaagaagcgggttcttcggaaagccctcgagcatgttccaaactcggttcgcttgtggaaagcagccgttgagctggaagaacctgaagatgctagaatcatgctgagccgagctgtggagtgctgccccaccagcgtggagctctggcttgctctggcaaggctggagacctatgaaaatgcccgcaaggtcttgaacaaggcgcgggagaacattcctacagaccgacatatctggatcacggctgctaagctggaggaagccaatgggaacacgcagatggtggagaagatcatcgaccgagccatcacctcgctgcgggccaacggtgtggagatcaaccgtgagcagtggatccaggatgccgaggaatgtgacagggctgggagtgtggccacctgccaggccgtcatgcgtgccgtgattgggattgggattgaggaggaagatcggaagcatacctggatggaggatgctgacagttgtgtagcccacaatgccctggagtgtgcacgagccatctacgcctacgccctgcaggtgttccccagcaagaagagtgtgtggctgcgcgccgcgtacttcgagaagaaccatggcactcgggagtccctggaagcactcctgcagagggctgtggcccactgccccaaagcagaggtgctgtggctcatgggcgccaagtccaagtggctggcaggggatgtgcctgcagcaaggagcatcctggccctggccttccaggccaaccccaacagtgaggagatctggctggcagccgtgaagctggagtccgagaatgatgagtacgagcgggcccggaggctgctggccaaggcgcggagcagtgcccccaccgcccgggtgttcatgaagtctgtgaagctggagtgggtgcaagacaacatcagggcagcccaagatctgtgcgaggaggccctgcggcactatgaggacttccccaagctgtggatgatgaaggggcagatcgaggagcagaaggagatgatggagaaggcgcgggaagcctataaccaggggttgaagaagtgtccccactccacacccctgtggcttttgctctctcggctggaggagaagattgggcagcttactcgagcacgggccattttggaaaagtctcgtctgaagaacccaaagaaccctgggctgtggttggagtccgtgcggctggagtaccgtgcggggctgaagaacatcgcaaatacactcatggccaaggcgctgcaggagtgccccaactccggtatcctgtggtctgaggccatcttcctcgaggcaaggccccagaggaggaccaagagcgtggatgccctgaagaagtgtgagcatgacccccatgtgctcctggccgtggccaagctgttttggagtcagcggaagatcaccaaggccagggagtggttccaccgcactgtgaagattgactcggacctgggggatgcctgggccttcttctacaagtttgagctgcagcatggcactgaggagcagcaggaggaggtgaggaagcgctgtgagagtgcagagcctcggcatggggagctgtggtgcgccgtgtccaaggacatcgccaactggcagaagaagatcggggacatccttaggctggtggccggccgcatcaagaacaccttctga

SEQ ID NO: 13089 - DNA, 636 bp, synthetic construct; identical to SEQ ID NO: 8339
  misc_feature 1..636: note = Synthetic polypeptide
  source 1..636: mol_type = other DNA

SEQ ID NO: 13090 - DNA, 1418 bp, synthetic construct; identical to SEQ ID NO: 8618
  misc_feature 1..1418: note = Synthetic polypeptide
  source 1..1418: mol_type = other DNA

SEQ ID NO: 13091 - DNA, 1595 bp, synthetic construct; identical to SEQ ID NO: 8619
  misc_feature 1..1595: note = Synthetic polypeptide
  source 1..1595: mol_type = other DNA

SEQ ID NO: 13092 - DNA, 578 bp, synthetic construct; identical to SEQ ID NO: 9000
  misc_feature 1..578: note = Synthetic polypeptide
  source 1..578: mol_type = other DNA

SEQ ID NO: 13093 - DNA, 590 bp, synthetic construct; identical to SEQ ID NO: 9001
  misc_feature 1..590: note = Synthetic polypeptide
  source 1..590: mol_type = other DNA

SEQ ID NO: 13094 - DNA, 130 bp, synthetic construct; identical to SEQ ID NO: 9002
  misc_feature 1..130: note = Synthetic polypeptide
  source 1..130: mol_type = other DNA

SEQ ID NO: 13095 - DNA, 228 bp, synthetic construct
  misc_feature 1..228: note = Synthetic polypeptide
  source 1..228: mol_type = other DNA
ggccaggcgaggtggctcacacctgtaatcccagcactttgggaggccgaggcgggcagatcacaagggattggagtttggaatcctgccttcgatgtcaccccccacgacctcatcactggtggcatcatcacagaactgggggtctttgcccctgaggagctccggacagccctaaccaccaccatctcttccagggatggaaccctagatggaccccagatgtaa

SEQ ID NO: 13096 - DNA, 864 bp, synthetic construct; identical to SEQ ID NO: 6975
  misc_feature 1..864: note = Synthetic polypeptide
  source 1..864: mol_type = other DNA

SEQ ID NO: 13097 - DNA, 471 bp, synthetic construct; identical to SEQ ID NO: 6976
  misc_feature 1..471: note = Synthetic polypeptide
  source 1..471: mol_type = other DNA

SEQ ID NO: 13098 - DNA, 2282 bp, synthetic construct
  misc_feature 1..2282: note = Synthetic polypeptide
  source 1..2282: mol_type = other DNA
gttcctcaaagactgtattggtgatcacgtaccgagaacccccaaatcctgagtatcaggaattccagaatcgtctgctgataagagcccgggaagactttggtgtggagctgggcccttccctgatgaacctcatcgctggctgcttctatgatgggatcctgctatatgctgaagtcctgaatgagacaatacaggaaggaggcacccgggaggatggacttcgaattgtggaaaagatgcagggacgaagatatcacggtgtaactgggctggttgtcatggacaagaacaatgaccgagagactgactttgtcctctgggccatgggagacctggattctggggactttcagcctgcagcccactactcgggagctgagaagcagatttggtggacgggacggcctattccctgggtgaagggggctcctccctcggacaatcccccctgtgcctttgacttggacgacccatcctgtgataaaactccactttcaaccctggcaattgtggctctgggcacaggaatcaccttcatcatgtttggtgtttccagcttcctaattttccgaaagctgatgctggagaaggagctggctagcatgttgtggcgtattcgctgggaagaactgcagtttggcaactcagagcgttatcacaaaggtgcaggcagtcgcctcacactgtcgctgcggggatccagttacggctcgctcatgacagcccatgggaaataccagatctttgccaacaccggtcacttcaagggaaatgttgtcgccatcaaacatgtgaataagaagcgcattgagctgacccggcaggttctgtttgaactcaaacatatgagagatgttcagttcaaccatctcactcgcttcattggcgcctgcatagaccctcccaacatttgcattgtcactgaatactgtcctcgtgggagtttacaggatattctagaaaatgacagcatcaacttggactggatgtttcgttattcactcattaatgaccttgttaagggcatggcctttctccacaacagcattatttcatcgcatgggagtctcaagtcctccaactgtgtggtggatagtcgttttgtgctcaaaatcacagactatggcctggccagcttccgatcaactgctgaacctgatgacagccatgccctctatgccaagaagctgtggactgccccagaactgctcagtgggaaccccttgccaaccacaggcatgcagaaggctgacgtctatagctttgggatcatcctgcaggagatagcacttcgcagtggtcctttctacttggagggcctggacctcagccccaaagagattgtccagaaggtacgaaatggtcagcggccatatttccggccaagcattgaccggacccaactgaatgaagagctagttttgctgatggagcgatgttgggctcaggacccagctgagcggccagactttggacagattaagggcttcattcggcgctttaacaaggagggtggcaccagcatattggacaacctcctgctgcgcatggaacagtatgccaataacttggagaagctggtggaggaacgcacacaggcctatctggaggaaaaacgcaaggctgaagctctgctctaccaaatcctaccccattcagtggcagagcagttaaaacggggagagactgtacaggctgaggcctttgacagtgttaccatctacttcagtgacattgttggcttcacagcattgtcagcagagagcacccccatgcaggtagtgacacttcttaatgacctgtatacctgctttgatgccataattgacaactttgatgtctacaaggtggagacgattggggatgcttacatggtggtatctggcctcccaggccgaaatggtcaacgccatgcaccagaaattgctcgtatggccctagcattactagatgcagtttcttcctttcgcatccgccaccgaccccatgaccagctgaggctacgcataggggtccatactgggccagtctgtgctggggttgttggcctgaagatgccccgttattgtctttttggagacacagtgaacactgcttctcgaatggagtctaatggtcaagcgctgaagatccatgtctcctctaccaccaaggatgccctagatgagctaggatgcttccagctagagcttcggggggatgtggaaatgaagggaaaaggaaagatgcgaacatactggctcttaggagagcggaaaggacctcctggactcctgtaa

SEQ ID NO: 13099 - DNA, 1314 bp, synthetic construct
  misc_feature 1..1314: note = Synthetic polypeptide
  source 1..1314: mol_type = other DNA
gggggcggggggggaaggggttgggcgatgcaggtgttgggggccgggacagttgcgggggtaggcaggtaccgggaaggcgggagggcgggcaggttccggaggggcgcgacaggtgctgggacgcgagccatccgggtgacctgcataggttcctgcggggtctccaacaaggctaatgacacagcgtgggtagtggaggagggttacttcaacagttccctgtcgctggcagacaaggggagcctgcccgctggagagcacagcttccccttccagttcctgcttcctgccactgcacccacgtcctttgagggtcctttcgggaagatcgtgcaccaggtgagggccgccatccacacgccacggttttccaaggatcacaagtgcagcctcgtgttctatatcttgagccccttgaacctgaacagcatcccagacattgagcaacccaacgtggcctctgccaccaagaagttctcctacaagctggtgaagacgggcagcgtggtcctcacagccagcactgatctccgcggctatgtggtggggcaggcactgcagctgcatgccgacgttgagaaccagtcaggcaaggacaccagccctgtggtggccagtctgctgcagaaagtgtcctataaggccaagcgctggatccacgacgtacggaccattgcggaggtggagggtgcgggcgtcaaggcctggcggcgggcgcagtggcacgagcagatcctggtgcctgccttgccccagtcggccctgccgggctgcagcctcatccacatcgactactacttacaggtctctctgaaggcgccggaagctactgtgaccctcccggtcttcattggcaatattgctgtgaaccatgccccagtgagcccccggccaggcctggggctgcctcctggggccccacccctggtggtgccttccgcaccaccccaggaggaggctgaggctgaggctgcggctggcggcccccacttcttggaccccgtcttcctctccaccaagagccattcgcagcggcagcccctgctggccaccttgagttctgtgcctggtgcgccggagccctgccctcaggatggcagccctgcctcacacccgctgcaccctcccttgtgcatttcaacaggtgccactgtcccctactttgcagagggctccggggggccagtgcccactaccagcaccttgattcttcctccagagtacagttcttggggctacccctatgaggccccaccgtcttatgagcagagctgcggcggcgtggaacccagcctgacccctgagagctga

SEQ ID NO: 13100 - DNA, 543 bp, synthetic construct
  misc_feature 1..543: note = Synthetic polypeptide
  source 1..543: mol_type = other DNA
gggggcggggggggaaggggttgggcgatgcaggtgttgggggccgggacagttgcgggggtaggcaggtaccgggaaggcgggagggcgggcaggttccggaggggcgcgacaggtgctgggacgcgagccatccgggtgacctgcataggttcctgcggggtctccaacaaggctaatgacacagcgtgggtagtggaggagggttacttcaacagttccctgtcgctggcagacaaggggagcctgcccgctggagagcacagcttccccttccagttcctgcttcctgccactgcacccacgtcctttgagggtcctttcgggaagatcgtgcaccaggtgagggccgccatccacacgccacggttttccaaggatcacaagtgcagcctcgtgttctatatcttgagccccttgaacctgaacagcatcccagacattgagggatccagcctgcgcacacctgctaagcccctccctggccctccccccaagcaacccaacgtggcctctgccaccaagaagttctcctacaagctg

SEQ ID NO: 13101 - DNA, 384 bp, synthetic construct
  misc_feature 1..384: note = Synthetic polypeptide
  source 1..384: mol_type = other DNA
gggggcggggggggaaggggttgggcgatgcaggtgttgggggccgggacagttgcgggggtaggcaggtaccgggaaggcgggagggcgggcaggttccggaggggcgcgacaggtgctgggacgcgagccatccgggtgacctgcataggttcctgcggggtctccaacaaggctaatgacacagcgtgggtagtggaggagggttacttcaacagttccctgtcgctggcagacaagggtaagtttgggagccagttcccgagtggtgacccctgggggcagcccttggagtggggcctgtctgtcctgtcctccccctttcctagatctgcctcttggatctggcactggcccatcttgtcccagggttgtgggccctga

SEQ ID NO: 13102 - DNA, 826 bp, synthetic construct
  misc_feature 1..826: note = Synthetic polypeptide
  source 1..826: mol_type = other DNA
gggggcggggggggaaggggttgggcgatgcaggtgttgggggccgggacagttgcgggggtaggcaggtaccgggaaggcgggagggcgggcaggttccggaggggcgcgacaggtgctgggacgcgagccatccgggtgacctgcataggttcctgcggggtctccaacaaggctaatgacacagcgtgggtagtggaggagggttacttcaacagttccctgtcgctggcagacaaggggagcctgcccgctggagagcacagcttccccttccagttcctgcttcctgccactgcacccacgtcctttgagggtcctttcgggaagatcgtgcaccaggtgagggccgccatccacacgccacggttttccaaggatcacaagtgcagcctcgtgttctatatcttgagccccttgaacctgaacagcatcccagacattgaggcactgcagctgcatgccgacgttgagaaccagtcaggcaaggacaccagccctgtggtggccagtctgctgcagaaagtgtcctataaggccaagcgctggatccacgacgtacggaccattgcggaggtggagggtgcgggcgtcaaggcctggcggcgggcgcagtggcacgagcagatcctggtgcctgccttgccccagtcggccctgccgggctgcagcctcatccacatcgactactacttacaggtctctctgaaggcgccggaagctactgtgaccctcccggtcttcattggcaatattgctgtgaaccatgccccagtgagcccccggccaggcctggggctgcctcctggggccccacccctggtgg

SEQ ID NO: 13103 - DNA, 200 bp, synthetic construct
  misc_feature 1..200: note = Synthetic polypeptide
  source 1..200: mol_type = other DNA
gggcacagtggctcatgcctgtaatcccagcaccttgggaggccgagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtga

SEQ ID NO: 13104 - DNA, 213 bp, synthetic construct
  misc_feature 1..213: note = Synthetic polypeptide
  source 1..213: mol_type = other DNA
gggcacagtggctcatgcctgtaatcccagcaccttgggaggccgagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtga

SEQ ID NO: 13105 - DNA, 646 bp, synthetic construct
  misc_feature 1..646: note = Synthetic polypeptide
  source 1..646: mol_type = other DNA
gggggaggagccaagatggccgaataggaacagctccggtctacagctcccagcgtgagcgacgcagaagacgggtgatttctgcatttccatctgagctgtctccgttatgaggtacagcgcctctgcttttgggtttgcatttgatgccatcctggacgtcctgtcatcggcgattgtcctgtggcgttacagcaacgcggccgctgtgcactctgcccatagggagtacatagcctgtgtcatcttgggggtgatattccttctgtcatccatatgtatagtggtcaaagccatccatgacctctcaactaggctgctcccagaagtggacgatttcctgttcagtgtctccattttaagtgggattctttgcagcatcctggccgtgttgaagttcatgctggggaaggttctgaccagtagagcactcataacagatgggtttaactccctcgtgggtggcgtgatgggcttctccattcttctgagcgcggaagtgttcaagcatgactcggcggtctggtacctggacggcagcataggcgttctgatcggcctcaccatatttgcctatggggtcaaactcctcatcgacatggtgccgagggtgaggcagacacgtcactacgagatgtttgagtga

SEQ ID NO: 13106 - DNA, 779 bp, synthetic construct
  misc_feature 1..779: note = Synthetic polypeptide
  source 1..779: mol_type = other DNA
ggaggcaggtgtgtggggggaagcgggtgtgtgtctgaggaagcgggtgtgtgtggggggaagcgggtgtgtggaggcgggcgtgtgggggaggcgggtgtgtgtgtgagaggaaggtgtgtgggaggaggcagatttgtggggggaggcgggcgtgtgggggaggcgggtgtgaggcgggtgtccgggaggcagccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtccagccctag

SEQ ID NO: 13107 - DNA, 943 bp, synthetic construct; identical to SEQ ID NO: 6540
  misc_feature 1..943: note = Synthetic polypeptide
  source 1..943: mol_type = other DNA

SEQ ID NO: 13108 - DNA, 719 bp, synthetic construct
  misc_feature 1..719: note = Synthetic polypeptide
  source 1..719: mol_type = other DNA
tattttgggccaaattgtgtctcccgacccctgcaaattcatatgttgaagccctggctccccagtacctcagaatgtgactgtatttggagagagggcctttaaagagctgatttaacttaacatgaggccaattagggtgggctctgatccaatctgattaatgttcttatcagaagaggaaatttggacacacagagacaccagagcagagggaagaccttgtgaagacacagggagaatgtggccatctttgagttaagagaggcgtttccatcaaccagttttgcaaggagttcaatgagaggacaaaggacatcaaggaaggcattcctctgcctaccaagattttagtgaagcctgacaggacatttgaaattaagattggacagcccactgtttcctacttcctgaaggcagcagctgggattgaaaagggggcccggcaaacagggaaagaggtggcaggcctggtgaccttgaagcatgtgtatgagattgcccgcatcaaagctcaggatgaggcatttgccctgcaggatgtacccctgtcgtctgttgtccgctccatcatcgggtctgcccgttctctgggcattcgcgtggtgaaggacctcagttcagaagagcttgcagctttccagaaggaacgagccatcttcctggctgctcagaaggaggcagatttggctgcccaagaagaagctgccaagaagtga

SEQ ID NO: 13109 - DNA, 368 bp, synthetic construct
  misc_feature 1..368: note = Synthetic polypeptide
  source 1..368: mol_type = other DNA
tattttgggccaaattgtgtctcccgacccctgcaaattcatatgttgaagccctggctccccagtacctcagaatgtgactgtatttggagagagggcctttaaagagctgatttaacttaacatgaggccaattagggtgggctctgatccaatctgattaatgttcttatcagaagaggaaatttggacacacagagacaccagagcagagggaagaccttgtgaagacacagggagaatgtggccatctttgagttaagagaggcgtttccatcaaccagttttgcaaggagttcaatgagaggacaaaggacatcaaggaaggcattcctctgcctaccaagattttagtgaaggacatttga

SEQ ID NO: 13110 - DNA, 686 bp, synthetic construct
  misc_feature 1..686: note = Synthetic polypeptide
  source 1..686: mol_type = other DNA
tattttgggccaaattgtgtctcccgacccctgcaaattcatatgttgaagccctggctccccagtacctcagaatgtgactgtatttggagagagggcctttaaagagctgatttaacttaacatgaggccaattagggtgggctctgatccaatctgattaatgttcttatcagaagaggaaatttggacacacagagacaccagagcagagggaagaccttgtgaagacacagggagaatgtggccatctttgagttaagagaggcgtttccatcaaccagttttgcaaggagttcaatgagaggacaaaggacatcaaggaaggcattcctctgcctaccaagattttagtgaagcctgacaggacatttgaaattaagattggacagcccactgtttcctacttcctgaaggcagcagctgggattgaaaagggggcccggcaaacagggaaagaggtggcaggcctggtgaccttgaagcatgtgtatgagattgcccgcatcaaagctcaggatgaggcatttgccctgcaggatgtacccctgtcgtctgttgtccgctccatcatcgggtctgcccgttctctgggcattcgcgtggtgaaggaacgttgttctgcaaatgttctaagaaatggaaagatctccatgaaggatccaagtgggagaagttcagtgtga

SEQ ID NO: 13111 - DNA, 1912 bp, synthetic construct; identical to SEQ ID NO: 8999
  misc_feature 1..1912: note = Synthetic polypeptide
  source 1..1912: mol_type = other DNA

SEQ ID NO: 13112 - DNA, 999 bp, synthetic construct; identical to SEQ ID NO: 7471
  misc_feature 1..999: note = Synthetic polypeptide
  source 1..999: mol_type = other DNA

SEQ ID NO: 13113 - DNA, 2825 bp, synthetic construct; identical to SEQ ID NO: 6727
  misc_feature 1..2825: note = Synthetic polypeptide
  source 1..2825: mol_type = other DNA

SEQ ID NO: 13114 - DNA, 1188 bp, synthetic construct; identical to SEQ ID NO: 12282
  misc_feature 1..1188: note = Synthetic polypeptide
  source 1..1188: mol_type = other DNA

SEQ ID NO: 13115 - DNA, 1131 bp, synthetic construct; identical to SEQ ID NO: 12283
  misc_feature 1..1131: note = Synthetic polypeptide
  source 1..1131: mol_type = other DNA

SEQ ID NO: 13116 - DNA, 1263 bp, synthetic construct; identical to SEQ ID NO: 12284
  misc_feature 1..1263: note = Synthetic polypeptide
  source 1..1263: mol_type = other DNA

SEQ ID NO: 13117 - DNA, 894 bp, synthetic construct; identical to SEQ ID NO: 12285
  misc_feature 1..894: note = Synthetic polypeptide
  source 1..894: mol_type = other DNA

SEQ ID NO: 13118 - DNA, 807 bp, synthetic construct; identical to SEQ ID NO: 12286
  misc_feature 1..807: note = Synthetic polypeptide
  source 1..807: mol_type = other DNA

SEQ ID NO: 13119 - DNA, 697 bp, synthetic construct; identical to SEQ ID NO: 12287
  misc_feature 1..697: note = Synthetic polypeptide
  source 1..697: mol_type = other DNA

SEQ ID NO: 13120 - DNA, 765 bp, synthetic construct; identical to SEQ ID NO: 12288
  misc_feature 1..765: note = Synthetic polypeptide
  source 1..765: mol_type = other DNA

SEQ ID NO: 13121 - DNA, 365 bp, synthetic construct; identical to SEQ ID NO: 12289
  misc_feature 1..365: note = Synthetic polypeptide
  source 1..365: mol_type = other DNA

SEQ ID NO: 13122 - DNA, 476 bp, synthetic construct; identical to SEQ ID NO: 12290
  misc_feature 1..476: note = Synthetic polypeptide
  source 1..476: mol_type = other DNA

SEQ ID NO: 13123 - DNA, 113 bp, synthetic construct; identical to SEQ ID NO: 12291
  misc_feature 1..113: note = Synthetic polypeptide
  source 1..113: mol_type = other DNA

SEQ ID NO: 13124 - DNA, 211 bp, synthetic construct; identical to SEQ ID NO: 12292
  misc_feature 1..211: note = Synthetic polypeptide
  source 1..211: mol_type = other DNA

SEQ ID NO: 13125 - DNA, 305 bp, synthetic construct
  misc_feature 1..305: note = Synthetic polypeptide
  source 1..305: mol_type = other DNA
ttatggttttgaagcatatttagtggtcgggaagagtgctcatgatgcgaagctaactgaactatatatacagaatgatccagactttgaaaggaaaaactaaagaaatacatctacatattaagtagtgcatggccccagatgagaccaccctaaaggagctggccgagaccctgcaacagaagaacattgaccacatgctgtggcttgagcaaccagagaatatcgccacttgtattgctctccggccctaccccaaggaagaagtgggccagtatttgaagaagttccgattgttcaagtaa

SEQ ID NO: 13126 - DNA, 1737 bp, synthetic construct; identical to SEQ ID NO: 905
  misc_feature 1..1737: note = Synthetic polypeptide
  source 1..1737: mol_type = other DNA

SEQ ID NO: 13127 - DNA, 284 bp, synthetic construct; identical to SEQ ID NO: 906
  misc_feature 1..284: note = Synthetic polypeptide
  source 1..284: mol_type = other DNA

SEQ ID NO: 13128 - DNA, 856 bp, synthetic construct; identical to SEQ ID NO: 907
  misc_feature 1..856: note = Synthetic polypeptide
  source 1..856: mol_type = other DNA

SEQ ID NO: 13129 - DNA, 802 bp, synthetic construct; identical to SEQ ID NO: 908
  misc_feature 1..802: note = Synthetic polypeptide
  source 1..802: mol_type = other DNA

SEQ ID NO: 13130 - DNA, 561 bp, synthetic construct; identical to SEQ ID NO: 909
  misc_feature 1..561: note = Synthetic polypeptide
  source 1..561: mol_type = other DNA

SEQ ID NO: 13131 - DNA, 582 bp, synthetic construct; identical to SEQ ID NO: 910
  misc_feature 1..582: note = Synthetic polypeptide
  source 1..582: mol_type = other DNA

SEQ ID NO: 13132 - DNA, 135 bp, synthetic construct
  misc_feature 1..135: note = Synthetic polypeptide
  source 1..135: mol_type = other DNA
ggccatgcgcggtggctcacgcctgtaatcccagcactttgggaggccaagccgtttccctggggagatggtaaccatactctattccataaccctcatgtgaatccacttccaactggctacgaagatgaataa

SEQ ID NO: 13133 - DNA, 770 bp, synthetic construct
  misc_feature 1..770: note = Synthetic polypeptide
  source 1..770: mol_type = other DNA
ccctccccttcccgcccgaattctatgagcatgccaaggctctgtgggaggatgaaggagtgcgtgcctgctacgaacgctccaacgagtaccagctgattgactgtgcccagtacttcctggacaagatcgacgtgatcaagcaggctgactatgtgccgagcgatcaggacctgcttcgctgccgtgtcctgacttctggaatctttgagaccaagttccaggtggacaaagtcaacttccacatgtttgacgtgggtggccagcgcgatgaacgccgcaagtggatccagtgcttcaacgatgtgactgccatcatcttcgtggtggccagcagcagctacaacatggtcatccgggaggacaaccagaccaaccgcctgcaggaggctctgaacctcttcaagagcatctggaacaacagatggctgcgcaccatctctgtgatcctgttcctcaacaagcaagatctgctcgctgagaaagtccttgctgggaaatcgaagattgaggactactttccagaatttgctcgctacactactcctgaggatgctactcccgagcccggagaggacccacgcgtgacccgggccaagtacttcattcgagatgagtttctgaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaa

SEQ ID NO: 13134 - DNA, 137 bp, synthetic construct
  misc_feature 1..137: note = Synthetic polypeptide
  source 1..137: mol_type = other DNA
ccctccccttcccgcccgaattctatgagcatgccaaggctctgtgggaggatgaaggagtgcgtgcctgctacgaacgctccaacgagtaccagctgattgactgtgcccagtacttcctggacaagatcgacgtg

SEQ ID NO: 13135 - DNA, 115 bp, synthetic construct
  misc_feature 1..115: note = Synthetic polypeptide
  source 1..115: mol_type = other DNA
ccctccccttcccgcccgaattctatgagcatgccaaggctctgtgggaggatgaaggagtgcgtgcctgctacgaacgctccaacgagtaccagctgattgactgtgcccagta

SEQ ID NO: 13136 - DNA, 244 bp, synthetic construct
  misc_feature 1..244: note = Synthetic polypeptide
  source 1..244: mol_type = other DNA
ccctccccttcccgcccgaattctatgagcatgccaaggctctgtgggaggatgaaggagtgcgtgcctgctacgaacgctccaacgagtaccagctgattgactgtgcccagtacttcctggacaagatcgacgtgatcaagcaggctgactatgtgccgagcgatcaggacctgcttcgctgccgtgtcctgacttctggaatctttgagaccaagttccaggtggacaaagtcaacttcca

SEQ ID NO: 13137 - DNA, 123 bp, synthetic construct
  misc_feature 1..123: note = Synthetic polypeptide
  source 1..123: mol_type = other DNA
ccctccccttcccgcccgaattctatgagcatgccaaggctctgtgggaggatgaaggagtgcgtgcctgctacgaacgctccaacgagtaccagctgattgactgtgcccagtacttcctgg

SEQ ID NO: 13138 - DNA, 966 bp, synthetic construct
  misc_feature 1..966: note = Synthetic polypeptide
  source 1..966: mol_type = other DNA
ccccggcccggccgtgcccccgcgccccggccccggccccggccccgcggcctgcaggccggggccgccatgatcccgagcggccgcgggcccggctcaaaatggaggccgccggcgcgggggggacctggcgcctcccgcccccggcccccggcctcggcggcgcccccggcctcaggcgcggccggccacgacaagggacccgaggcggaggagggcgtcgagctgcaggaaggcggggacggcccaggagcggaggagcagacagcggtggccatcaccagcgtccagcaggcggcgttcggcgaccacaacatccagtaccagttccgcacagagacaaatggaggacaggctgtgatccaaaatcccttcagcaatggtggcagtccggcggccgaggctgtcagcggggaggcacgatttgcctatttcccagcgtccagtgtgggagatactacggctgtgtccgtacagaccacagaccagagcttgcaggctggaggccagttctacgtcatgatgacgccccaggatgtgcttcagacaggaacacagaggacgatcgccccccggacacacccttactctccaaaaattgatggaaccagaacaccccgagatgagaggagaagagcccagcacaacgaagtggagcggaggcggagggacaagatcaacaactggatcgtccagctttcgaaaatcattccagactgtaacgcagacaacagcaagacgggagcgagtaaaggagggatcctgtccaaggcctgcgattacatccgggagttgcgccagaccaaccagcgcatgcaggagaccttcaaagaggccgagcggctgcagatggacaacgagctcctgaggcagcagatcgaggagctgaagaatgagaacgccctgcttcgagcccagctgcagcagcacaacctggagatggtgggcgagggcacccggcagtga

SEQ ID NO: 13139 - DNA, 1167 bp, synthetic construct
  misc_feature 1..1167: note = Synthetic polypeptide
  source 1..1167: mol_type = other DNA
ccccggcccggccgtgcccccgcgccccggccccggccccggccccgcggcctgcaggccggggccgccatgatcccgagcggccgcgggcccggctcaaaatggaggccgccggcgcgggggggacctggcgcctcccgcccccggcccccggcctcggcggcgcccccggcctcaggcgcggccggccacgacaagggacccgaggcggaggagggcgtcgagctgcaggaaggcggggacggcccaggagcggaggagcagacagcggtggccatcaccagcgtccagcaggcggcgttcggcgaccacaacatccagtaccagttccgcacagagacaaatggaggacaggtgacataccgcgtagtccaggtgactgatggtcagctggacggccagggcgacacagctggcgccgtcagcgtcgtgtccaccgctgccttcgcgggggggcagcaggctgtgacccaggtgggtgtggacggggcagcccagcgcccgggccccgccgctgcctctgtgcccccaggtcctgcagcgcccttcccgctggctgtgatccaaaatcccttcagcaatggtggcagtccggcggccgaggctgtcagcggggaggcacgatttgcctatttcccagcgtccagtgtgggagatactacggctgtgtccgtacagaccacagaccagagcttgcaggctggaggccagttctacgtcatgatgacgccccaggatgtgcttcagacaggaacacagaggacgatcgccccccggacacacccttactctccaaaaattgatggaaccagaacaccccgagatgagaggagaagagcccagcacaacgaagtggagcggaggcggagggacaagatcaacaactggatcgtccagctttcgaaaatcattccagactgtaacgcagacaacagcaagacgggagcgagtaaaggagggatcctgtccaaggcctgcgattacatccgggagttgcgccagaccaaccagcgcatgcaggagaccttcaaagaggccgagcggctgcagatggacaacgagctcctgaggcagcagatcgaggagctgaagaatgagaacgccctgcttcgagcccagctgcagcagcacaacctggagatggtgggcgagggcacccggcagtga

SEQ ID NO: 13140 - DNA, 1143 bp, synthetic construct
  misc_feature 1..1143: note = Synthetic polypeptide
  source 1..1143: mol_type = other DNA
ccccggcccggccgtgcccccgcgccccggccccggccccggccccgcggcctgcaggccggggccgccatgatcccgagcggccgcgggcccggctcaaaatggaggccgccggcgcgggggggacctggcgcctcccgcccccggcccccggcctcggcggcgcccccggcctcaggcgcggccggccacgacaagggacccgaggcggaggagggcgtcgagctgcaggaaggcggggacggcccaggagcggaggagcagacagcggtggccatcaccagcgtccagcaggcggcgttcggcgaccacaacatccagtaccagttccgcacagagacaaatggaggacaggtgacataccgcgtagtccaggtgactgatggtcagctggacggccagggcgacacagctggcgccgtcagcgtcgtgtccaccgctgccttcgcgggggggcagcaggctgtgacccaggtgggtgtggacggggcagcccagcgcccgggccccgccgctgcctctgtgcccccaggtcctgcagcgcccttcccgctggctgtgatccaaaatcccttcagcaatggtggcagtccggcggccgaggctgtcagcggggaggcacgatttgcctatttcccagcgtccagtgtgggagatactacggctgtgtccgtacagaccacagaccagagcttgcaggctggaggccagttctacgtcatgatgacgccccaggatgtgcttcagacaggaacacagaggacgatcgccccccggacacacccttactctccaaaaattgatggaaccagaacaccccgagatgagaggagaagagcccagcacaacgaagtggagcggaggcggagggacaagatcaacaactggatcgtccagctttcgaaaatcattccagactgtaacgcagacaacagcaagacgggagcggcctgcgattacatccgggagttgcgccagaccaaccagcgcatgcaggagaccttcaaagaggccgagcggctgcagatggacaacgagctcctgaggcagcagatcgaggagctgaagaatgagaacgccctgcttcgagcccagctgcagcagcacaacctggagatggtgggcgagggcacccggcagtga

SEQ ID NO: 13141 - DNA, 774 bp, synthetic construct
  misc_feature 1..774: note = Synthetic polypeptide
  source 1..774: mol_type = other DNA
ccccggcccggccgtgcccccgcgccccggccccggccccggccccgcggcctgcaggccggggccgccatgatcccgagcggccgcgggcccggctcaaaatggaggccgccggcgcgggggggacctggcgcctcccgcccccggcccccggcctcggcggcgcccccggcctcaggcgcggccggccacgacaagggacccgaggcggaggagggcgtcgagctgcaggaaggcggggacggcccaggagcggaggagcagacagcggtggccatcaccagcgtccagcaggcggcgttcggcgaccacaacatccagtaccagttccgcacagagacaaatggaggacagacaggaacacagaggacgatcgccccccggacacacccttactctccaaaaattgatggaaccagaacaccccgagatgagaggagaagagcccagcacaacgaagtggagcggaggcggagggacaagatcaacaactggatcgtccagctttcgaaaatcattccagactgtaacgcagacaacagcaagacgggagcgagtaaaggagggatcctgtccaaggcctgcgattacatccgggagttgcgccagaccaaccagcgcatgcaggagaccttcaaagaggccgagcggctgcagatggacaacgagctcctgaggcagcagatcgaggagctgaagaatgagaacgccctgcttcgagcccagctgcagcagcacaacctggagatggtgggcgagggcacccggcagtga

SEQ ID NO: 13142 - DNA, 471 bp, synthetic construct
  misc_feature 1..471: note = Synthetic polypeptide
  source 1..471: mol_type = other DNA
ccccggcccggccgtgcccccgcgccccggccccggccccggccccgcggcctgcaggccggggccgccatgatcccgagcggccgcgggcccggctcaaaatggaggccgccggcgcgggggggacctggcgcctcccgcccccggcccccggcctcggcggcgcccccggcctcaggcgcggccggccacgacaagggacccgaggcggaggagggcgtcgagctgcaggaaggtgagtgcttgccgggccggccgcgcccggggagggctgggggcgctcggcgcggccctgaccgtgccccgaccctcctcggccccaggcggggacggcccaggagcggaggagcagacagcggtggccatcaccagcgtccagcaggcggcgttcggcgaccacaacatccagtaccagttccgcacagagacaaatggaggacaggtgacataccgcgtagtccaggtgactga

SEQ ID NO: 13143 - DNA, 1182 bp, synthetic construct
  misc_feature 1..1182: note = Synthetic polypeptide
  source 1..1182: mol_type = other DNA
ccccggcccggccgtgcccccgcgccccggccccggccccggccccgcggcctgcaggccggggccgccatgatcccgagcggccgcgggcccggctcaaaatggaggccgccggcgcgggggggacctggcgcctcccgcccccggcccccggcctcggcggcgcccccggcctcaggcgcggccggccacgacaagggacccgaggcggaggagggcgtcgagctgcaggaaggcggggacggcccaggagcggaggagcagacagcggtggccatcaccagcgtccagcaggcggcgttcggcgaccacaacatccagtaccagttccgcacagagacaaatggaggacaggtgacataccgcgtagtccaggtgactgatggtcagctggacggccagggcgacacagctggcgccgtcagcgtcgtgtccaccgctgccttcgcgggggggcagcaggctgtgacccaggtgggtgtggacggggcagcccagcgcccgggccccgccgctgcctctgtgcccccaggtcctgcagcgcccttcccgctggctgtgatccaaaatcccttcagcaatggtggcagtccggcggccgaggctgtcagcggggaggcacgatttgcctatttcccagcgtccagtgtgggagatactacggctgtgtccgtacagaccacagaccagagcttgcaggctggaggccagttctacgtcatgatgacgccccaggatgtgcttcagacaggaacacagaggacgatcgccccccggacacacccttactctccaaaaattgatggaaccagaacaccccgagatgagaggagaagagcccagcacaacgaagtggagcggaggcggagggacaagatcaacaactggatcgtccagctttcgaaaatcattccagactgtaacgcagacaacagcaagacgggagcgagtaaaggagggatcctgtccaaggcctgcgattacatccgggagttgcgccagaccaaccagcgcatgcaggagaccttcaaagaggccgagcggctgcagatggacaacgagctcctgaggcagcaggtgggtgcggggcctggagcgggtcagggcccaggagccccagatgcaaggcgctggccctcagctcccttgacctccgtcgtgtccgccagatcgaggagctga

SEQ ID NO: 13144 - DNA, 649 bp, synthetic construct
  misc_feature 1..649: note = Synthetic polypeptide
  source 1..649: mol_type = other DNA
ccccggcccggccgtgcccccgcgccccggccccggccccggccccgcggcctgcaggccggggccgccatgatcccgagcggccgcgggcccggctcaaaatggaggccgccggcgcgggggggacctggcgcctcccgcccccggcccccggcctcggcggcgcccccggcctcaggcgcggccggccacgacaagggacccgaggcggaggagggcgtcgagctgcaggaaggcggggacggcccaggagcggaggagcagacagcggtggccatcaccagcgtccagcaggcggcgttcggcgaccacaacatccagtaccagttccgcacagagacaaatggaggacaggtgacataccgcgtagtccaggtgactgatggtcagctggacggccagggcgacacagctggcgccgtcagcgtcgtgtccaccgctgccttcgcgggggggcagcaggctgtgacccaggtgggtgtggacggggcagcccagcgcccgggccccgccgctgcctctgtgcccccaggtcctgcagcgcccttcccgctggtaggtgccctgccacccctgggtgggggggggagggagtggagaggggacactggctctgctcttggggagccccgggggtggggcaggtgtc

SEQ ID NO: 13145 - DNA, 953 bp, synthetic construct
  misc_feature 1..953: note = Synthetic polypeptide
  source 1..953: mol_type = other DNA
cgaggcggttggatcacctgaggtcaggagtttgagaccagcctggccaacacggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaagggagttgctgctgggagctccagctcagtgaaatggacagaagggcagagcaaccacagcacagggtacgagagcgataaccacacaacgcccatcctctgcggagcccaatacagaatacacacgcacggtgtcttcagaggcattcaggatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactggtgagaaaccataccagtgtgacttcaaggactgtgaacgaaggttttctcgttcagaccagctcaaaagacaccaaaggagacatacaggtgtgaaaccattccagtgtaaaacttgtcagcgaaagttctcccggtccgaccacctgaagacccacaccaggactcatacaggtgaaaagcccttcagctgtcggtggccaagttgtcagaaaaagtttgcccggtcagatgaattagtccgccatcacaacatgcatcagagaaacatgaccaaactccagctggcgctttga

SEQ ID NO: 13146 - DNA, 362 bp, synthetic construct
  misc_feature 1..362: note = Synthetic polypeptide
  source 1..362: mol_type = other DNA
cgaggcggttggatcacctgaggtcaggagtttgagaccagcctggccaacacggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaaggggtaa

SEQ ID NO: 13147 - DNA, 962 bp, synthetic construct
  misc_feature 1..962: note = Synthetic polypeptide
  source 1..962: mol_type = other DNA
cgaggcggttggatcacctgaggtcaggagtttgagaccagcctggccaacacggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaagggagttgctgctgggagctccagctcagtgaaatggacagaagggcagagcaaccacagcacagggtacgagagcgataaccacacaacgcccatcctctgcggagcccaatacagaatacacacgcacggtgtcttcagaggcattcaggatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactggtgagaaaccataccagtgtgacttcaaggactgtgaacgaaggttttctcgttcagaccagctcaaaagacaccaaaggagacatacaggtgtgaaaccattccagtgtaaaacttgtcagcgaaagttctcccggtccgaccacctgaagacccacaccaggactcatacaggtaaaacaagtgaaaagcccttcagctgtcggtggccaagttgtcagaaaaagtttgcccggtcagatgaattagtccgccatcacaacatgcatcagagaaacatgaccaaactccagctggcgctttga

SEQ ID NO: 13148 - DNA, 911 bp, synthetic construct
  misc_feature 1..911: note = Synthetic polypeptide
  source 1..911: mol_type = other DNA
cgaggcggttggatcacctgaggtcaggagtttgagaccagcctggccaacacggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaagggccacagcacagggtacgagagcgataaccacacaacgcccatcctctgcggagcccaatacagaatacacacgcacggtgtcttcagaggcattcaggatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactggtgagaaaccataccagtgtgacttcaaggactgtgaacgaaggttttctcgttcagaccagctcaaaagacaccaaaggagacatacaggtgtgaaaccattccagtgtaaaacttgtcagcgaaagttctcccggtccgaccacctgaagacccacaccaggactcatacaggtaaaacaagtgaaaagcccttcagctgtcggtggccaagttgtcagaaaaagtttgcccggtcagatgaattagtccgccatcacaacatgcatcagagaaacatgaccaaactccagctggcgctttga

SEQ ID NO: 13149 - DNA, 902 bp, synthetic construct
  misc_feature 1..902: note = Synthetic polypeptide
  source 1..902: mol_type = other DNA
cgaggcggttggatcacctgaggtcaggagtttgagaccagcctggccaacacggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaagggccacagcacagggtacgagagcgataaccacacaacgcccatcctctgcggagcccaatacagaatacacacgcacggtgtcttcagaggcattcaggatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactggtgagaaaccataccagtgtgacttcaaggactgtgaacgaaggttttctcgttcagaccagctcaaaagacaccaaaggagacatacaggtgtgaaaccattccagtgtaaaacttgtcagcgaaagttctcccggtccgaccacctgaagacccacaccaggactcatacaggtgaaaagcccttcagctgtcggtggccaagttgtcagaaaaagtttgcccggtcagatgaattagtccgccatcacaacatgcatcagagaaacatgaccaaactccagctggcgctttga

SEQ ID NO: 13150 - DNA, 809 bp, synthetic construct; identical to SEQ ID NO: 8613
  misc_feature 1..809: note = Synthetic polypeptide
  source 1..809: mol_type = other DNA

SEQ ID NO: 13151 - DNA, 512 bp, synthetic construct
  misc_feature 1..512: note = Synthetic polypeptide
  source 1..512: mol_type = other DNA
gctgggcaccggggctcacacctgtaatcccagcactttgggaggccaagaaccaaaaacttttgctagaaaatcagcttttacgagagaaaactcatggccttgtagttgagaaccaggagttaagacagcgcttggggatggatgccctggttgctgaagaggaggcggaagccaaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaa

SEQ ID NO: 13152 - DNA, 857 bp, synthetic construct
  misc_feature 1..857: note = Synthetic polypeptide
  source 1..857: mol_type = other DNA
gctgggcaccggggctcacacctgtaatcccagcactttgggaggccaagaaccaaaaacttttgctagaaaatcagcttttacgagagaaaactcatggccttgtagttgagaaccaggagttaagacagcgcttggggatggatgccctggttgctgaagaggaggcggaagccaaggggaatgaagtgaggccagtggccgggtctgctgagtccgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaa

SEQ ID NO: 13153 - DNA, 1448 bp, synthetic construct
  misc_feature 1..1448: note = Synthetic polypeptide
  source 1..1448: mol_type = other DNA
tctgcctctccctctccctctccctctccccatggtctccctctccctctctttccaccgtctccctctcacgccaagccaaagctggactatactgctgccatctcggctcactgcaacctccctgcctgattctcctgcctcagcctgcggagtgcctgcaattgcaggcgcgcgccgccacgcctgactggttttcctatttttttggtggagacggggtttcgctgtgttggccgggctggtctccagctcctaaccgtgagtcatccgccagcctcggcctcccgaggtgccgggattgcagacggagtctggttcactcagtgctcagtggcgcccaggctggagtgcagtggcgtgatctcggctggctacaacctccacctcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctctgcccggccgccatcccatctgggaagtgaggagcgcctcttccaggccgccatcccatctaggaagtgaggagcgtctctgcccggccgcccatcgtctgagatgtggggagcgcctttgccccgccgccccgtctgggatgtgaggagcgcctctgcccagccgcgaccccgtctgggaggtgaggagcgtctctgcccggccgccccgtctgagaagtgaggagaccctccgcccggcagccgccccgtctgagaagttaggagcctctccgcccggcagccgccccgtctgggaagtgaggagcgtctctgcccggcagccaccccgtccgggagggaggtggggggggtcagccccccgcccggccagccgccccgtccgggagagtcatggaggtctggcatggcttagtgatcgcggtggtgtccctcttcctgcaggcctgcttcctcaccgccatcaactacctgctcagcaggcacatggcccacaagagtgaacagatactgaaagcggccagtctccaggttcccaggcccagccctggccaccatcatccacctgctgtcaaagagatgaaggagactcagacagagagagacatcccaatgtctgattccctttacaggcatgacagcgacacaccctcagatagcttggatagctcctgcagttcgcctcctgcctgccaggccacagaggatgtggattacacacaagtcgtcttttctgaccctggagaactaaaaaatgactccccgctggactatgagaacataaaggaaatcacagattatgtcaatgtcaatccagaaagacacaagcccagtttctggtattttgtcaaccctgctctgtctgagccagcggaatatgatcaagtggccatgtga

SEQ ID NO: 13154 - DNA, 864 bp, synthetic construct; identical to SEQ ID NO: 6737
  misc_feature 1..864: note = Synthetic polypeptide
  source 1..864: mol_type = other DNA

SEQ ID NO: 13155 - DNA, 2662 bp, synthetic construct; identical to SEQ ID NO: 8473
  misc_feature 1..2662: note = Synthetic polypeptide
  source 1..2662: mol_type = other DNA

SEQ ID NO: 13156 - DNA, 1822 bp, synthetic construct; identical to SEQ ID NO: 8474
  misc_feature 1..1822: note = Synthetic polypeptide
  source 1..1822: mol_type = other DNA

SEQ ID NO: 13157 - DNA, 610 bp, synthetic construct
  misc_feature 1..610: note = Synthetic polypeptide
  source 1..610: mol_type = other DNA
ggaggcaggtgtgtggggggaagcggccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtccagccctag

SEQ ID NO: 13158 - DNA, 796 bp, synthetic construct; identical to SEQ ID NO: 8652
  misc_feature 1..796: note = Synthetic polypeptide
  source 1..796: mol_type = other DNA

SEQ ID NO: 13159 - DNA, 383 bp, synthetic construct; identical to SEQ ID NO: 8653
  misc_feature 1..383: note = Synthetic polypeptide
  source 1..383: mol_type = other DNA

SEQ ID NO: 13160 - DNA, 155 bp, synthetic construct; identical to SEQ ID NO: 8654
  misc_feature 1..155: note = Synthetic polypeptide
  source 1..155: mol_type = other DNA

SEQ ID NO: 13161 - DNA, 118 bp, synthetic construct; identical to SEQ ID NO: 8655
  misc_feature 1..118: note = Synthetic polypeptide
  source 1..118: mol_type = other DNA

SEQ ID NO: 13162 - DNA, 193 bp, synthetic construct; identical to SEQ ID NO: 8656
  misc_feature 1..193: note = Synthetic polypeptide
  source 1..193: mol_type = other DNA

SEQ ID NO: 13163 - DNA, 103 bp, synthetic construct; identical to SEQ ID NO: 8657
  misc_feature 1..103: note = Synthetic polypeptide
  source 1..103: mol_type = other DNA

SEQ ID NO: 13164 - DNA, 230 bp, synthetic construct; identical to SEQ ID NO: 8658
  misc_feature 1..230: note = Synthetic polypeptide
  source 1..230: mol_type = other DNA

SEQ ID NO: 13165 - DNA, 279 bp, synthetic construct; identical to SEQ ID NO: 8659
  misc_feature 1..279: note = Synthetic polypeptide
  source 1..279: mol_type = other DNA

SEQ ID NO: 13166 - DNA, 2887 bp, synthetic construct; identical to SEQ ID NO: 8311
  misc_feature 1..2887: note = Synthetic polypeptide
  source 1..2887: mol_type = other DNA

SEQ ID NO: 13167 - DNA, 2941 bp, synthetic construct; identical to SEQ ID NO: 8312
  misc_feature 1..2941: note = Synthetic polypeptide
  source 1..2941: mol_type = other DNA

SEQ ID NO: 13168 - DNA, 2980 bp, synthetic construct; identical to SEQ ID NO: 8313
  misc_feature 1..2980: note = Synthetic polypeptide
  source 1..2980: mol_type = other DNA

SEQ ID NO: 13169 - DNA, 2887 bp, synthetic construct; identical to SEQ ID NO: 8314
  misc_feature 1..2887: note = Synthetic polypeptide
  source 1..2887: mol_type = other DNA

SEQ ID NO: 13170 - DNA, 3046 bp, synthetic construct; identical to SEQ ID NO: 8315
  misc_feature 1..3046: note = Synthetic polypeptide
  source 1..3046: mol_type = other DNA

SEQ ID NO: 13171 - DNA, 2959 bp, synthetic construct; identical to SEQ ID NO: 8316
  misc_feature 1..2959: note = Synthetic polypeptide
  source 1..2959: mol_type = other DNA

SEQ ID NO: 13172 - DNA, 2941 bp, synthetic construct; identical to SEQ ID NO: 8317
  misc_feature 1..2941: note = Synthetic polypeptide
  source 1..2941: mol_type = other DNA

SEQ ID NO: 13173 - DNA, 940 bp, synthetic construct; identical to SEQ ID NO: 8318
  misc_feature 1..940: note = Synthetic polypeptide
  source 1..940: mol_type = other DNA

SEQ ID NO: 13174 - DNA, 796 bp, synthetic construct; identical to SEQ ID NO: 8676
  misc_feature 1..796: note = Synthetic polypeptide
  source 1..796: mol_type = other DNA

SEQ ID NO: 13175 - DNA, 272 bp, synthetic construct; identical to SEQ ID NO: 8677
  misc_feature 1..272: note = Synthetic polypeptide
  source 1..272: mol_type = other DNA

SEQ ID NO: 13176 - DNA, 226 bp, synthetic construct; identical to SEQ ID NO: 8678
  misc_feature 1..226: note = Synthetic polypeptide
  source 1..226: mol_type = other DNA

SEQ ID NO: 13177 - DNA, 175 bp, synthetic construct; identical to SEQ ID NO: 8679
  misc_feature 1..175: note = Synthetic polypeptide
  source 1..175: mol_type = other DNA

SEQ ID NO: 13178 - DNA, 886 bp, synthetic construct
  misc_feature 1..886: note = Synthetic polypeptide
  source 1..886: mol_type = other DNA
ggccaggcatggtggctcacgcctgtagtcccagcacttttggaggctgaggcagttggatcacctgaagtcaggagttcaagaccagcctggccaacatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagaagaaaattgatctagggaagacaacgtag

SEQ ID NO: 13179 - DNA, 901 bp, synthetic construct
  misc_feature 1..901: note = Synthetic polypeptide
  source 1..901: mol_type = other DNA
ggccaggcatggtggctcacgcctgtagtcccagcacttttggaggctgaggcagttggatcacctgaagtcaggagttcaagaccagcctggccaacatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtacatgctgtggagatccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagaagaaaattgatctagggaagacaacgtag

SEQ ID NO: 13180 - DNA, 901 bp, synthetic construct
  misc_feature 1..901: note = Synthetic polypeptide
  source 1..901: mol_type = other DNA
ggccaggcatggtggctcacgcctgtagtcccagcacttttggaggctgaggcagttggatcacctgaagtcaggagttcaagaccagcctggccaacatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtccagggggaggaagtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagaagaaaattgatctagggaagacaacgtag

SEQ ID NO: 13181 - DNA, 931 bp, synthetic construct
  misc_feature 1..931: note = Synthetic polypeptide
  source 1..931: mol_type = other DNA
ggccaggcatggtggctcacgcctgtagtcccagcacttttggaggctgaggcagttggatcacctgaagtcaggagttcaagaccagcctggccaacatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgggtgtgtgtgcaggttaaagatgatagcacggagcctggcttgtgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagaagaaaattgatctagggaagacaacgtag

SEQ ID NO: 13182 - DNA, 707 bp, synthetic construct
  misc_feature 1..707: note = Synthetic polypeptide
  source 1..707: mol_type = other DNA
ggccaggcatggtggctcacgcctgtagtcccagcacttttggaggctgaggcagttggatcacctgaagtcaggagttcaagaccagcctggccaacatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagaggtactgaggacaaatcagttctctgtgaccagacatgagaaggttgccaatgggctgttgggcgaccaaggccttcccggagtcttcgtcctct

SEQ ID NO: 13183 - DNA, 591 bp, synthetic construct
  misc_feature 1..591: note = Synthetic polypeptide
  source 1..591: mol_type = other DNA
tgctttggttcgaatgtgttcctccatgttgccagtgggatggtagtaaaaggctcctgggtagaactgcacttcagcaataatgggaacgggggcagcgttccagcctcggtttctatttataatggagacatggaaaaaatactgctggacgcacagcatgagtctggacggagtagctccaagagctctcactgtgacagcccacctcgctcgcagacaccacaagataccaacagagcttctgaaacagatacccatagcattggagagaaaaacagctcacagtctgaggaagatgatattgaaagaaggaaagaagttgaaagcatcttgaagaaaaactcagattggatatgggattggtcaagtcggccggaaaatattccccccaaggagttcctctttaaacacccgaagcgcacggccaccctcagcatgaggaacacgagcgtcatgaagaaagggggcatattctctgcagaatttctgaaagttttccttccatctctgctgctctctcatttgctggccatcggattggggatctatattggaaggcgtctgacaacctccaccagcaccttttga

SEQ ID NO: 13184 - DNA, 549 bp, synthetic construct
  misc_feature 1..549: note = Synthetic polypeptide
  source 1..549: mol_type = other DNA
tgctttggttcgaatgtgttcctccatgttgccagtgggatggtagtaaaaggctcctgggtagaactgcacttcagcaataatgggaacgggggcagcgttccagcctcggtttctatttataatggagacatggaaaaaatactgctggacgcacagcatgagtctggacggagtagctccaagagctctcactgtgacagcccacctcgctcgcagacaccacaagataccaacagagcttctgaaacagatacccatagcattggagagaaaaacagctcacagtctgaggaagatgatattgaaagaaggaaagaagttgaaagcatcttgaagaaaaactcagattggatatgggattggtcaagtcggccggaaaatattccccccaaggagttcctctttaaacacccgaagcgcacggccaccctcagcatgaggaacacgagcgtcatgaagaaagggggcatattctctgcagaatttctgaaagttttccttccatctctgctgctctctcatttgctggccatcggattggggtag

SEQ ID NO: 13185 - DNA, 811 bp, synthetic construct; identical to SEQ ID NO: 7106
  misc_feature 1..811: note = Synthetic polypeptide
  source 1..811: mol_type = other DNA

SEQ ID NO: 13186 - DNA, 650 bp, synthetic construct
  misc_feature 1..650: note = Synthetic polypeptide
  source 1..650: mol_type = other DNA
ggccgggtgcggtggctgacacctgtaatcccagcactttgggagcccgaggcgggcggatcacctgaggtcgggagttcaagaccagcctgaccaacatggagaaaccctgtctctactaaaaatacaaaattagccgggcgtggtggcagatgcctgtaatcccagctactcagaaggctgaggcaggagaatcacttgaacctgggaagtggaggttgaggatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccgggtgagggcggggcctggaggggcagacggggtgggctggacactggcccgtgtgcccaggcctgggacagccctggcctgtttcttcggaggtcctcagggagaggcggcggtgatggaagaacagggacttccaccacaggctccaggacatgtggactga

SEQ ID NO: 13187 - DNA, 521 bp, synthetic construct
  misc_feature 1..521: note = Synthetic polypeptide
  source 1..521: mol_type = other DNA
ggccgggtgcggtggctgacacctgtaatcccagcactttgggagcccgaggcgggcggatcacctgaggtcgggagttcaagaccagcctgaccaacatggagaaaccctgtctctactaaaaatacaaaattagccgggcgtggtggcagatgcctgtaatcccagctactcagaaggctgaggcaggagaatcacttgaacctgggaagtggaggttgaggatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccggacgtgcctgcttccccttcgccttctgccgtga

SEQ ID NO: 13188 - DNA, 524 bp, synthetic construct
  misc_feature 1..524: note = Synthetic polypeptide
  source 1..524: mol_type = other DNA
ggccgggtgcggtggctgacacctgtaatcccagcactttgggagcccgaggcgggcggatcacctgaggtcgggagttcaagaccagcctgaccaacatggagaaaccctgtctctactaaaaatacaaaattagccgggcgtggtggcagatgcctgtaatcccagctactcagaaggctgaggcaggagaatcacttgaacctgggaagtggaggttgaggatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaactctgccccagagcacatcagctatgtgccccagctctcaaacgacaccttggcggggaggctcaccctgtccaccttcacgctggagcagcctctaggccagttcagcagccacaacatctctga

SEQ ID NO: 13189 - DNA, 996 bp, synthetic construct
  misc_feature 1..996: note = Synthetic polypeptide
  source 1..996: mol_type = other DNA
ggccgggtgcggtggctgacacctgtaatcccagcactttgggagcccgaggcgggcggatcacctgaggtcgggagttcaagaccagcctgaccaacatggagaaaccctgtctctactaaaaatacaaaattagccgggcgtggtggcagatgcctgtaatcccagctactcagaaggctgaggcaggagaatcacttgaacctgggaagtggaggttgaggatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaacttctggcatggaaaagcccctgtgcaactggtaaagatatcaataagcaccaggaggtatctaaatccaccaggagccataggcatcacgttgacatccatttaccagtcttccctggcaagattcttctgaattgtgctgccttggccaaaagagctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaacaaagtggtccagcgacactcgcc

SEQ ID NO: 13190 - DNA, 717 bp, synthetic construct
  misc_feature 1..717: note = Synthetic polypeptide
  source 1..717: mol_type = other DNA
ggccgggtgcggtggctgacacctgtaatcccagcactttgggagcccgaggcgggcggatcacctgaggtcgggagttcaagaccagcctgaccaacatggagaaaccctgtctctactaaaaatacaaaattagccgggcgtggtggcagatgcctgtaatcccagctactcagaaggctgaggcaggagaatcacttgaacctgggaagtggaggttgaggatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaacttctggcatggaaaagcccctgtgcaactggtaaagatatcaataagcaccaggaggtatctaaatccaccaggagccataggcatcacgttgacatccatttaccagtcttccctggcaagattcttctgaattgtgctgccttggccaaaagagctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacg

SEQ ID NO: 13191 - DNA, 404 bp, synthetic construct
  misc_feature 1..404: note = Synthetic polypeptide
  source 1..404: mol_type = other DNA
ggccgggtgcggtggctgacacctgtaatcccagcactttgggagcccgaggcgggcggatcacctgaggtcgggagttcaagaccagcctgaccaacatggagaaaccctgtctctactaaaaatacaaaattagccgggcgtggtggcagatgcctgtaatcccagctactcagaaggctgaggcaggagaatcacttgaacctgggaagtggaggttgaggatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaactatga

SEQ ID NO: 13192 - DNA, 404 bp, synthetic construct
  misc_feature 1..404: note = Synthetic polypeptide
  source 1..404: mol_type = other DNA
ggccgggtgcggtggctgacacctgtaatcccagcactttgggagcccgaggcgggcggatcacctgaggtcgggagttcaagaccagcctgaccaacatggagaaaccctgtctctactaaaaatacaaaattagccgggcgtggtggcagatgcctgtaatcccagctactcagaaggctgaggcaggagaatcacttgaacctgggaagtggaggttgaggatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaactgtga

SEQ ID NO: 13193 - DNA, 395 bp, synthetic construct
  misc_feature 1..395: note = Synthetic polypeptide
  source 1..395: mol_type = other DNA
ggccgggtgcggtggctgacacctgtaatcccagcactttgggagcccgaggcgggcggatcacctgaggtcgggagttcaagaccagcctgaccaacatggagaaaccctgtctctactaaaaatacaaaattagccgggcgtggtggcagatgcctgtaatcccagctactcagaaggctgaggcaggagaatcacttgaacctgggaagtggaggttgaggatcaccattaacaaggacaccaaggtacccaatgcctgtttattcaccatcaacaaagaagaccacacactgggaaacatcattaaatcgctggagtgcaatggcacgatcttgctcactgcaacctccgcctcccgggttcaagtgattctcctgcttcagccttcctag

SEQ ID NO: 13194 - DNA, 772 bp, synthetic construct
  misc_feature 1..772: note = Synthetic polypeptide
  source 1..772: mol_type = other DNA
ggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtgctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggacgagctgctgtttcccagctgggaggctctgttctcaggctctgagggtccgctgaagcccggggcacgcatcttctcctttgacggcaaggacgtcctgaggcaccccacctggccccagaagagcgtgtggcatggctcggaccccaacgggcgcaggctgaccgagagctactgtgagacgtggcggacggaggctccctcggccacgggccaggcctcctcgctgctggggggcaggctcctggggcagagtgccgcgagctgccatcacgcctacatcgtgctctgcattgagaacagcttcatgactgcctccaagtag

SEQ ID NO: 13195 - DNA, 637 bp, synthetic construct
  misc_feature 1..637: note = Synthetic polypeptide
  source 1..637: mol_type = other DNA
ggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtgctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggacgagctgctgtttcccagctgggaggctctgttctcaggctctgagggtccgctgaagcccggggcacgcatcttctcctttgacggcaaggacgtcctgaggcaccccacctggccccagaagagcgtgtggcatggctcggaccccaacgggcgcaggctgaccgagagctactgtgagacgtggcgg

SEQ ID NO: 13196 - DNA, 83 bp, synthetic construct; identical to SEQ ID NO: 10925
  misc_feature 1..83: note = Synthetic polypeptide
  source 1..83: mol_type = other DNA

SEQ ID NO: 13197 - DNA, 555 bp, synthetic construct; identical to SEQ ID NO: 10926
  misc_feature 1..555: note = Synthetic polypeptide
  source 1..555: mol_type = other DNA

SEQ ID NO: 13198 - DNA, 650 bp, synthetic construct
  misc_feature 1..650: note = Synthetic polypeptide
  source 1..650: mol_type = other DNA
ggaggcaggtgtgtggggggaagcgggtgtgtgtctgaggaagcgggtgtgtgtggggggaagcggccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtccagccctag

SEQ ID NO: 13199 - DNA, 1084 bp, synthetic construct; identical to SEQ ID NO: 580
  misc_feature 1..1084: note = Synthetic polypeptide
  source 1..1084: mol_type = other DNA

SEQ ID NO: 13200 - DNA, 308 bp, synthetic construct; identical to SEQ ID NO: 7506
  misc_feature 1..308: note = Synthetic polypeptide
  source 1..308: mol_type = other DNA

SEQ ID NO: 13201 - DNA, 423 bp, synthetic construct; identical to SEQ ID NO: 7507
  misc_feature 1..423: note = Synthetic polypeptide
  source 1..423: mol_type = other DNA

SEQ ID NO: 13202 - DNA, 369 bp, synthetic construct; identical to SEQ ID NO: 7508
  misc_feature 1..369: note = Synthetic polypeptide
  source 1..369: mol_type = other DNA

SEQ ID NO: 13203 - DNA, 456 bp, synthetic construct; identical to SEQ ID NO: 7509
  misc_feature 1..456: note = Synthetic polypeptide
  source 1..456: mol_type = other DNA

SEQ ID NO: 13204 - DNA, 1052 bp, synthetic construct; identical to SEQ ID NO: 447
  misc_feature 1..1052: note = Synthetic polypeptide
  source 1..1052: mol_type = other DNA

SEQ ID NO: 13205 - DNA, 1118 bp, synthetic construct; identical to SEQ ID NO: 448
  misc_feature 1..1118: note = Synthetic polypeptide
  source 1..1118: mol_type = other DNA

SEQ ID NO: 13206 - DNA, 309 bp, synthetic construct; identical to SEQ ID NO: 8320
  misc_feature 1..309: note = Synthetic polypeptide
  source 1..309: mol_type = other DNA
